(12) United States Patent
Gaitanaris et al.

(10) Patent No.: US 8,999,654 B2
(45) Date of Patent: Apr. 7, 2015

(54) METHOD OF IDENTIFYING A COMPOUND FOR THE TREATMENT OR PREVENTION OF OBESITY

(75) Inventors: George A. Gaitanaris, Seattle, WA (US); John E. Bergmann, Mercer Island, WA (US); Alexander Gragerov, Seattle, WA (US); John Hohmann, La Conner, WA (US); Fusheng Li, Seattle, WA (US); Linda Madisen, Seattle, WA (US); Kellie L. McIlwain, Washington, DC (US); Maria N. Pavlova, Seattle, WA (US); Demetri Vassilatis, Seattle, WA (US); Hongkui Zeng, Shoreline, WA (US)

(73) Assignee: Omeros Corporation, Seattle, WA (US)

( * ) Notice: Subject to any disclaimer, the term of this patent is extended or adjusted under 35 U.S.C. 154(b) by 0 days.

(21) Appl. No.: 12/916,227

(22) Filed: Oct. 29, 2010
(Under 37 CFR 1.47)

(65) Prior Publication Data
US 2011/0214189 A1 Sep. 1, 2011

Related U.S. Application Data

(63) Continuation of application No. 11/940,917, filed on Nov. 15, 2007, now abandoned, which is a continuation-in-part of application No. 10/527,265, filed as application No. PCT/US03/28226 on Sep. 9, 2003, now abandoned.

(60) Provisional application No. 60/409,303, filed on Sep. 9, 2003, provisional application No. 60/461,329, filed on Apr. 9, 2003, provisional application No. 60/859,469, filed on Nov. 15, 2006, provisional application No. 60/859,473, filed on Nov. 15, 2006, provisional application No. 60/859,470, filed on Nov. 15, 2006.

(51) Int. Cl.
| | | |
|---|---|---|
| G01N 33/566 | (2006.01) |
| C07K 14/72 | (2006.01) |
| C12Q 1/68 | (2006.01) |
| C07K 14/705 | (2006.01) |
| A61K 38/00 | (2006.01) |

(52) U.S. Cl.
CPC ............ *C07K 14/723* (2013.01); *C12Q 1/6883* (2013.01); *A61K 38/00* (2013.01); *G01N 2333/726* (2013.01); *G01N 2800/04* (2013.01); *G01N 2800/28* (2013.01); *G01N 2800/50* (2013.01); *A01K 2217/00* (2013.01); *C12Q 2600/106* (2013.01); *C12Q 2600/136* (2013.01); *C12Q 2600/156* (2013.01); *C12Q 2600/158* (2013.01)

(58) Field of Classification Search
None
See application file for complete search history.

(56) References Cited

U.S. PATENT DOCUMENTS

| | | |
|---|---|---|
| 4,816,567 A | 3/1989 | Cabilly et al. |
| 4,946,778 A | 8/1990 | Ladner et al. |
| 4,987,071 A | 1/1991 | Cech et al. |
| 5,091,513 A | 2/1992 | Huston et al. |
| 5,132,405 A | 7/1992 | Huston et al. |
| 5,229,275 A | 7/1993 | Goroff |
| 5,334,711 A | 8/1994 | Sproat et al. |
| 5,464,764 A | 11/1995 | Capecchi et al. |
| 5,487,992 A | 1/1996 | Capecchi et al. |
| 5,545,807 A | 8/1996 | Surani et al. |
| 5,565,332 A | 10/1996 | Hoogenboom et al. |
| 5,567,610 A | 10/1996 | Borrebaeck et al. |
| 5,573,905 A | 11/1996 | Lerner et al. |
| 5,589,369 A | 12/1996 | Seidman et al. |
| 5,591,669 A | 1/1997 | Krimpenfort et al. |
| 5,610,288 A | 3/1997 | Rubenstein |
| 5,612,205 A | 3/1997 | Kay et al. |
| 5,627,059 A | 5/1997 | Capecchi et al. |
| 5,631,359 A | 5/1997 | Chowrira et al. |
| 5,739,119 A | 4/1998 | Galli et al. |
| 5,747,470 A | 5/1998 | Becherer et al. |
| 5,759,829 A | 6/1998 | Shewmaker et al. |
| 5,770,429 A | 6/1998 | Lonberg et al. |

(Continued)

FOREIGN PATENT DOCUMENTS

| | | |
|---|---|---|
| CA | 2609116 A1 | 4/2007 |
| EP | 0 360 257 | 9/1989 |

(Continued)

OTHER PUBLICATIONS

Zambrowicz et al. Predicting drug efficacy: knockouts model pipeline drugs of the pharmaceutical industry, 2003, Current Opinion in Pharmacology 3:563-570.*

Brighton, et al., "Neuromedin U and its Receptors: Structure, Function and Physiological Roles," *Pharma. Rev.* 56(2):231-248 (2004).

Yu, et al., "Pro-nociceptive Effects of Neuromedin U in Rat," *Neuroscience* 120:467-474 (2003).

Cao, et al., "A Pro-nociceptive Role of Neuromedin U in Adult Mice," *Pain* 104:609-616 (2003).

Mizushima, et al., "A Novel G-Protein-Coupled Receptor Gene Expressed in Striatum," *Genomics* 69:314-321 (2000).

Stadel, et al., "Orphan G protien-coupled receptors; a neglected opportunity for pioneer drug discovery," *TRENDS in Pharmacological Sciences* 18:430-437 (1997).

(Continued)

*Primary Examiner* — John Ulm
(74) *Attorney, Agent, or Firm* — Tineka J. Quinton; Marcia S. Kelbon

(57) ABSTRACT

The present invention provides GPCR polypeptides and polynucleotides, recombinant materials, and transgenic mice, as well as methods for their production. The polypeptides and polynucleotides are useful, for example, in methods of diagnosis and treatment of diseases and disorders. The invention also provides methods for identifying compounds (e.g., agonists or antagonists) using the GPCR polypeptides and polynucleotides of the invention, and for treating conditions associated with GPCR dysfunction with the GPCR polypeptides, polynucleotides, or identified compounds. The invention also provides diagnostic assays for detecting diseases or disorders associated with inappropriate GPCR activity or levels.

1 Claim, 59 Drawing Sheets

(56) References Cited

U.S. PATENT DOCUMENTS

| | | | |
|---|---|---|---|
| 5,783,683 | A | 7/1998 | Morrison |
| 5,789,215 | A | 8/1998 | Berns et al. |
| 5,789,573 | A | 8/1998 | Baker et al. |
| 5,801,154 | A | 9/1998 | Baracchini et al. |
| 5,833,985 | A | 11/1998 | Ball et al. |
| 5,837,243 | A | 11/1998 | Deo et al. |
| 5,922,845 | A | 7/1999 | Deo et al. |
| 6,071,517 | A | 6/2000 | Fanger et al. |
| 6,071,722 | A | 6/2000 | Elshourbagy et al. |
| 6,096,311 | A | 8/2000 | Fanger et al. |
| 6,111,166 | A | 8/2000 | Van de Winkel |
| 6,204,061 | B1 | 3/2001 | Capecchi et al. |
| 6,228,639 | B1 | 5/2001 | Gaitanaris |
| 6,270,765 | B1 | 8/2001 | Deo et al. |
| 6,303,755 | B1 | 10/2001 | Deo et al. |
| 6,410,690 | B1 | 6/2002 | Deo et al. |
| 6,555,344 | B1 | 4/2003 | Matsumoto et al. |
| 6,682,928 | B2 | 1/2004 | Keler et al. |
| 6,984,720 | B1 | 1/2006 | Korman et al. |
| 2001/0056581 | A1 | 12/2001 | Gaitanaris |
| 2002/0012996 | A1 | 1/2002 | Gaitanaris |
| 2002/0083481 | A1 | 6/2002 | Gaitanaris |
| 2002/0115210 | A1 | 8/2002 | Gaitanaris |
| 2005/0059078 | A1 | 3/2005 | Gaitanaris |
| 2006/0134109 | A1 | 6/2006 | Gaitanaris et al. |
| 2011/0185439 | A1 | 7/2011 | Gaitanaris et al. |

FOREIGN PATENT DOCUMENTS

| | | |
|---|---|---|
| EP | 1 690 939 A2 | 8/2006 |
| WO | WO 84/03712 A2 | 9/1984 |
| WO | WO 91/03162 A1 | 3/1991 |
| WO | WO 92/07065 A1 | 4/1992 |
| WO | WO 93/15187 A1 | 8/1993 |
| WO | WO 93/23569 A1 | 11/1993 |
| WO | WO 94/02595 A1 | 2/1994 |
| WO | WO 94/13688 A1 | 6/1994 |
| WO | WO 99/32619 A1 | 7/1999 |
| WO | WO 00/64928 A2 | 11/2000 |
| WO | WO 01/07612 A2 | 2/2001 |
| WO | WO 01/29058 A1 | 4/2001 |
| WO | WO 01/31014 A2 | 5/2001 |
| WO | WO 01/32865 A1 | 5/2001 |
| WO | WO 01/68836 A2 | 9/2001 |
| WO | WO 01/75164 A2 | 10/2001 |
| WO | WO 01/92513 A1 | 12/2001 |
| WO | WO 01/96584 A2 | 12/2001 |
| WO | WO 02/44321 A2 | 6/2002 |
| WO | WO 02/061432 A2 | 8/2002 |
| WO | WO 03/016553 A2 | 2/2003 |
| WO | WO 03/065984 A2 | 8/2003 |
| WO | WO 2004/040000 A2 | 5/2004 |
| WO | WO 2005/047905 A1 | 5/2005 |
| WO | WO 2005/050221 A1 | 6/2005 |
| WO | WO 2005/075991 A1 | 8/2005 |
| WO | WO 2008/061209 A2 | 5/2008 |

OTHER PUBLICATIONS

Howard, et al., "Orphan G-protein-coupled receptors and natural ligand discovery," *TRENDS in Pharmacological Sciences* 22(3):132-140 (2001).

Iida, et al., "Identification of 156 novel SNPs in 29 genes encoding G-protein coupled receptors," *J Hum Genet* 50:182-191 (2005).

Buscher, et al., "PCR-Based Methods for Identifying Genetic Variations in Human $\alpha_{1B}$- and $\beta_2$-Andrenergic Receptors[1]," *Molecular Genetics and Metabolism* 64:266-270 (1998).

Tao, Y-X., "Inactivating mutations of G protein-coupled receptors and diseases: Structure function insights and therapeutic implications," *Pharmacology & Therapeutics* 111:949-973 (2006).

Schoneberg, et al., "Mutant G-protein-coupled receptors as a cause of human diseases," *Pharmacology & Therapeutics* 104:173-206 (2004).

Hein, et al., "Adrenergic Receptors: From Molecular Structure to in vivo Function," *TCM* 7(5):137-145 (1997).

Boulton, et al., "ERKs: A Family of Protein-Serine/Threonine Kinases that are Activated and Tyrosine Phosphorylated in Response to Insulin and NGF," *Cell* 65:663-675 (1991).

Conklin, et al., "Substitution of three amino acids switches receptor specificity of $G_q\alpha$ to that of $G_i\alpha$," *Nature* 363:274-276 (1993).

Venter, et al., "The Sequence of the Human Genome," *Science* 291:1304-1351 (2001).

Dooley, et al., "Binding and IN Vitro Activities of Peptides with High Affinity for the Nociceptin/Orphanin FQ Receptor, ORL1[1]," *The Journal of Pharmacology and Experimental Therapeutics* 283(2):735-741 (1997).

Dunlop, et al., "Characterization of 5-HT 1A Receptor Functioning Coupling in Cells Expressing the Human 5-HT1A Receptor as Assessed with the Cytosensor Microphysiometer," *Journal of Pharmacological and Toxicological Methods* 40(1):47-55 (1998).

Frandsen, et al., "A Simple Ultrasensitive Method for the Assay of Cyclic AMP and Cyclic GMP in Tissues," *Life Sciences* 18(5): 529-542 (1976).

George, et al., "Evaluation of a CRE-Directed Luciferase Reporter Gene Assay as an Alternative to Measuring cAMP Accumulation," *Journal of Biomolecular Screening* 2(4):235-240 (1997).

Hinuma, et al., "A prolactin-releasing peptide in the brain," *Nature* 393:272-276, 302 (1998).

Jayawickreme, et al., "Gene expression systems in the development of high-throughput screens," *Current Opinion in Biotchnology* 8:629-634 (1997).

Kanterman, et al., "Transfected $D_2$ Dopamine Receptors Mediate the Potentiation of Arachidonic Acid Release in Chinese Hamster Ovary Cells," *Molecular Pharmacology* 39:364-369 (1990).

Kowal, et al., "A [$^{35}$S]GTPγS binding assessment of metabotropic glutamate receptor standards in Chinese hamster ovary cell lines expressing the human metabotropic receptor subtypes 2 and 4," *Neuropharmacology* 37:179-187 (1998).

Lajiness, et al., "D2 Dopamine Receptor Stimulation of Mitogenesis in Transfected Chinese Hamster Ovary Cells: Relationship to Dopamine Stimulation of Tyrosine Phosphorylations," *The Journal of Pharmacology and Experimental Therapeutics* 267(3):1573-1581 (1993).

Larider, et al., "Initial sequencing and analysis of the human genome," *Nature* 409:860-921 (2001).

Murphy, et al., "From DNA to drugs: the orphan G-protein coupled receptors," *Current Opinion in Drug Discovery & Development* 1(2):192-199 (1998).

Pausch, M.H., et al., "G-protein-coupled receptors in *Saccharomyces cerevisiae*: high-throughput screening assays for drug discovery," *TIBTECH* 15:487-494 (1997).

Reinscheid, et al., "Orphanin FQ: A Neuropeptide that Activates an Opioidlike G Protein-coupled Receptor," *Science* 270:792-794 (1995).

Saito, et al., "Molecular characterization of the melanin-concentrating-hormone receptor," *Nature* 400:265-269 (1999).

Sakurai, et al., "Orexins and Orexin Receptors: A Family of Hypothalamic Neuropeptides and G Protein-coupled Receptors that Regulate Feeding Behavior," *Cell* 92:573-585 (1998).

Schroeder, et al, "FLIPR: A New Instrument for Accurate, High Throughput Optical Screening," *Journal of Biomolecular Screening* 1(2):75-80 (1996).

Sim, et al., "Identification of opioid receptor-like (ORL1) peptide-stimulated [35S]GTPγS binding in rat brain," *NeuroReport* 7(3):729-733 (1996).

Stables, et al., "A Bioluminescent Assay for Agonist Activity at Potentially Any G-Protein-Coupled Receptor," *Analytical Biochemistry* 252:115-126 (1997).

Stratowa, et al., "Use of a luciferase reporter system for characterizing G-protein-linked receptors," *Current Opinion in Biotechnology* 6:574-581 (1995).

Sutherland, et al., "Some Aspects of the Biological Role of Adenosine 3', 5'-monophosphate (Cyclic AMP)," *Circulation* 37:279-306 (1968).

Takeda, et al., "Identification of G protein-coupled receptor genes from the human genome sequence," *FEBS Letters* 520:97-101 (2002).

\* cited by examiner

Class A

| Family | Gene | Database ID | Species |
|---|---|---|---|
| Acetylcholine (muscarinic) | CHRM1 | #1 | H,M |
| | CHRM2 | 2 | H,M |
| | CHRM3 | 3 | H,M |
| | CHRM4 | 4 | H,M |
| | CHRM5 | 5 | H,M |
| Adenosine | ADORA1 | 6 | H,M |
| | ADORA2A | 7 | H,M |
| | ADORA2B | 8 | H,M |
| | ADORA3 | 9 | H,M |

Class A

| Family | Gene | Database ID | Species |
|---|---|---|---|
| Histamine | HRH1 | 87 | H,M |
| | HRH2 | 88 | H,M |
| | HRH3 | 89 | H,M |
| | HRH4 | 90 | H,M |
| Hormone protein | FSHR | 91 | H,M |
| | LHCGR | 92 | H,M |
| | TSHR | 93 | H,M |
| KISS-1 | GPR54 | 94 | H,M |
| Leukotriene | LTB4R | 95 | H,M |
| | LTB4R2 | 96 | H,M |

FIG. 1A esoGPCR Genes

Class A

| Family | Gene | Database ID | Species |
|---|---|---|---|
| Prostanoid | PTGDR | #172 | H,M |
| | PTGER1 | 173 | H,M |
| | PTGER2 | 174 | H,M |
| | PTGER3 | 175 | H,M |
| | PTGER4 | 176 | H,M |
| | PTGFR | 177 | H,M |
| | PTGIR | 178 | H,M |
| | TBXA2R | 179 | H,M |

*FIG. 1B*

Class A

| Family | Gene | Database ID | Species |
|---|---|---|---|
| Orphan group A6 | *GPRA5 | #258 | H,M |
|  | *GPR83 | 259 | H,M |
| Orphan group A7 | *GRCA | 260 | H,M |
|  | *PGR1 | 261 | H,M |
| Orphan group A8 | *HGPCR11 | 262 | H,M |
|  | *SALPR | 263 | H,M |
| Orphan group A9 | *MAS1 | 264 | H,M |
|  | *GPR90 | 265 | M |
| Orphan group A10 | *P2Y5 | 266 | H,M |
|  | *GPR23 | 267 | H,M |

Class B

| Family | Gene | Database ID | Species |
|---|---|---|---|
| Parathyroid hormone | PTHR1 | #340 | H,M |
|  | PTHR2 | 341 | H,M |
| Secretin | SCTR | 342 | H,M |
| PACAP | ADCYAP1R1 | 343 | H,M |
| Vasoactive intestinal peptide | VIPR1 | 344 | H,M |
|  | VIPR2 | 345 | H,M |
| Brain-specific angiogenesis inhibitor | BAI1 | 346 | H,M |
|  | BAI2 | 347 | H,M |
|  | BAI3 | 348 | H,M |
| DAF | CD97 | 349 | H,M |

*FIG. 1C*

| | | | |
|---|---|---|---|
| ADP/UDP-glucose | P2RY12 | 10 | H,M |
| | GPR105 | 11 | H,M |
| | GPR86 | 12 | H,M |
| | *GPR87 | 13 | H,M |
| Adrenoceptor | ADRA1A | 14 | H,M |
| | ADRA1B | 15 | H,M |
| | ADRA1D | 16 | H,M |
| | ADRA2A | 17 | H,M |
| | ADRA2B | 18 | H,M |
| | ADRA2C | 19 | H,M |
| | ADRB1 | 20 | H,M |
| | ADRB2 | 21 | H,M |
| | ADRB3 | 22 | H,M |
| Adrenomedullin | ADMR | 23 | H,M |
| Anaphylatoxin | C3AR1 | 24 | H,M |
| | C5R1 | 25 | H,M |
| | GPR77 | 26 | H,M |
| Angiotensin | AGTR1 | 27 | H,M |
| | AGTR2 | 28 | H,M |
| Apelin | AGTRL1 | 29 | H,M |
| Bombesin | BRS3 | 30 | H,M |
| | GRPR | 31 | H,M |
| | NMBR | 32 | H,M |

| MAS-related gene | | | |
|---|---|---|---|
| | MRGX1 | 97 | H |
| | MRGX2 | 98 | H |
| | MRGX3 | 99 | H |
| | MRGX4 | 100 | H |
| | *MRGD | 101 | H,M |
| | *MrgA1 | 102 | M |
| | *MrgA2 | 103 | M |
| | *MrgA3 | 104 | M |
| | *MrgA4 | 105 | M |
| | *MrgA5 | 106 | M |
| | *MrgA6 | 107 | M |
| | *MrgA7 | 108 | M |
| | *MrgA8 | 109 | M |
| | *MrgA9 | 110 | M |
| | *MrgA10 | 111 | M |
| | *MrgA11 | 112 | M |
| | *MrgA12 | 113 | M |
| | *MrgA13 | 114 | M |
| | *MrgA14 | 115 | M |
| | *MrgA15 | 116 | M |
| | *MrgA16 | 117 | M |
| | *MrgA19 | 118 | M |
| | *MrgB1 | 119 | M |

FIG. 1D

| Family | Gene | # | Species |
|---|---|---|---|
| Purinoceptor | P2RY1 | 180 | H,M |
| | P2RY2 | 181 | H,M |
| | P2RY4 | 182 | H,M |
| | P2RY6 | 183 | H,M |
| | P2RY11 | 184 | H |
| Relaxin/INSL3 | LGR7 | 185 | H,M |
| | LGR8 | 186 | H,M |
| Retinal | RGR | 187 | H,M |
| Serotonin | HTR1A | 188 | H,M |
| | HTR1B | 189 | H,M |
| | HTR1D | 190 | H,M |
| | HTR1E | 191 | H |
| | HTR1F | 192 | H,M |
| | HTR2A | 193 | H,M |
| | HTR2B | 194 | H,M |
| | HTR2C | 195 | H,M |
| | HTR4 | 196 | H,M |
| | HTR5A | 197 | H,M |
| | HTR5B | 198 | M |
| | HTR6 | 199 | H,M |
| | HTR7 | 200 | H,M |
| Somatostatin | SSTR1 | 201 | H,M |
| | SSTR2 | 202 | H,M |
| | SSTR3 | 203 | H,M |
| | SSTR4 | 204 | H,M |
| | SSTR5 | 205 | H,M |

FIG. 1E

| | | | | | | |
|---|---|---|---|---|---|---|
| Orphan group A11 | *P2Y10 | 268 | H,M | EGF-like, mucin- | *EMR1 | 350 | H,M |
| | *KSG79 | 269 | H,M | like receptor (EMR) | *EMR2 | 351 | H,M |
| Orphan group A12 | *PGR2 | 270 | H,M | | EMR3 | 352 | H,M |
| | !PGR3 | 271 | H,M | | *PGR16 | 353 | H,M |
| Other Orphan Genes | *AGR9 | 272 | H,M | Latrophilin | !LEC1 | 354 | H,M |
| | *CMKLR1 | 273 | H,M | | !LEC2 | 355 | H,M |
| | *EBI2 | 274 | H,M | | !LEC3 | 356 | H,M |
| | *GPCR150 | 275 | H,M | Proto-cadherin | *CELSR1 | 357 | H,M |
| | !GPR1 | 276 | H,M | | *CELSR2 | 358 | H,M |
| | *GPR15 | 277 | H,M | | *CELSR3 | 359 | H,M |
| | *GPR17 | 278 | H,M | Orphan group B1 | *GPR64 | 360 | H,M |
| | *GPR18 | 279 | H,M | | *PGR17 | 361 | H,M |
| | *GPR19 | 280 | H,M | | *DJ287G14 | 362 | H,M |
| | *GPR20 | 281 | H,M | Orphan group B2 | *KIAA0758 | 363 | H,M |
| | *GPR22 | 282 | H,M | | *PGR18 | 364 | H,M |
| | *GPR25 | 283 | H,M | | *PGR19 | 365 | H,M |
| | *GPR30 | 284 | H,M | | *PGR20 | 366 | H,M |
| | *GPR31 | 285 | H,M | Orphan group B3 | *TEM5 | 367 | H,M |
| | *GPR32 | 286 | H | | *KIAA1828 | 368 | H,M |
| | *GPR33 | 287 | M | | *PGR21 | 369 | H,M |
| | *GPR34 | 288 | H,M | | | | |
| | *GPR35 | 289 | H,M | | | | |
| | *GPR39 | 290 | H,M | | | | |

*FIG. 1F*

| Bradykinin | BDKRB1 | 33 | H,M |
|---|---|---|---|
| | BDKRB2 | 34 | H,M |
| Cannabinoid | CNR1 | 35 | H,M |
| | CNR2 | 36 | H,M |
| Chemokine | CCR1 | 37 | H,M |
| | CCR2 | 38 | H,M |
| | CCR3 | 39 | H,M |
| | CCR4 | 40 | H,M |
| | CCR5 | 41 | H,M |
| | CCR6 | 42 | H,M |
| | CCR7 | 43 | H,M |
| | CCR8 | 44 | H,M |
| | CCR9 | 45 | H,M |
| | GPR2 | 46 | H,M |
| | CCRL1 | 47 | H,M |
| | 'CCRL2 | 48 | H |
| | CCBP2 | 49 | H,M |
| | 'CMGBR1L1 | 50 | M |
| | 'CMGBR1L2 | 51 | M |
| | CCXCR1 | 52 | H,M |
| | CX3CR1 | 53 | H,M |
| | IL8RA | 54 | H,M |
| | IL8RB | 55 | H,M |
| | GPR9 | 56 | H,M |

| | 'MrgB2 | 120 | M |
|---|---|---|---|
| | 'MrgB3 | 121 | M |
| | 'MrgB4 | 122 | M |
| | 'MrgB5 | 123 | M |
| | 'MrgB6 | 124 | M |
| | 'MrgB8 | 125 | M |
| | 'MrgB10 | 126 | M |
| | 'MrgB11 | 127 | M |
| | 'MrgB13 | 128 | M |
| Melanin-concentrating hormone | GPR24 | 129 | H,M |
| | SLT | 130 | H |
| Melanocortin | MC1R | 131 | H,M |
| | MC2R | 132 | H,M |
| | MC3R | 133 | H,M |
| | MC4R | 134 | H,M |
| | MC5R | 135 | H,M |
| Melatonin | MTNR1A | 136 | H,M |
| | MTNR1B | 137 | H,M |
| | 'GPR50 | 138 | H,M |
| Motilin/Ghrelin | GHSR | 139 | H,M |
| | GPR38 | 140 | H,M |
| Neuromedin U | GPR66 | 141 | H,M |
| | NMU2R | 142 | H,M |
| Neuropeptide FF | NPFF1R | 143 | H,M |
| | GPR74 | 144 | H,M |

*FIG. 1G*

| | | | |
|---|---|---|---|
| SPC/LPC | G2A | 206 | H,M |
| | GPR4 | 207 | H,M |
| | GPR65 | 208 | H,M |
| | GPR68 | 209 | H,M |
| Sphingolipid | EDG1 | 210 | H,M |
| | EDG2 | 211 | H,M |
| | EDG3 | 212 | H,M |
| | EDG4 | 213 | H,M |
| | EDG5 | 214 | H,M |
| | EDG6 | 215 | H,M |
| | EDG7 | 216 | H,M |
| | EDG8 | 217 | H,M |
| Tachykinin | TACR1 | 218 | H,M |
| | TACR2 | 219 | H,M |
| | TACR3 | 220 | H,M |
| TRH | TRHR | 221 | H,M |
| | TRHR2 | 222 | M |
| Trace amine | *GPR57 | 223 | H,M |
| | *GPR58 | 224 | H,M |
| | *PNR | 225 | H,M |
| | TAR1 | 226 | H,M |
| | TAR2 | 227 | M |
| | *TAR3 | 228 | H,M |
| | *TAR4 | 229 | H,M |
| | *GPR102 | 230 | H |

FIG. 1H

| | | | |
|---|---|---|---|
| *GPR40 | 291 | H,M | |
| *GPR44 | 292 | H,M | |
| *GPR55 | 293 | H,M | |
| *GPR81 | 294 | H,M | |
| *GPR82 | 295 | H,M | |
| *GPR75 | 296 | H,M | |
| *GPR80 | 297 | H,M | |
| *GPR82 | 298 | H,M | |
| *GPR83 | 299 | H,M | |
| *GPR84 | 300 | H,M | |
| *GPR88 | 301 | H,M | |
| *GPR91 | 302 | H,M | |
| *GPR92 | 303 | H,M | |
| *GPR101 | 304 | H,M | |
| *GPR103 | 305 | H,M | |
| *H963 | 306 | H,M | |
| *HGPCR2 | 307 | H,M | |
| *HGPCR19 | 308 | H,M | |
| *HUMNPIIY20 | 309 | H,M | |
| *MRG | 310 | H | |
| *MRGE | 311 | H,M | |
| *MRGF | 312 | H,M | |
| *MRGG | 313 | H,M | |
| *OPN3 | 314 | H,M | |

| Other Orphan Genes | | |
|---|---|---|
| *ETL | 370 | H,M |
| *FLJ14454 | 371 | H,M |
| *GPR56 | 372 | H,M |
| *OA1 | 373 | H,M |
| *PGR22 | 374 | H,M |
| *PGR23 | 375 | H,M |
| *PGR24 | 376 | H,M |
| *PGR25 | 377 | H,M |
| *PGR26 | 378 | H,M |
| *PGR27 | 379 | H,M |
| *VLGR1 | 380 | H,M |

| Class C | | | |
|---|---|---|---|
| Calcium-sensing | CASR | 381 | H,M |
| GABA-B | GABBR1 | 382 | H,M |
| | GPR51 | 383 | H,M |
| GPRC5 | *GPRC5B | 384 | H,M |
| | *GPRC5C | 385 | H,M |
| | *GPRC5D | 386 | H,M |
| | *RAI3 | 387 | H,M |
| Metabotropic glutamate | GRM1 | 388 | H,M |
| | GRM2 | 389 | H,M |
| | GRM3 | 390 | H,M |

FIG. 11

| | | | |
|---|---|---|---|
| | CXCR4 | 57 | H,M |
| | BLR1 | 58 | H,M |
| | CXCR6 | 59 | H,M |
| Cholecystokinin | CCKAR | 60 | H,M |
| | CCKBR | 61 | H,M |
| Cysteinyl leukotriene | CYSLT1 | 62 | H,M |
| | CYSLT2 | 63 | H,M |
| Dopamine | DRD1 | 64 | H,M |
| | DRD2 | 65 | H,M |
| | DRD3 | 66 | H,M |
| | DRD4 | 67 | H,M |
| | DRD5 | 68 | H,M |
| Duffy | FY | 69 | H,M |
| Eicosanoid | TG1019 | 70 | H |
| | HM74 | 71 | H,M |
| | GPR81 | 72 | H,M |
| Endothelin | EDNRA | 73 | H,M |
| | EDNRB | 74 | H,M |
| FMLP-related peptide | FPR1 | 75 | H,M |
| | FPRL1 | 76 | H |
| | FPRL2 | 77 | H |
| | FPR-RS1 | 78 | M |
| | FPR-RS2 | 79 | M |
| | FPR-RS3 | 80 | M |
| | FPR-RS4 | 81 | M |

| | | | |
|---|---|---|---|
| Neuropeptide W | GPR7 | 145 | H,M |
| | GPR8 | 146 | H |
| Neuropeptide Y | NPY1R | 147 | H,M |
| | NPY2R | 148 | H,M |
| | PPYR1 | 149 | H,M |
| | NPY5R | 150 | H,M |
| | NPY6R | 151 | H,M |
| Neurotensin | NTSR1 | 152 | H,M |
| | NTSR2 | 153 | H,M |
| Opioid/nociceptin | OPRD1 | 154 | H,M |
| | OPRK1 | 155 | H,M |
| | OPRM1 | 156 | H,M |
| | OPRL1 | 157 | H,M |
| Opsin | OPN1LW | 158 | H |
| | OPN1MW | 159 | H,M |
| | OPN1SW | 160 | H,M |
| | RHO | 161 | H,M |
| Orexin/Hypocretin | HCRTR1 | 162 | H,M |
| | HCRTR2 | 163 | H,M |
| PAF | PTAFR | 164 | H,M |
| Prokineticin 2 | GPR73 | 165 | H,M |
| | GPR73L1 | 166 | H,M |
| Prolactin RF | GPR10 | 167 | H,M |

FIG. 1J

| | | | |
|---|---|---|---|
| | TA7 | 231 | M |
| | TA8 | 232 | M |
| | TA10 | 233 | M |
| | TA12 | 234 | M |
| | TA14 | 235 | M |
| Urotensin II | GPR14 | 236 | H,M |
| Vasopressin/Oxytocin | AVPR1A | 237 | H,M |
| | AVPR1B | 238 | H,M |
| | AVPR2 | 239 | H,M |
| | OXTR | 240 | H,M |
| LGR | *GPR48 | 241 | H,M |
| | *GPR49 | 242 | H,M |
| | *LGR6 | 243 | H,M |
| SREB | *GPR27 | 244 | H,M |
| | *GPR85 | 245 | H,M |
| | *SREB3 | 246 | H,M |
| Orphan group A1 | *GPR3 | 247 | H,M |
| | *GPR6 | 248 | H,M |
| | *GPR12 | 249 | H,M |
| Orphan group A2 | *GPR21 | 250 | H,M |
| | *GPR52 | 251 | H,M |
| Orphan group A3 | *GPR26 | 252 | H,M |
| | *GPR78 | 253 | H |
| Orphan group A4 | *GPR37 | 254 | H,M |
| | *GPR37L1 | 255 | H,M |

*FIG. 1K*

| | | | |
|---|---|---|---|
| *OPN4 | 315 | H,M | |
| *PGR4 | 316 | H,M | |
| *PGR5 | 317 | H,M | |
| *PGR6 | 318 | H | |
| *PGR7 | 319 | H,M | |
| *PGR8 | 320 | H,M | |
| *PGR9 | 321 | H,M | |
| *PGR10 | 322 | H,M | |
| *PGR11 | 323 | H,M | |
| *PGR12 | 324 | H,M | |
| *PGR13 | 325 | H,M | |
| *PGR14 | 326 | H,M | |
| *PGR15 | 327 | H,M | |
| *RDC1 | 328 | H,M | |
| *RE2 | 329 | H,M | |
| *RRH | 330 | H,M | |

| | | |
|---|---|---|
| GRM4 | 391 | H,M |
| GRM5 | 392 | H,M |
| GRM6 | 393 | H,M |
| GRM7 | 394 | H,M |
| GRM8 | 395 | H,M |
| Other Orphan Genes | | |
| *GPRC6A | 396 | H,M |
| *PGR28 | 397 | H,M |

Class F/S

| | | | |
|---|---|---|---|
| Frizzled | | | |
| FZD1 | 398 | H,M | |
| FZD2 | 399 | H,M | |
| FZD3 | 400 | H,M | |
| FZD4 | 401 | H,M | |
| FZD5 | 402 | H,M | |
| FZD6 | 403 | H,M | |
| FZD7 | 404 | H,M | |
| FZD8 | 405 | H,M | |
| FZD9 | 406 | H,M | |
| FZD10 | 407 | H | |
| Smoothened | | | |
| SMOH | 408 | H,M | |

*FIG. 1L*

| Proteinase-activated | F2R | 168 | H,M |
|---|---|---|---|
| | F2RL1 | 169 | H,M |
| | F2RL2 | 170 | H,M |
| | F2RL3 | 171 | H,M |

| Galanin | GALR1 | 82 | H,M |
|---|---|---|---|
| | GALR2 | 83 | H,M |
| | GALR3 | 84 | H,M |
| GNRH | GNRHR | 85 | H,M |
| | GNRHR2 | 86 | H |

FIG. 1M

| Class B | | | |
|---|---|---|---|
| Calcitonin | CALCR | 331 | H,M |
| | CALCRL | 332 | H,M |
| Corticotropin- | CRHR1 | 333 | H,M |
| releasing hormone | CRHR2 | 334 | H,M |
| GIP | GIPR | 335 | H,M |
| Glucagon | GCGR | 336 | H,M |
| | GLP1R | 337 | H,M |
| | GLP2R | 338 | H,M |
| GHRH | GHRHR | 339 | H,M |

| No class | | | |
|---|---|---|---|
| Orphan group N1 | TM7SF1 | 409 | H,M |
| | TM7SF1L1 | 410 | H,M |
| | TM7SF1L2 | 411 | H,M |
| Other Orphan Genes | TM7SF3 | 412 | H,M |
| | TPRA40 | 413 | H,M |

FIG. 10

| FIG. 1A | FIG. 1B | FIG. 1C |
| --- | --- | --- |
| FIG. 1D | FIG. 1E | FIG. 1F |
| FIG. 1G | FIG. 1H | FIG. 1I |
| FIG. 1J | FIG. 1K | FIG. 1L |
| FIG. 1M | FIG. 1N | FIG. 1O |

*FIG. 1P*

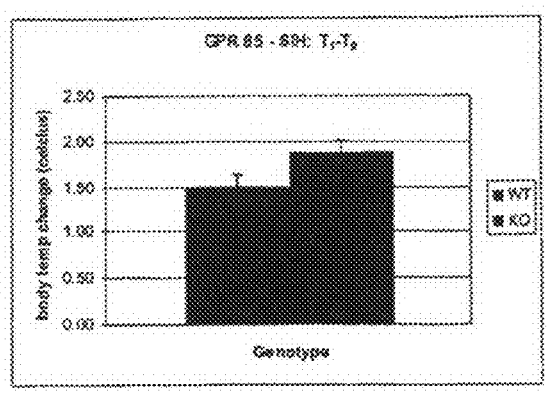
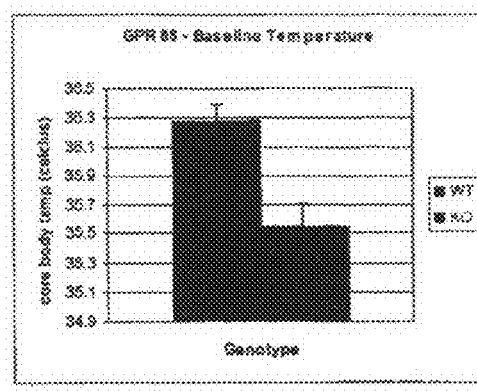
*Fig. 7A*  *Fig. 7B*

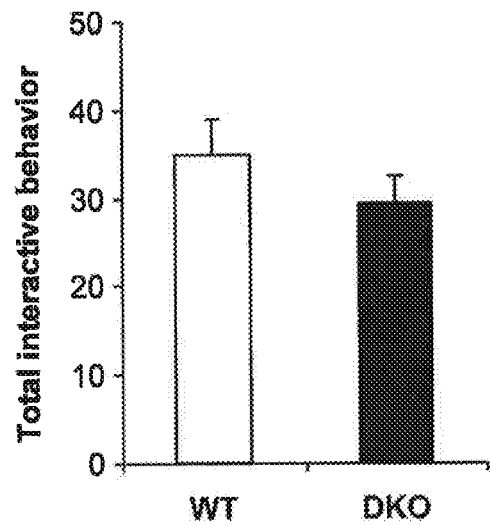
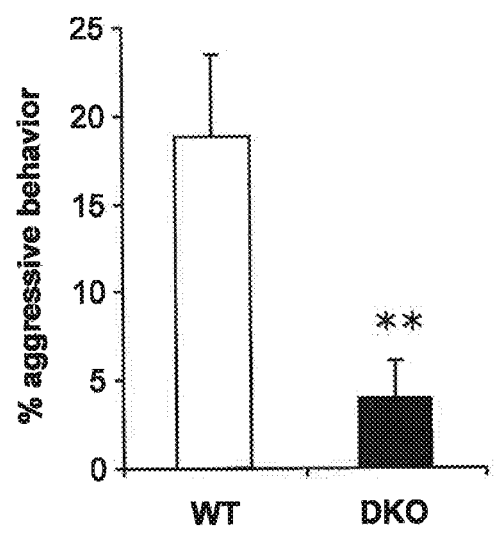
Fig. 14A
Fig. 14B

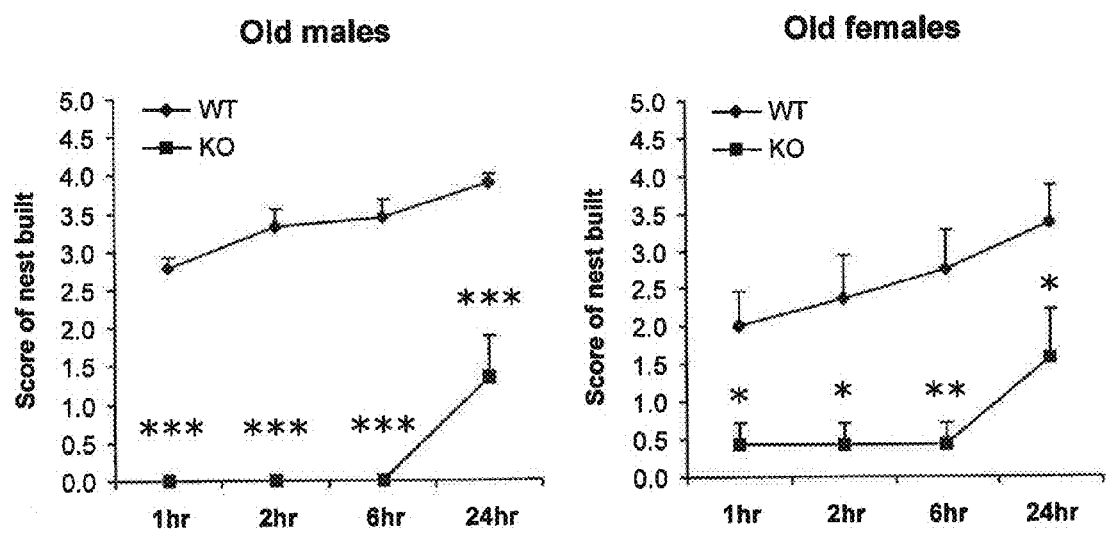
*Fig. 15A*  *Fig. 15B*

Fig. 17A
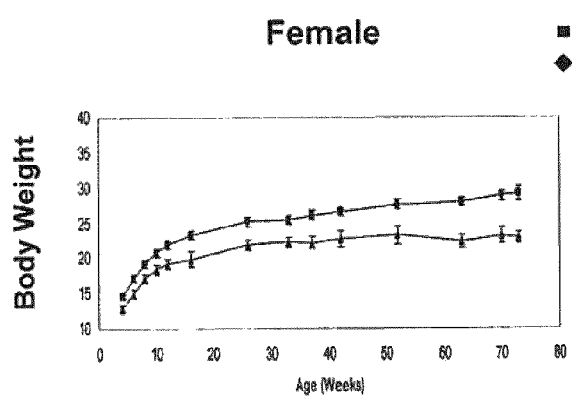
Fig. 17C
Fig. 17B
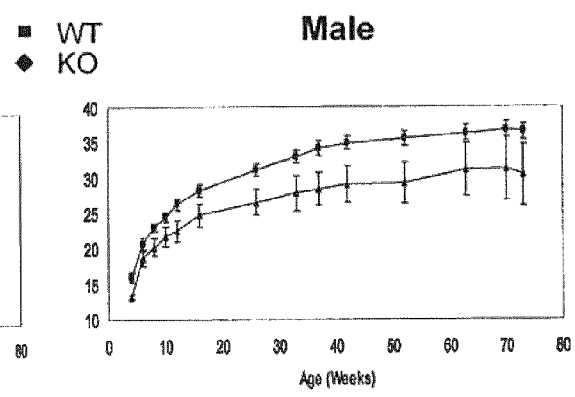
Fig. 17D
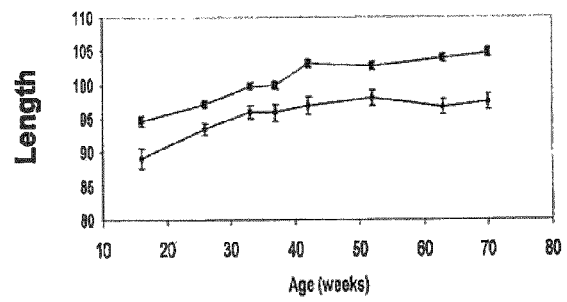
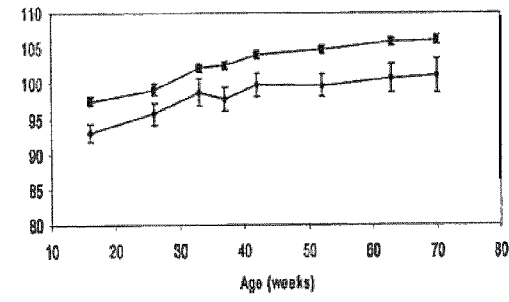

Fig. 22A
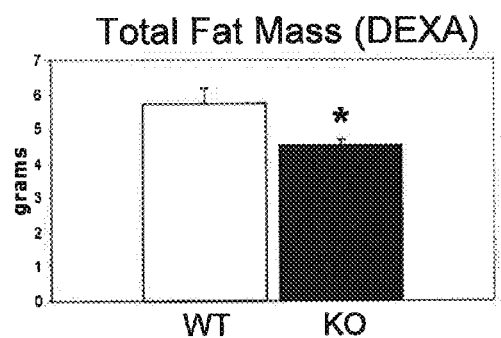
Fig. 22C
Fig. 22B
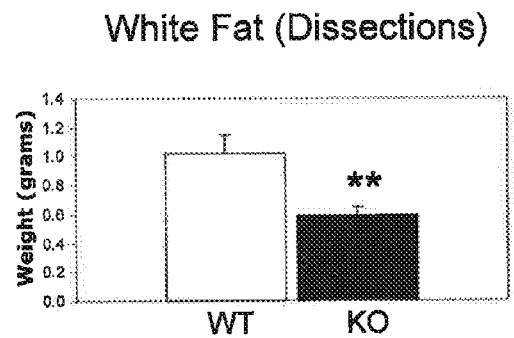
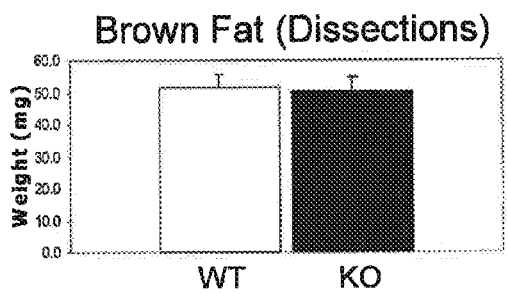
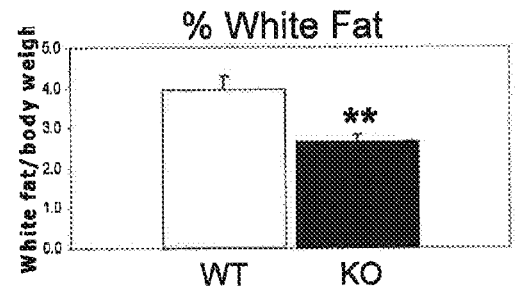
Fig. 22D

Fig. 24A
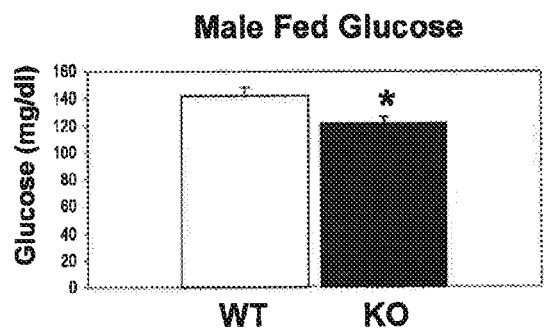
Fig. 24B
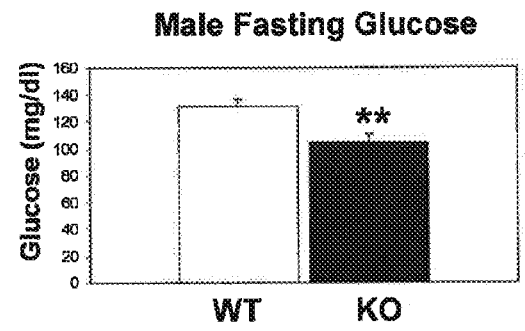
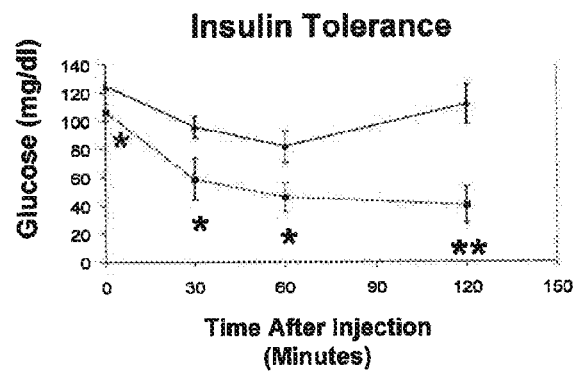
Fig. 24C
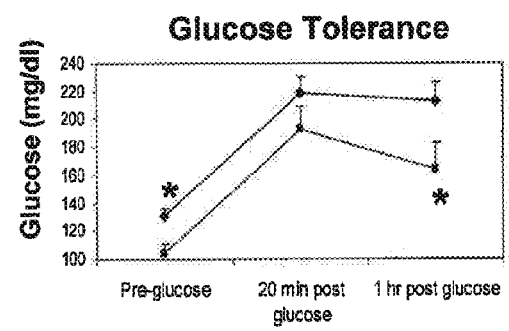
Fig. 24D

Fig. 28A
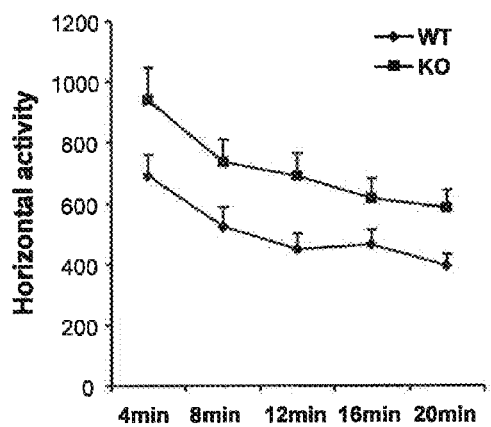
Fig. 28B
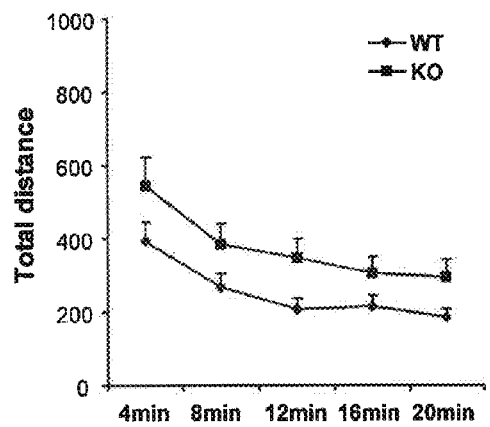
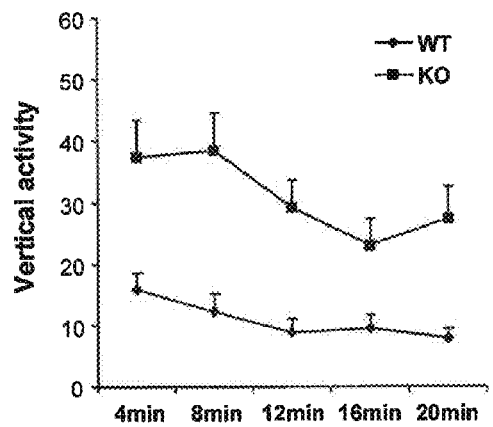
Fig. 28C
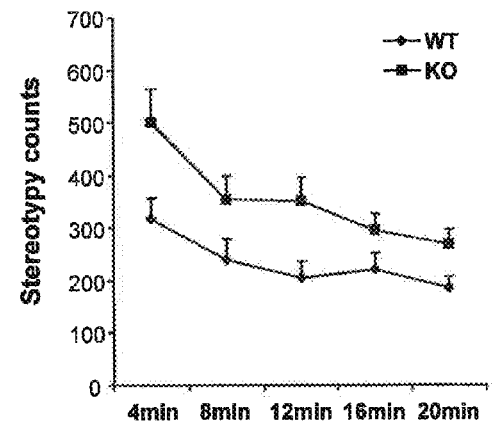
Fig. 28D

*Fig. 30A*
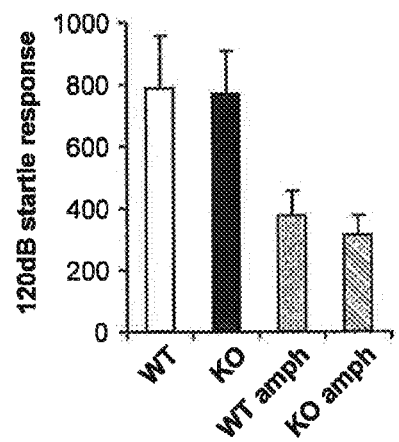
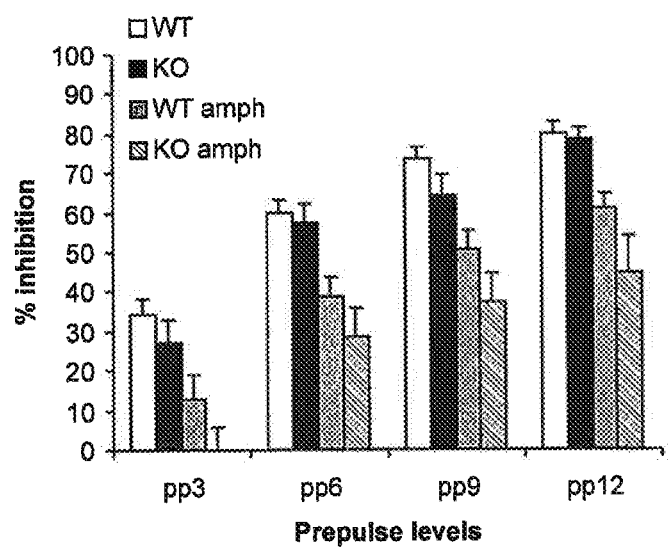
*Fig. 30B*

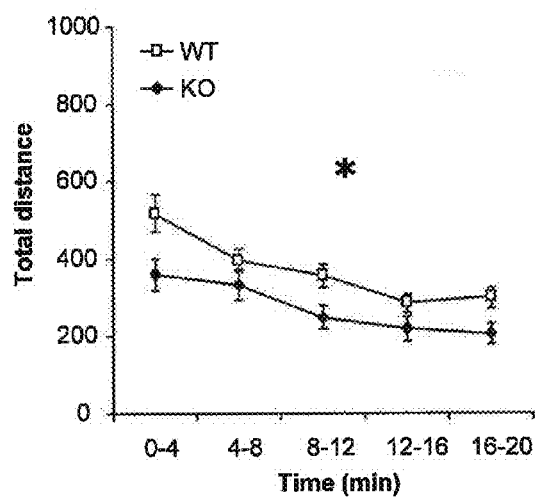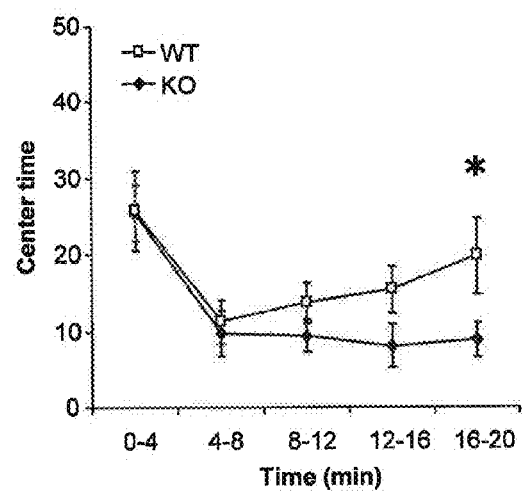
*Fig. 31A*  *Fig. 31B*

METHOD OF IDENTIFYING A COMPOUND FOR THE TREATMENT OR PREVENTION OF OBESITY

CROSS-REFERENCES TO RELATED APPLICATIONS

This application is a continuation of U.S. patent application Ser. No. 11/940,917, filed Nov. 15, 2007, which is a continuation-in-part of U.S. patent application Ser. No. 10/527,265, filed Jan. 26, 2006, now abandoned, which is a U.S. national stage application of PCT Patent Application No. PCT/US03/28226, filed Sep. 9, 2003, which claims the benefit under 35 U.S.C. §119(e) of U.S. Provisional Patent Application No. 60/409,303, filed Sep. 9, 2002, and U.S. Provisional Patent Application No. 60/461,329, filed Apr. 9, 2003. This application claims the benefit under 35 U.S.C. §119(e) of U.S. Provisional Patent Application No. 60/859,469, filed Nov. 15, 2006, U.S. Provisional Patent Application No. 60/859,473, filed Nov. 15, 2006, and U.S. Provisional Patent Application No. 60/859,470, filed Nov. 15, 2006, where all of the above applications are incorporated herein by reference in their entireties.

STATEMENT REGARDING SEQUENCE LISTING

The Sequence Listing associated with this application is provided in a paper copy, and is hereby incorporated by reference into the specification. The paper copy of the sequence listing in this application is identical to the computer readable copy of the sequence listing filed in application Ser. No. 11/940,917, filed Nov. 15, 2007. In accordance with 37 CFR 1.821(e), please use the last-filed computer readable form filed in that application as the computer readable form for the instant application. It is understood that the Patent and Trademark Office will make the necessary change in application number and filing date for the instant application. A paper copy of the sequence listing is included in the originally-filed specification of the instant application.

BACKGROUND OF THE INVENTION

The invention relates to the fields of medicine and drug discovery.

Mammalian G protein coupled receptors (GPCRs) constitute a superfamily of diverse proteins with thousands of members. GPCRs act as receptors for a multitude of different signals. Chemosensory GPCRs (csGPCR) are receptors for sensory signals of external origin that are sensed as odors, pheromones, or tastes. Most other GPCRs respond to endogenous signals, such as peptides, lipids, neurotransmitters, or nucleotides. GPCRs falling in the latter group are involved in numerous physiological processes, including the regulation of neuronal excitability, metabolism, reproduction, development, hormonal homeostasis, and behavior, and are differentially expressed in many cell types in the body.

Of all currently marketed drugs, greater than 30% are modulators of specific GPCRs. Only 10% of GPCRs (excluding csGPCRs) are targeted by these drugs, emphasizing the potential of the remaining 90% of the gene family for the treatment of human disease.

Despite the importance of GPCRs in physiology and disease, the size of the GPCR superfamily is still uncertain. Analyses of genome sequences have generated markedly varied estimates (Venter, J. C. et al., Science 291, 1304-51 (2001); Lander, E. S. et al., Nature 409, 860-921 (2001); Takeda, S. et al., FEBS Lett 520, 97-101 (2002)). In addition, while most GPCRs are known to be selectively expressed in subsets of cells, the expression patterns of most GPCRs are incomplete or unknown. Thus, there is a need for GPCR polypeptides, polynucleotides, antibodies, genetic models, and modulating compounds for use in the treatment and diagnosis of a wide variety of disorders and diseases.

SUMMARY OF THE INVENTION

The present invention provides GPCR polypeptides and polynucleotides, recombinant materials, and transgenic mice, as well as methods for their production. The polypeptides and polynucleotides are useful, for example, in methods of diagnosis and treatment of diseases and disorders. The invention also provides methods for identifying compounds (e.g., agonists or antagonists) using the GPCR polypeptides and polynucleotides of the invention, and for treating conditions associated with GPCR dysfunction with the GPCR polypeptides, polynucleotides, or identified compounds. The invention also provides diagnostic assays for detecting diseases or disorders associated with inappropriate GPCR activity or levels.

In one aspect, the invention features a variety of substantially pure GPCR polypeptides. Such polypeptides include: (a) polypeptides including a polypeptide sequence having at least 90%, 95%, 97%, 98%, or 99% identity to a polypeptide listed in Table 2; (b) polypeptides that include a polypeptide listed in Table 2; (c) polypeptides having at least 90%, 95%, 97%, 98%, or 99% sequence identity to a polypeptide listed in Table 2; and (d) polypeptides listed in Table 2.

Polypeptides of the present invention also include variants of the aforementioned polypeptides, including all allelic forms and splice variants. Such polypeptides vary from the reference polypeptide by insertions, deletions, and substitutions that may be conservative or non-conservative, or any combination thereof. Particularly desirable variants are those in which several, for instance from 50 to 30, from 30 to 20, from 20 to 10, from 10 to 5, from 5 to 3, from 3 to 2, or from 2 to 1 amino acids are inserted, substituted, or deleted, in any combination.

Polypeptides of the present invention also include polypeptides that include an amino acid sequence having at least 30, 50, or 100 contiguous amino acids from any of the polypeptides listed in Table 2. Polypeptides of the invention are desirably biologically active or are antigenic or immunogenic in an animal, especially in a human.

The polypeptides of the present invention may be in the form of the "mature" polypeptide, or may be a part of a larger polypeptide such as a precursor or a fusion protein. It is often advantageous to include an additional amino acid sequence that contains secretory or leader sequences, pro-sequences, sequences that aid in purification, for instance multiple histidine residues, or an additional sequence for stability during recombinant production.

Polypeptides of the present invention can be prepared in any suitable manner, for instance by isolation from naturally occurring sources, from genetically engineered host cells comprising expression systems, or by chemical synthesis, using for instance automated peptide synthesizers, or a combination of such methods. For example, polypeptides of the invention may be produced by expressing in a cell (e.g., a yeast, bacterial, mammalian, or insect cell) a vector containing a polynucleotide that encodes a GPCR of the invention under condition in which the polypeptide (e.g., one listed in Table 2) is expressed. Means for preparing such polypeptides are well understood in the art.

In another aspect, the invention features substantially pure GPCR polynucleotides. Such polynucleotides include: (a) polynucleotides that include a polynucleotide sequence having at least 90%, 95%, 97%, 98%, or 99% sequence identity to a polynucleotide listed in Table 2; (b) polynucleotides that include a polynucleotide sequence having at least 90%, 95%, 97%, 98%, or 99% sequence identity to the reverse complement of polynucleotide listed in Table 2; (c) polynucleotides that include a polynucleotide listed in Table 2; (d) polynucleotides that are the reverse complement of polynucleotide listed in Table 2; (e) polynucleotides having at least 90%, 95%, 97%, 98%, or 99% sequence identity to a polynucleotide listed in Table 2; (f) polynucleotides having at least 90%, 95%, 97%, 98%, or 99% sequence identity to the reverse complement of polynucleotide listed in Table 2; (g) polynucleotides listed in Table 2; (h) reverse complement of polynucleotides listed in Table 2; (i) polynucleotides that include a polynucleotide sequence encoding a polypeptide sequence having at least 90%, 95%, 97%, 98%, or 99% identity to a polypeptide listed in Table 2; (j) polynucleotides including a nucleotide sequence encoding a polypeptide listed in Table 2; and (k) polynucleotides encoding a polypeptide listed in Table 2. Preferred GPCR polynucleotides of the present invention have at least 15, 30, 50 or 100 contiguous nucleotides from any of the polynucleotides listed in Table 2.

In one embodiment, the polynucleotide is operably linked to a promoter for expression of the polypeptide encoded by the polynucleotide. In certain embodiments, the promoter is a constitutive promoter, is inducible by one or more external agents, or is cell-type specific.

In another aspect, the invention features a vector that includes a GPCR polynucleotide of the invention, the vector being capable of directing expression of the polypeptide encoded by the polynucleotide in a vector-containing cell.

In another aspect, the invention features a method of preventing or treating a neurological disease or disorder, including introducing into a human an expression vector that includes a nucleic acid molecule encoding a GPCR polypeptide substantially identical to a polypeptide listed in any one of Tables 3-14 and 33, operably linked to a promoter.

In still another aspect, the invention features a method of treating or preventing a neurological disease or disorder, including administering to an animal (e.g., a human) a compound that modulates the biological activity of a GPCR polypeptide substantially identical to a polypeptide listed in any one of Tables 3-14 and 33.

In yet another aspect, the invention features a method for determining whether a candidate compound is a compound that may be useful for the treatment of a neurological disease or disorder. This method includes the steps of (a) providing a GPCR polypeptide substantially identical to a polypeptide listed in any one of Tables 3-14 and 33; (b) contacting the GPCR polypeptide with the candidate compound; and (c) measuring biological activity of the GPCR polypeptide, wherein altered biological activity, relative to that of the GPCR polypeptide not contacted with the compound, indicates that the candidate compound may be useful for the treatment of a neurological disease or disorder. The GPCR polypeptide can be in a cell or may be in a cell-free assay system.

In yet another aspect, the invention features another method for determining whether a candidate compound is a compound that may be useful for the treatment of a neurological disease or disorder. This method includes the steps of (a) providing a transgenic non-human mammal (e.g., a knock-out mouse) having a disruption in a nucleic acid molecule encoding a GPCR polypeptide substantially identical to a polypeptide listed in any one of Tables 3-14 and 33; (b) contacting the transgenic non-human mammal with the candidate compound; and (c) measuring biological activity of the GPCR polypeptide in the transgenic non-human mammal, wherein altered biological activity, relative to that of the transgenic non-human mammal not contacted with the compound, indicates that the candidate compound may be useful for the treatment of a neurological disease or disorder.

In yet another aspect, the invention features a method for determining whether a candidate compound is a compound that may be useful for the treatment of a neurological disease or disorder. This method includes the steps of (a) providing a transgenic non-human mammal (e.g., a mouse) overexpressing a nucleic acid molecule encoding a GPCR polypeptide substantially identical to a polypeptide listed in any one of Tables 3-14 and 33; (b) contacting the transgenic non-human mammal with the candidate compound; and (c) measuring biological activity of the GPCR polypeptide in the transgenic non-human mammal, wherein altered biological activity, relative to that of the GPCR polypeptide in the transgenic non-human mammal not contacted with the compound, indicates that the candidate compound may be useful for the treatment of a neurological disease or disorder.

In still another aspect, the invention features another method for determining whether a candidate compound may be useful for the treatment of a neurological disease or disorder. This method includes (a) providing a nucleic acid molecule comprising a promoter from a gene encoding a GPCR polypeptide listed in any one of Tables 3-14 and 33, the promoter operably linked to a reporter system; (b) contacting the nucleic acid molecule with the candidate compound; and (c) measuring reporter activity, wherein altered reporter activity, relative to a nucleic acid molecule not contacted with the compound, indicates that the candidate compound may be useful for the treatment of a neurological disease or disorder.

In another aspect, the invention features yet another method for determining whether a candidate compound may be useful for the treatment of a neurological disease or disorder. This method includes the steps of: (a) providing a GPCR polypeptide substantially identical to a polypeptide listed in any one of Tables 3-14 and 33; (b) contacting the polypeptide with the candidate compound; and (c) measuring interaction between the candidate compound and the polypeptide. Interaction between the compound and the polypeptide indicates that the candidate compound may be useful for the treatment of a neurological disease or disorder.

In still another aspect, the invention features another method for determining whether a candidate compound may be useful for the treatment of a neurological disease or disorder. This method includes (a) providing a GPCR polypeptide substantially identical to a polypeptide listed in any one of Tables 3-14 and 33; (b) contacting the polypeptide with the candidate compound; and (c) measuring the half-life of the polypeptide, wherein a change in the half-life of the polypeptide, relative to that of the polypeptide not contacted with the compound, indicates that the candidate compound may be useful for the treatment of a neurological disease or disorder. Preferably, the GPCR polypeptide is in a cell or a cell free assay system.

In another aspect, the invention features a method for determining whether a patient has an increased risk for developing a neurological disease or disorder. The method includes the step of determining whether the patient has a mutation in a gene encoding a polypeptide listed in one of Tables 3-14 and 33, wherein presence of the mutation indicates that the patient has an increased risk for developing a neurological disease or disorder.

In a related aspect, the invention features another method for determining whether a patient has an increased risk for developing a neurological disease or disorder. This method includes the step of determining whether the patient has a polymorphism in a gene encoding a polypeptide listed in any one of Tables 3-14 and 33, wherein presence of the polymorphism indicates that the patient has an increased risk for developing a neurological disease or disorder.

In either of these two methods, the mutation or polymorphism is preferably associated with an alteration (for example, a decrease) in the expression level or biological activity of the polypeptide.

In another aspect, the invention features another method for determining whether a patient has an increased risk for developing a neurological disease or disorder. The method includes measuring biological activity of a GPCR polypeptide from the patient that is substantially identical to a polypeptide listed in any one of Tables 3-14 and 33, wherein increased or decreased levels in the GPCR biological activity, relative to normal levels, indicates that the patient has an increased risk for developing a neurological disease or disorder.

In still another aspect, the invention features yet another method for determining whether a patient has an increased risk for developing a neurological disease or disorder. The method includes the step of measuring the patient's expression level of a polypeptide listed in any one of Tables 3-14 and 33, wherein an alteration in the expression, relative to normal, indicates that the patient has an increased risk for developing a neurological disease or disorder. Preferably, the expression levels are determined by measuring levels of polypeptide or mRNA.

In still another aspect, the invention features another method for determining whether a candidate compound may be useful for the treatment of a disease or disorder of the adrenal gland. This method includes (a) providing a nucleic acid molecule comprising a promoter from a gene encoding a GPCR polypeptide listed in Tables 15 and 33, the promoter operably linked to a reporter system; (b) contacting the nucleic acid molecule with the candidate compound; and (c) measuring reporter activity, wherein altered reporter activity, relative to a nucleic acid molecule not contacted with the compound, indicates that the candidate compound may be useful for the treatment of a disease or disorder of the adrenal gland.

In another aspect, the invention features yet another method for determining whether a candidate compound may be useful for the treatment of a disease or disorder of the adrenal gland. This method includes the steps of: (a) providing a GPCR polypeptide substantially identical to a polypeptide listed in Tables 15 and 33; (b) contacting the polypeptide with the candidate compound; and (c) measuring interaction of the candidate compound to the polypeptide. Interaction of the compound to the polypeptide indicates that the candidate compound may be useful for the treatment of a disease or disorder of the adrenal gland.

In still another aspect, the invention features another method for determining whether a candidate compound may be useful for the treatment of a disease or disorder of the adrenal gland. This method includes (a) providing a GPCR polypeptide substantially identical to a polypeptide listed in Tables 15 and 33; (b) contacting the polypeptide with the candidate compound; and (c) measuring the half-life of the polypeptide, wherein an alteration in the half-life of the polypeptide, relative to that of the polypeptide not contacted with the compound, indicates that the candidate compound may be useful for the treatment of a disease or disorder of the adrenal gland. Preferably the GPCR polypeptide is in a cell or a cell free assay system.

In another aspect, the invention features a method for determining whether a patient has an increased risk for developing a disease or disorder of the adrenal gland. The method includes the step of determining whether the patient has a mutation in a gene encoding a polypeptide listed in Tables 15 and 33, wherein presence of the mutation indicates that the patient has an increased risk for developing a disease or disorder of the adrenal gland.

In a related aspect, the invention features another method for determining whether a patient has an increased risk for developing a disease or disorder of the adrenal gland. This method includes the step of determining whether the patient has a polymorphism in a gene encoding a polypeptide listed in Tables 15 and 33, wherein presence of the polymorphism indicates that the patient may have an increased risk for developing a disease or disorder of the adrenal gland.

In either of these two methods, the mutation or polymorphism is preferably associated with an alteration (for example, a decrease) in the biological activity of the polypeptide.

In another aspect, the invention features another method for determining whether a patient has an increased risk for developing a disease or disorder of the adrenal gland. The method includes measuring biological activity of a GPCR polypeptide from the patient that is substantially identical to a polypeptide listed in Tables 15 and 33, wherein increased or decreased levels in the GPCR biological activity, relative to normal levels, indicates that the patient has an increased risk for developing a disease or disorder of the adrenal gland.

In still another aspect, the invention features yet another method for determining whether a patient has an increased risk for developing a disease or disorder of the adrenal gland. The method includes the step of measuring the patient's expression levels of a polypeptide listed in Tables 15 and 33, wherein altered levels in the expression, relative to normal, indicate that the patient has an increased risk for developing a disease or disorder of the adrenal gland. Preferably, the expression levels are determined by measuring levels of polypeptide or mRNA.

In another aspect, the invention features a non-human mammal (e.g., a mouse), having a transgene that includes a nucleic acid molecule encoding a GPCR polypeptide substantially identical to a polypeptide listed in Table 15.

In yet another aspect, the invention features a non-human mammal (e.g., a mouse), having a mutation in a nucleic acid molecule encoding a GPCR polypeptide substantially identical to a polypeptide listed in Table 15.

In a related aspect, the invention features a cell from a non-human mammal having a transgene that includes a nucleic acid molecule encoding a GPCR polypeptide substantially identical to a polypeptide listed in Table 15.

In another aspect, the invention features a cell from a non-human mammal having a mutation in a nucleic acid molecule encoding a GPCR polypeptide substantially identical to a polypeptide listed in Table 15.

In another aspect, the invention features a method of preventing or treating a disease of the colon including introducing into a human an expression vector that includes a nucleic acid molecule encoding a GPCR polypeptide substantially identical to a polypeptide listed in Tables 16 and 33, operably linked to a promoter.

In still another aspect, the invention features a method of treating or preventing a disease of the colon including administering to an animal (e.g., a human) a compound that modulates the biological activity of a GPCR polypeptide substantially identical to a polypeptide listed in Tables 16 and 33.

In yet another aspect, the invention features a method for determining whether a candidate compound is a compound that may be useful for the treatment of a disease or disorder of the colon. This method includes the steps of (a) providing a GPCR polypeptide substantially identical to a polypeptide listed in Tables 16 and 33; (b) contacting the GPCR polypeptide with the candidate compound; and (c) measuring biological activity of the GPCR polypeptide, wherein altered biological activity, relative to that of the GPCR polypeptide not contacted with the compound, indicates that the candidate compound may be useful for the treatment of a disease or disorder of the colon. The GPCR polypeptide can be in a cell or in a cell-free assay system.

In yet another aspect, the invention features a method for determining whether a candidate compound is a compound that may be useful for the treatment of a disease or disorder of the colon. This method includes the steps of (a) providing a transgenic non-human mammal (e.g., a knock-out mouse) having a disruption in a nucleic acid molecule encoding a GPCR polypeptide substantially identical to a polypeptide listed in Tables 16 and 33; (b) contacting the transgenic non-human mammal with the candidate compound;

and (c) measuring biological activity of the GPCR polypeptide in the transgenic non-human mammal, wherein altered biological activity, relative to that of the transgenic non-human mammal not contacted with the compound, indicates that the candidate compound may be useful for the treatment of a disease or disorder of the colon.

In yet another aspect, the invention features a method for determining whether a candidate compound is a compound that may be useful for the treatment of a disease or disorder of the colon. This method includes the steps of (a) providing a transgenic non-human mammal (e.g., a mouse) overexpressing a nucleic acid molecule encoding a GPCR polypeptide substantially identical to a polypeptide listed in Tables 16 and 33; (b) contacting the GPCR polypeptide with the candidate compound; and (c) measuring biological activity of the GPCR polypeptide in the transgenic non-human mammal, wherein altered biological activity, relative to that of the transgenic non-human mammal not contacted with the compound, indicates that the candidate compound may be useful for the treatment of a disease or disorder of the colon.

In still another aspect, the invention features another method for determining whether a candidate compound may be useful for the treatment of a disease or disorder of the colon. This method includes (a) providing a nucleic acid molecule comprising a promoter from a gene encoding a GPCR polypeptide listed in Tables 16 and 33, the promoter operably linked to a reporter system; (b) contacting the nucleic acid molecule with the candidate compound; and (c) measuring reporter activity, wherein altered reporter activity, relative to a nucleic acid molecule not contacted with the compound, indicates that the candidate compound may be useful for the treatment of a disease or disorder of the colon.

In another aspect, the invention features yet another method for determining whether a candidate compound may be useful for the treatment of a disease or disorder of the colon. This method includes the steps of: (a) providing a GPCR polypeptide substantially identical to a polypeptide listed in Tables 16 and 33; (b) contacting the polypeptide with the candidate compound; and (c) measuring interaction of the candidate compound to the polypeptide. Interaction of the compound to the polypeptide indicates that the candidate compound may be useful for the treatment of a disease or disorder of the colon.

In still another aspect, the invention features another method for determining whether a candidate compound may be useful for the treatment of a disease or disorder of the colon. This method includes (a) providing a GPCR polypeptide substantially identical to a polypeptide listed in Tables 16 and 33; (b) contacting the polypeptide with the candidate compound; and (c) measuring the half-life of the polypeptide, wherein an alteration in the half-life of the polypeptide, relative to that of the polypeptide not contacted with the compound, indicates that the candidate compound may be useful for the treatment of a disease or disorder of the colon. Preferably the GPCR polypeptide is in a cell or a cell free assay system.

In another aspect, the invention features a method for determining whether a patient has an increased risk for developing a disease or disorder of the colon. The method includes the step of determining whether the patient has a mutation in a gene encoding a polypeptide listed in Tables 16 and 33, wherein presence of the mutation indicates that the patient has an increased risk for developing a disease or disorder of the colon.

In a related aspect, the invention features another method for determining whether a patient has an increased risk for developing a disease or disorder of the colon. This method includes the step of determining whether the patient has a polymorphism in a gene encoding a polypeptide listed in Tables 16 and 33, wherein presence of the polymorphism indicates that the patient may have an increased risk for developing a disease or disorder of the colon.

In either of these two methods, the mutation or polymorphism is preferably associated with an alteration (for example, a decrease) in the biological activity of the polypeptide.

In another aspect, the invention features another method for determining whether a patient has an increased risk for developing a disease or disorder of the colon. The method includes measuring biological activity of a GPCR polypeptide from the patient that is substantially identical to a polypeptide listed in Tables 16 and 33, wherein increased or decreased levels in the GPCR biological activity, relative to normal levels, indicate that the patient may have an increased risk for developing a disease or disorder of the colon.

In still another aspect, the invention features yet another method for determining whether a patient has an increased risk for developing a disease or disorder of the colon. The method includes the step of measuring the patient's expression levels of a polypeptide listed in Tables 16 and 33, wherein altered levels in the expression, relative to normal, indicate that the patient has an increased risk for developing a disease or disorder of the colon. Preferably, the expression levels are determined by measuring levels of polypeptide or mRNA.

In another aspect, the invention features a non-human mammal (e.g., a mouse), having a transgene that includes a nucleic acid molecule encoding a GPCR polypeptide substantially identical to a polypeptide listed in Table 16.

In yet another aspect, the invention features a non-human mammal (e.g., a mouse), having a mutation in a nucleic acid molecule encoding a GPCR polypeptide substantially identical to a polypeptide listed in Table 16.

In a related aspect, the invention features a cell from a non-human mammal having a transgene that includes a nucleic acid molecule encoding a GPCR polypeptide substantially identical to a polypeptide listed in Table 16.

In another aspect, the invention features a cell from a non-human mammal having a mutation in a nucleic acid molecule encoding a GPCR polypeptide substantially identical to a polypeptide listed in Table 16.

In another aspect, the invention features a method of preventing or treating cardiovascular disease, including introducing into a human an expression vector that includes a nucleic acid molecule encoding a GPCR polypeptide substantially identical to a polypeptide listed in Tables 17 and 33, operably linked to a promoter.

In still another aspect, the invention features a method of treating or preventing cardiovascular disease, including administering to an animal (e.g., a human) a compound that modulates the biological activity of a GPCR polypeptide substantially identical to a polypeptide listed in Tables 17 and 33.

In yet another aspect, the invention features a method for determining whether a candidate compound is a compound that may be useful for the treatment of a cardiovascular disease or disorder. This method includes the steps of (a) providing a GPCR polypeptide substantially identical to a polypeptide listed in Tables 17 and 33; (b) contacting the GPCR polypeptide with the candidate compound; and (c) measuring biological activity of the GPCR polypeptide, wherein altered biological activity, relative to that of the GPCR polypeptide not contacted with the compound, indicates that the candidate compound may be useful for the treatment of a cardiovascular disease or disorder. The GPCR polypeptide can be in a cell or in a cell-free assay system.

In yet another aspect, the invention features a method for determining whether a candidate compound is a compound that may be useful for the treatment of a cardiovascular disease or disorder. This method includes the steps of (a) providing a transgenic non-human mammal (e.g., a knock-out mouse) having a disruption in a nucleic acid molecule encoding a GPCR polypeptide substantially identical to a polypeptide listed in Tables 17 and 33; (b) contacting the transgenic non-human mammal with the candidate compound, and (c) measuring biological activity of the GPCR polypeptide in the transgenic non-human mammal, wherein altered biological activity, relative to that of the transgenic non-human mammal not contacted with the compound, indicates that the candidate compound may be useful for the treatment of a cardiovascular disease or disorder.

In yet another aspect, the invention features a method for determining whether a candidate compound is a compound that may be useful for the treatment of a cardiovascular disease or disorder. This method includes the steps of (a) providing a transgenic non-human mammal (e.g., a mouse) overexpressing a nucleic acid molecule encoding a GPCR polypeptide substantially identical to a polypeptide listed in Tables 17 and 33; (b) contacting the transgenic non-human mammal with the candidate compound; and (c) measuring biological activity of the GPCR polypeptide in the transgenic non-human mammal, wherein altered biological activity, relative to that of the transgenic non-human mammal not contacted with the compound, indicates that the candidate compound may be useful for the treatment of a cardiovascular disease or disorder.

In still another aspect, the invention features another method for determining whether a candidate compound may be useful for the treatment of a cardiovascular disease or disorder. This method includes (a) providing a nucleic acid molecule comprising a promoter from a gene encoding a GPCR polypeptide listed in Tables 17 and 33, the promoter operably linked to a reporter system; (b) contacting the nucleic acid molecule with the candidate compound; and (c) measuring reporter activity, wherein altered reporter activity, relative to a nucleic acid molecule not contacted with the compound, indicates that the candidate compound may be useful for the treatment of a cardiovascular disease or disorder.

In another aspect, the invention features yet another method for determining whether a candidate compound may be useful for the treatment of a cardiovascular disease or disorder. This method includes the steps of: (a) providing a GPCR polypeptide substantially identical to a polypeptide listed in Tables 17 and 33; (b) contacting the polypeptide with the candidate compound; and (c) measuring interaction of the candidate compound to the polypeptide. Interaction of the compound to the polypeptide indicates that the candidate compound may be useful for the treatment of a cardiovascular disease or disorder.

In still another aspect, the invention features another method for determining whether a candidate compound may be useful for the treatment of a cardiovascular disease or disorder. This method includes (a) providing a GPCR polypeptide substantially identical to a polypeptide listed in Tables 17 and 33; (b) contacting the polypeptide with the candidate compound; and (c) measuring the half-life of the polypeptide, wherein an alteration in the half-life of the polypeptide, relative to that of the polypeptide not contacted with the compound, indicates that the candidate compound may be useful for the treatment of a cardiovascular disease or disorder. Preferably the GPCR polypeptide is in a cell or a cell free assay system.

In another aspect, the invention features a method for determining whether a patient has an increased risk for developing a cardiovascular disease or disorder. The method includes the step of determining whether the patient has a mutation in a gene encoding a polypeptide listed in Tables 17 and 33, wherein presence of the mutation indicates that the patient may have an increased risk for developing a cardiovascular disease or disorder.

In a related aspect, the invention features another method for determining whether a patient has an increased risk for developing a cardiovascular disease or disorder. This method includes the step of determining whether the patient has a polymorphism in a gene encoding a polypeptide listed in Tables 17 and 33, wherein presence of the polymorphism indicates that the patient may have an increased risk for developing a cardiovascular disease or disorder.

In either of these two methods, the mutation or polymorphism is preferably associated with an alteration (for example, a decrease) in the biological activity of the polypeptide.

In another aspect, the invention features another method for determining whether a patient has an increased risk for developing a cardiovascular disease or disorder. The method includes measuring biological activity of a GPCR polypeptide from the patient that is substantially identical to a polypeptide listed in Tables 17 and 33, wherein increased or decreased levels in the GPCR biological activity, relative to normal levels, indicate that the patient may have an increased risk for developing a cardiovascular disease or disorder.

In still another aspect, the invention features yet another method for determining whether a patient has an increased risk for developing a cardiovascular disease or disorder. The method includes the step of measuring the patient's expression levels of a polypeptide listed in Tables 17 and 33, wherein altered levels in the expression, relative to normal, indicate that the patient has an increased risk for developing a cardiovascular disease or disorder. Preferably, the expression levels are determined by measuring levels of polypeptide or mRNA. One preferred cardiovascular disease that can be treated or diagnosed using the methods of the invention or for which candidate therapeutic compounds may be identified is coronary artery disease.

In another aspect, the invention features a non-human mammal (e.g., a mouse), having a transgene that includes a nucleic acid molecule encoding a GPCR polypeptide substantially identical to a polypeptide listed in Table 17.

In yet another aspect, the invention features a non-human mammal (e.g., a mouse), having a mutation in a nucleic acid molecule encoding a GPCR polypeptide substantially identical to a polypeptide listed in Table 17.

In a related aspect, the invention features a cell from a non-human mammal having a transgene that includes a nucleic acid molecule encoding a GPCR polypeptide substantially identical to a polypeptide listed in Table 17.

In another aspect, the invention features a cell from a non-human mammal having a mutation in a nucleic acid molecule encoding a GPCR polypeptide substantially identical to a polypeptide listed in Table 17.

In another aspect, the invention features a method of preventing or treating a disease of the intestine including introducing into a human an expression vector that includes a nucleic acid molecule encoding a GPCR polypeptide substantially identical to a polypeptide listed in Tables 18 and 33, operably linked to a promoter.

In still another aspect, the invention features a method of treating or preventing a disease of the intestine including administering to an animal (e.g., a human) a compound that modulates the biological activity of a GPCR polypeptide substantially identical to a polypeptide listed in Tables 18 and 33.

In yet another aspect, the invention features a method for determining whether a candidate compound is a compound that may be useful for the treatment of a disease or disorder of the intestine. This method includes the steps of (a) providing a GPCR polypeptide substantially identical to a polypeptide listed in Tables 18 and 33; (b) contacting the GPCR polypeptide with the candidate compound; and (c) measuring biological activity of the GPCR polypeptide, wherein altered biological activity, relative to that of the GPCR polypeptide not contacted with the compound, indicates that the candidate compound may be useful for the treatment of a disease or disorder of the intestine. The GPCR polypeptide can be in a cell or in a cell-free assay system.

In yet another aspect, the invention features a method for determining whether a candidate compound is a compound that may be useful for the treatment of a disease or disorder of the intestine. This method includes the steps of (a) providing a transgenic non-human mammal (e.g., a knock-out mouse) having a disruption in a nucleic acid molecule encoding a GPCR polypeptide substantially identical to a polypeptide listed in Tables 18 and 33; (b) contacting the transgenic non-human mammal with the candidate compound; and (c) measuring biological activity of the GPCR polypeptide in the transgenic non-human mammal, wherein altered biological activity, relative to that of the transgenic non-human mammal not contacted with the compound, indicates that the candidate compound may be useful for the treatment of a disease or disorder of the intestine.

In yet another aspect, the invention features a method for determining whether a candidate compound is a compound that may be useful for the treatment of a disease or disorder of the intestine. This method includes the steps of (a) providing a transgenic non-human mammal (e.g., a mouse) overexpressing a nucleic acid molecule encoding a GPCR polypeptide substantially identical to a polypeptide listed in Tables 18 and 33; (b) contacting the transgenic non-human mammal with the candidate compound; and (c) measuring biological activity of the GPCR polypeptide in the transgenic non-human mammal, wherein altered biological activity, relative to that of the transgenic non-human mammal not contacted with the compound, indicates that the candidate compound may be useful for the treatment of a disease or disorder of the intestine.

In still another aspect, the invention features another method for determining whether a candidate compound may be useful for the treatment of a disease or disorder of the intestine. This method includes (a) providing a nucleic acid molecule comprising a promoter from a gene encoding a GPTR polypeptide listed in Tables 18 and 33, the promoter operably linked to a reporter system; (b) contacting the nucleic acid molecule with the candidate compound; and (c) measuring reporter activity, wherein altered reporter activity, relative to a nucleic acid molecule not contacted with the compound, indicates that the candidate compound may be useful for the treatment of a disease or disorder of the intestine.

In another aspect, the invention features yet another method for determining whether a candidate compound may be useful for the treatment of a disease or disorder of the intestine. This method includes the steps of: (a) providing a GPCR polypeptide substantially identical to a polypeptide listed in Tables 18 and 33; (b) contacting the polypeptide with the candidate compound; and (c) measuring interaction of the candidate compound to the polypeptide. Interaction of the compound to the polypeptide indicates that the candidate compound may be useful for the treatment of a disease or disorder of the intestine.

In still another aspect, the invention features another method for determining whether a candidate compound may be useful for the treatment of a disease or disorder of the intestine. This method includes (a) providing a GPCR polypeptide substantially identical to a polypeptide listed in Tables 18 and 33; (b) contacting the polypeptide with the candidate compound; and (c) measuring the half-life of the polypeptide, wherein an alteration in the half-life of the polypeptide, relative to that of the polypeptide not contacted with the compound, indicates that the candidate compound may be useful for the treatment of a disease or disorder of the intestine. Preferably the GPCR polypeptide is in a cell or a cell free assay system.

In another aspect, the invention features a method for determining whether a patient has an increased risk for developing a disease or disorder of the intestine. The method includes the step of determining whether the patient has a mutation in a gene encoding a polypeptide listed in Tables 18 and 33, wherein presence of the mutation indicates that the patient may have an increased risk for developing a disease or disorder of the intestine.

In a related aspect, the invention features another method for determining whether a patient has an increased risk for developing a disease or disorder of the intestine. This method includes the step of determining whether the patient has a polymorphism in a gene encoding a polypeptide listed in Tables 18 and 33, wherein presence of the polymorphism indicates that the patient may have an increased risk for developing a disease or disorder of the intestine.

In either of these two methods, the mutation or polymorphism is preferably associated with an alteration (for example, a decrease) in the biological activity of the polypeptide.

In another aspect, the invention features another method for determining whether a patient has an increased risk for developing a disease or disorder of the intestine. The method includes measuring biological activity of a GPCR polypeptide from the patient that is substantially identical to a polypeptide listed in Tables 18 and 33, wherein increased or decreased levels in the GPCR biological activity, relative to normal levels, indicate that the patient may have an increased risk for developing a disease or disorder of the intestine.

In still another aspect, the invention features yet another method for determining whether a patient has an increased risk for developing a disease or disorder of the intestine. The method includes the step of measuring the patient's expression levels of a polypeptide listed in Tables 18 and 33, wherein altered levels in the expression, relative to normal, indicate that the patient has an increased risk for developing a disease or disorder of the intestine. Preferably, the expression levels are determined by measuring levels of polypeptide or mRNA.

In another aspect, the invention features a non-human mammal (e.g., a mouse), having a transgene that includes a nucleic acid molecule encoding a GPCR polypeptide substantially identical to a polypeptide listed in Table 18.

In yet another aspect, the invention features a non-human mammal (e.g., a mouse), having a mutation in a nucleic acid molecule encoding a GPCR polypeptide substantially identical to a polypeptide listed in Table 18.

In a related aspect, the invention features a cell from a non-human mammal having a transgene that includes a nucleic acid molecule encoding a GPCR polypeptide substantially identical to a polypeptide listed in Table 18.

In another aspect, the invention features a cell from a non-human mammal having a mutation in a nucleic acid molecule encoding a GPCR polypeptide substantially identical to a polypeptide listed in Table 18.

In another aspect, the invention features a method of preventing or treating a disease of the kidney including introducing into a human an expression vector that includes a nucleic acid molecule encoding a GPCR polypeptide substantially identical to a polypeptide listed in Tables 19 and 33, operably linked to a promoter.

In still another aspect, the invention features a method of treating or preventing a disease of the kidney including administering to an animal (e.g., a human) a compound that modulates the biological activity of a GPCR polypeptide substantially identical to a polypeptide listed in Tables 19 and 33.

In yet another aspect, the invention features a method for determining whether a candidate compound is a compound that may be useful for the treatment of a disease or disorder of the kidney. This method includes the steps of (a) providing a GPCR polypeptide substantially identical to a polypeptide listed in Tables 19 and 33; (b) contacting the GPCR polypeptide with the candidate compound; and (c) measuring biological activity of the GPCR polypeptide, wherein altered biological activity, relative to that of the GPCR polypeptide not contacted with the compound, indicates that the candidate compound may be useful for the treatment of a disease or disorder of the kidney. The GPCR polypeptide can be in a cell or in a cell-free assay system.

In yet another aspect, the invention features a method for determining whether a candidate compound is a compound that may be useful for the treatment of a disease or disorder of the kidney. This method includes the steps of (a) providing a transgenic non-human mammal (e.g., a knock-out mouse) having a disruption in a nucleic acid molecule encoding a GPCR polypeptide substantially identical to a polypeptide listed in Tables 19 and 33; (b) contacting the transgenic non-human mammal with the candidate compound; and (c) measuring biological activity of the GPCR polypeptide in the transgenic non-human mammal, wherein altered biological activity, relative to that of the transgenic non-human mammal not contacted with the compound, indicates that the candidate compound may be useful for the treatment of a disease or disorder of the kidney.

In yet another aspect, the invention features a method for determining whether a candidate compound is a compound that may be useful for the treatment of a disease or disorder of the kidney. This method includes the steps of (a) providing a transgenic non-human mammal (e.g., a mouse) overexpressing a nucleic acid molecule encoding a GPCR polypeptide substantially identical to a polypeptide listed in Tables 19 and 33; (b) contacting the transgenic non-human mammal with the candidate compound; and (c) measuring biological activity of the GPCR polypeptide in the transgenic non-human mammal, wherein altered biological activity, relative to that of the transgenic non-human mammal not contacted with the compound, indicates that the candidate compound may be useful for the treatment of a disease or disorder of the kidney.

In still another aspect, the invention features another method for determining whether a candidate compound may be useful for the treatment of a disease or disorder of the kidney. This method includes (a) providing a nucleic acid molecule comprising a promoter from a gene encoding a GPCR polypeptide listed in Tables 19 and 33, the promoter operably linked to a reporter system; (b) contacting the nucleic acid molecule with the candidate compound; and (c) measuring reporter activity, wherein altered reporter activity, relative to a nucleic acid molecule not contacted with the compound, indicates that the candidate compound may be useful for the treatment of a disease or disorder of the kidney.

In another aspect, the invention features yet another method for determining whether a candidate compound may be useful for the treatment of a disease or disorder of the kidney. This method includes the steps of: (a) providing a GPCR polypeptide substantially identical to a polypeptide listed in Tables 19 and 33; (b) contacting the polypeptide with the candidate compound; and (c) measuring interaction of the candidate compound to the polypeptide. Interaction of the compound to the polypeptide indicates that the candidate compound may be useful for the treatment of a disease or disorder of the kidney.

In still another aspect, the invention features another method for determining whether a candidate compound may be useful for the treatment of a disease or disorder of the kidney. This method includes (a) providing a GPCR polypeptide substantially identical to a polypeptide listed in Tables 19 and 33; (b) contacting the polypeptide with the candidate compound; and (c) measuring the half-life of the polypeptide, wherein an alteration in the half-life of the polypeptide, relative to that of the polypeptide not contacted with the compound, indicates that the candidate compound may be useful for the treatment of a disease or disorder of the kidney. Preferably the GPCR polypeptide is in a cell or a cell free assay system.

In another aspect, the invention features a method for determining whether a patient has an increased risk for developing a disease or disorder of the kidney. The method includes the step of determining whether the patient has a mutation in a gene encoding a polypeptide listed in Tables 19 and 33, wherein presence of the mutation indicates that the patient may have an increased risk for developing a disease or disorder of the kidney.

In a related aspect, the invention features another method for determining whether a patient has an increased risk for developing a disease or disorder of the kidney. This method includes the step of determining whether the patient has a polymorphism in a gene encoding a polypeptide listed in Tables 19 and 33, wherein presence of the polymorphism indicates that the patient may have an increased risk for developing a disease or disorder of the kidney.

In either of these two methods, the mutation or polymorphism is preferably associated with an alteration (for example, a decrease) in the biological activity of the polypeptide.

In another aspect, the invention features another method for determining whether a patient has an increased risk for developing a disease or disorder of the kidney. The method includes measuring biological activity of a GPCR polypeptide from the patient that is substantially identical to a polypeptide listed in Tables 19 and 33, wherein increased or decreased levels in the GPCR biological activity, relative to normal levels, indicate that the patient may have an increased risk for developing a disease or disorder of the kidney.

In still another aspect, the invention features yet another method for determining whether a patient has an increased risk for developing a disease or disorder of the kidney. The method includes the step of measuring the patient's expression levels of a polypeptide listed in Tables 19 and 33, wherein altered levels in the expression, relative to normal, indicate that the patient has an increased risk for developing a disease or disorder of the kidney. Preferably, the expression levels are determined by measuring levels of polypeptide or mRNA.

In another aspect, the invention features a non-human mammal (e.g., a mouse), having a transgene that includes a nucleic acid molecule encoding a GPCR polypeptide substantially identical to a polypeptide listed in Table 19.

In yet another aspect, the invention features a non-human mammal (e.g., a mouse), having a mutation in a nucleic acid molecule encoding a GPCR polypeptide substantially identical to a polypeptide listed in Table 19.

In a related aspect, the invention features a cell from a non-human mammal having a transgene that includes a nucleic acid molecule encoding a GPCR polypeptide substantially identical to a polypeptide listed in Table 19.

In another aspect, the invention features a cell from a non-human mammal having a mutation in a nucleic acid molecule encoding a GPCR polypeptide substantially identical to a polypeptide listed in Table 19.

In another aspect, the invention features a method of preventing or treating a disease of the liver including introducing into a human an expression vector that includes a nucleic acid molecule encoding a GPCR polypeptide substantially identical to a polypeptide listed in Tables 20 and 33, operably linked to a promoter.

In still another aspect, the invention features a method of treating or preventing a disease of the liver including administering to an animal (e.g., a human) a compound that modulates the biological activity of a GPCR polypeptide substantially identical to a polypeptide listed in Tables 20 and 33.

In yet another aspect, the invention features a method for determining whether a candidate compound is a compound that may be useful for the treatment of a disease or disorder of the liver. This method includes the steps of (a) providing a GPCR polypeptide substantially identical to a polypeptide listed in Tables 20 and 33; (b) contacting the GPCR polypeptide with the candidate compound; and (c) measuring biological activity of the GPCR polypeptide, wherein altered biological activity, relative to that of the GPCR polypeptide not contacted with the compound, indicates that the candidate compound may be useful for the treatment of a disease or disorder of the liver. The GPCR polypeptide can be in a cell or in a cell-free assay system.

In yet another aspect, the invention features a method for determining whether a candidate compound is a compound that may be useful for the treatment of a disease or disorder of the liver. This method includes the steps of (a) providing a transgenic non-human mammal (e.g., a knock-out mouse) having a disruption in a nucleic acid molecule encoding a GPCR polypeptide substantially identical to a polypeptide listed in Tables 20 and 33; (b) contacting the transgenic non-human mammal with the candidate compound; and (c) measuring biological activity of the GPCR polypeptide in the transgenic non-human mammal, wherein altered biological activity, relative to that of the transgenic non-human mammal not contacted with the compound, indicates that the candidate compound may be useful for the treatment of a disease or disorder of the liver.

In yet another aspect, the invention features a method for determining whether a candidate compound is a compound that may be useful for the treatment of a disease or disorder of the liver. This method includes the steps of (a) providing a transgenic non-human mammal (e.g., a mouse) overexpressing a nucleic acid molecule encoding a GPCR polypeptide substantially identical to a polypeptide listed in Tables 20 and 33; (b) contacting the transgenic non-human mammal with the candidate compound; and (c) measuring biological activity of the GPCR polypeptide in the transgenic non-human mammal, wherein altered biological activity, relative to that of the transgenic non-human mammal not contacted with the compound, indicates that the candidate compound may be useful for the treatment of a disease or disorder of the liver.

In still another aspect, the invention features another method for determining whether a candidate compound may be useful for the treatment of a disease or disorder of the liver. This method includes (a) providing a nucleic acid molecule comprising a promoter from a gene encoding a GPCR polypeptide listed in Tables 20 and 33, the promoter operably linked to a reporter system; (b) contacting the nucleic acid molecule with the candidate compound; and (c) measuring reporter activity, wherein altered reporter activity, relative to a nucleic acid molecule not contacted with the compound, indicates that the candidate compound may be useful for the treatment of a disease or disorder of the liver.

In another aspect, the invention features yet another method for determining whether a candidate compound may be useful for the treatment of a disease or disorder of the liver. This method includes the steps of: (a) providing a GPCR polypeptide substantially identical to a polypeptide listed in Tables 20 and 33; (b) contacting the polypeptide with the candidate compound; and (c) measuring interaction of the candidate compound to the polypeptide. Interaction of the compound to the polypeptide indicates that the candidate compound may be useful for the treatment of a disease or disorder of the liver.

In still another aspect, the invention features another method for determining whether a candidate compound may be useful for the treatment of a disease or disorder of the liver. This method includes (a) providing a GPCR polypeptide substantially identical to a polypeptide listed in Tables 20 and 33; (b) contacting the polypeptide with the candidate compound; and (c) measuring the half-life of the polypeptide, wherein an alteration in the half-life of the polypeptide, relative to that of the polypeptide not contacted with the compound, indicates that the candidate compound may be useful for the treatment of a disease or disorder of the liver. Preferably the GPCR polypeptide is in a cell or a cell free assay system.

In another aspect, the invention features a method for determining whether a patient has an increased risk for developing a disease or disorder of the liver. The method includes the step of determining whether the patient has a mutation in a gene encoding a polypeptide listed in Tables 20 and 33, wherein presence of the mutation indicates that the patient may have an increased risk for developing a disease or disorder of the liver.

In a related aspect, the invention features another method for determining whether a patient has an increased risk for developing a disease or disorder of the liver. This method includes the step of determining whether the patient has a polymorphism in a gene encoding a polypeptide listed in Tables 20 and 33, wherein presence of the polymorphism indicates that the patient may have an increased risk for developing a disease or disorder of the liver.

In either of these two methods, the mutation or polymorphism is preferably associated with an alteration (for example, a decrease) in the biological activity of the polypeptide.

In another aspect, the invention features another method for determining whether a patient has an increased risk for developing a disease or disorder of the liver. The method includes measuring biological activity of a GPCR polypeptide from the patient that is substantially identical to a polypeptide listed in Tables 20 and 33, wherein increased or decreased levels in the GPCR biological activity, relative to normal levels, indicate that the patient may have an increased risk for developing a disease or disorder of the liver.

In still another aspect, the invention features yet another method for determining whether a patient has an increased risk for developing a disease or disorder of the liver. The method includes the step of measuring the patient's expression levels of a polypeptide listed in Tables 20 and 33, wherein altered levels in the expression, relative to normal, indicate that the patient has an increased risk for developing a disease or disorder of the liver. Preferably, the expression levels are determined by measuring levels of polypeptide or mRNA.

In another aspect, the invention features a non-human mammal (e.g., a mouse), having a transgene that includes a nucleic acid molecule encoding a GPCR polypeptide substantially identical to a polypeptide listed in Table 20.

In yet another aspect, the invention features a non-human mammal (e.g., a mouse), having a mutation in a nucleic acid molecule encoding a GPCR polypeptide substantially identical to a polypeptide listed in Table 20.

In a related aspect, the invention features a cell from a non-human mammal having a transgene that includes a nucleic acid molecule encoding a GPCR polypeptide substantially identical to a polypeptide listed in Table 20.

In another aspect, the invention features a cell from a non-human mammal having a mutation in a nucleic acid molecule encoding a GPCR polypeptide substantially identical to a polypeptide listed in Table 20.

In another aspect, the invention features a method of preventing or treating lung disease, including introducing into a human an expression vector that includes a nucleic acid molecule encoding a GPCR polypeptide substantially identical to a polypeptide listed in Tables 21 and 33, operably linked to a promoter.

In still another aspect, the invention features a method of treating or preventing lung disease, including administering to an animal (e.g., a human) a compound that modulates the biological activity of a GPCR polypeptide substantially identical to a polypeptide listed in Tables 21 and 33.

In yet another aspect, the invention features a method for determining whether a candidate compound is a compound that may be useful for the treatment of a lung disease or disorder. This method includes the steps of (a) providing a GPCR polypeptide substantially identical to a polypeptide listed in Tables 21 and 33; (b) contacting the GPCR polypeptide with the candidate compound; and (c) measuring biological activity of the GPCR polypeptide, wherein altered biological activity, relative to that of the GPCR polypeptide not contacted with the compound, indicates that the candidate compound may be useful for the treatment of a lung disease or disorder. The GPCR polypeptide can be in a cell or in a cell-free assay system.

In yet another aspect, the invention features a method for determining whether a candidate compound is a compound that may be useful for the treatment of a disease or disorder of the lung. This method includes the steps of (a) providing a transgenic non-human mammal (e.g., a knock-out mouse) having a disruption in a nucleic acid molecule encoding a GPCR polypeptide substantially identical to a polypeptide listed in Tables 21 and 33; (b) contacting the transgenic non-human mammal with the candidate compound; and (c) measuring biological activity of the transgenic non-human mammal, wherein altered biological activity, relative to that of the transgenic non-human mammal not contacted with the compound, indicates that the candidate compound may be useful for the treatment of a disease or disorder of the lung.

In yet another aspect, the invention features a method for determining whether a candidate compound is a compound that may be useful for the treatment of a disease or disorder of the lung. This method includes the steps of (a) providing a transgenic non-human mammal (e.g., a mouse) overexpressing a nucleic acid molecule encoding a GPCR polypeptide substantially identical to a polypeptide listed in Tables 21 and 33; (b) contacting the transgenic non-human mammal with the candidate compound; and (c) measuring biological activity of the transgenic non-human mammal, wherein altered biological activity, relative to that of the transgenic non-human mammal not contacted with the compound, indicates that the candidate compound may be useful for the treatment of a disease or disorder of the lung.

In still another aspect, the invention features another method for determining whether a candidate compound may be useful for the treatment of a lung disease or disorder. This method includes (a) providing a nucleic acid molecule comprising a promoter from a gene encoding a GPCR polypeptide listed in Tables 21 and 33, the promoter operably linked to a reporter system; (b) contacting the nucleic acid molecule with the candidate compound; and (c) measuring reporter activity, wherein altered reporter activity, relative to a nucleic acid molecule not contacted with the compound, indicates that the candidate compound may be useful for the treatment of a lung disease or disorder.

In another aspect, the invention features yet another method for determining whether a candidate compound may be useful for the treatment of a lung disease or disorder. This method includes the steps of: (a) providing a GPCR polypeptide substantially identical to a polypeptide listed in Tables 21 and 33; (b) contacting the polypeptide with the candidate compound; and (c) measuring interaction of the candidate compound to the polypeptide. Interaction of the compound to the polypeptide indicates that the candidate compound may be useful for the treatment of a lung disease or disorder.

In still another aspect, the invention features another method for determining whether a candidate compound may be useful for the treatment of a lung disease or disorder. This method includes (a) providing a GPCR polypeptide substantially identical to a polypeptide listed in Tables 21 and 33; (b) contacting the polypeptide with the candidate compound; and (c) measuring the half-life of the polypeptide, wherein an alteration in the half-life of the polypeptide, relative to that of the polypeptide not contacted with the compound, indicates that the candidate compound may be useful for the treatment of a lung disease or disorder. Preferably, the GPCR polypeptide is in a cell or a cell free assay system.

In another aspect, the invention features a method for determining whether a patient has an increased risk for developing a lung disease or disorder. The method includes the step of determining whether the patient has a mutation in a gene encoding a polypeptide listed in Tables 21 and 33, wherein presence of the mutation indicates that the patient may have an increased risk for developing a lung disease or disorder.

In a related aspect, the invention features another method for determining whether a patient has an increased risk for developing a lung disease or disorder. This method includes the step of determining whether the patient has a polymorphism in a gene encoding a polypeptide listed in Tables 21 and 33, wherein presence of the polymorphism indicates that the patient may have an increased risk for developing a lung disease or disorder.

In either of these two methods, the mutation or polymorphism is preferably associated with an alteration (for example, a decrease) in the biological activity of the polypeptide.

In another aspect, the invention features another method for determining whether a patient has an increased risk for developing a lung disease or disorder. The method includes measuring biological activity of a GPCR polypeptide from the patient that is substantially identical to a polypeptide listed in Tables 21 and 33, wherein increased or decreased levels in the GPCR biological activity, relative to normal levels, indicate that the patient may have an increased risk for developing a lung disease or disorder.

In still another aspect, the invention features yet another method for determining whether a patient has an increased risk for developing a lung disease or disorder. The method includes the step of measuring the patient's expression levels of a polypeptide listed in Tables 21 and 33, wherein altered levels in the expression, relative to normal, indicate that the patient has an increased risk for developing a lung disease or disorder. Preferably, the expression levels are determined by measuring levels of polypeptide or mRNA.

In another aspect, the invention features a non-human mammal (e.g., a mouse), having a transgene that includes a nucleic acid molecule encoding a GPCR polypeptide substantially identical to a polypeptide listed in Table 21.

In yet another aspect, the invention features a non-human mammal (e.g., a mouse), having a mutation in a nucleic acid molecule encoding a GPCR polypeptide substantially identical to a polypeptide listed in Table 21.

In a related aspect, the invention features a cell from a non-human mammal having a transgene that includes a nucleic acid molecule encoding a GPCR polypeptide substantially identical to a polypeptide listed in Table 21.

In another aspect, the invention features a cell from a non-human mammal having a mutation in a nucleic acid molecule encoding a GPCR polypeptide substantially identical to a polypeptide listed in Table 21.

In another aspect, the invention features a method of preventing or treating muscular disease, including introducing into a human an expression vector that includes a nucleic acid molecule encoding a GPCR polypeptide substantially identical to a polypeptide listed in Tables 22 and 33, operably linked to a promoter.

In still another aspect, the invention features a method of treating or preventing muscular disease, including administering to an animal (e.g., a human) a compound that modulates the biological activity of a GPCR polypeptide substantially identical to a polypeptide listed in Tables 22 and 33.

In yet another aspect, the invention features a method for determining whether a candidate compound is a compound that may be useful for the treatment of a muscular disease or disorder. This method includes the steps of (a) providing a GPCR polypeptide substantially identical to a polypeptide listed in Tables 22 and 33; (b) contacting the GPCR polypeptide with the candidate compound; and (c) measuring biological activity of the GPCR polypeptide, wherein altered biological activity, relative to that of the GPCR polypeptide not contacted with the compound, indicates that the candidate compound may be useful for the treatment of a muscular disease or disorder. The GPCR polypeptide can be in a cell or in a cell-free assay system.

In yet another aspect, the invention features a method for determining whether a candidate compound is a compound that may be useful for the treatment of a muscular disease or disorder. This method includes the steps of (a) providing a transgenic non-human mammal (e.g., a knock-out mouse) having a disruption in a nucleic acid molecule encoding a GPCR polypeptide substantially identical to a polypeptide listed in Tables 22 and 33; (b) contacting the transgenic non-human mammal with the candidate compound; and (c) measuring biological activity of the GPCR polypeptide in the transgenic non-human mammal, wherein altered biological activity, relative to that of the transgenic non-human mammal not contacted with the compound, indicates that the candidate compound may be useful for the treatment of a muscular disease or disorder.

In yet another aspect, the invention features a method for determining whether a candidate compound is a compound that may be useful for the treatment of a muscular disease or disorder. This method includes the steps of (a) providing a transgenic non-human mammal (e.g., a mouse) overexpressing a nucleic acid molecule encoding a GPCR polypeptide substantially identical to a polypeptide listed in Tables 22 and 33; (b) contacting the transgenic non-human mammal with the candidate compound; and (c) measuring biological activity of the GPCR polypeptide in the transgenic non-human mammal, wherein altered biological activity, relative to that of the transgenic non-human mammal not contacted with the compound, indicates that the candidate compound may be useful for the treatment of a muscular disease or disorder.

In still another aspect, the invention features another method for determining whether a candidate compound may be useful for the treatment of a muscular disease or disorder. This method includes (a) providing a nucleic acid molecule comprising a promoter from a gene encoding a GPCR polypeptide listed in Tables 22 and 33, the promoter operably linked to a reporter system; (b) contacting the nucleic acid molecule with the candidate compound; and (c) measuring reporter activity, wherein altered reporter activity, relative to a nucleic acid molecule not contacted with the compound, indicates that the candidate compound may be useful for the treatment of a muscular disease or disorder.

In another aspect, the invention features yet another method for determining whether a candidate compound may be useful for the treatment of a muscular disease or disorder. This method includes the steps of: (a) providing a GPCR polypeptide substantially identical to a polypeptide listed in Tables 22 and 33; (b) contacting the polypeptide with the candidate compound; and (c) measuring interaction of the candidate compound to the polypeptide. Interaction of the compound to the polypeptide indicates that the candidate compound may be useful for the treatment of a muscular disease or disorder.

In still another aspect, the invention features another method for determining whether a candidate compound may be useful for the treatment of a muscular disease or disorder. This method includes (a) providing a GPCR polypeptide substantially identical to a polypeptide listed in Tables 22 and 33; (b) contacting the polypeptide with the candidate compound; and (c) measuring the half-life of the polypeptide, wherein an alteration in the half-life of the polypeptide, relative to that of the polypeptide not contacted with the compound, indicates that the candidate compound may be useful for the treatment of a muscular disease or disorder. Preferably the GPCR polypeptide is in a cell or a cell free assay system.

In another aspect, the invention features a method for determining whether a patient has an increased risk for developing a muscular disease or disorder. The method includes the step of determining whether the patient has a mutation in a gene encoding a polypeptide listed in Tables 22 and 33, wherein presence of the mutation indicates that the patient may have an increased risk for developing a muscular disease or disorder.

In a related aspect, the invention features another method for determining whether a patient has an increased risk for developing a muscular disease or disorder. This method includes the step of determining whether the patient has a polymorphism in a gene encoding a polypeptide listed in Tables 22 and 33, wherein presence of the polymorphism indicates that the patient may have an increased risk for developing a muscular disease or disorder.

In either of these two methods, the mutation or polymorphism is preferably associated with an alteration (for example, a decrease) in the biological activity of the polypeptide.

In another aspect, the invention features another method for determining whether a patient has an increased risk for developing a muscular disease or disorder. The method includes measuring biological activity of a GPCR polypeptide from the patient that is substantially identical to a polypeptide listed in Tables 22 and 33, wherein increased or decreased levels in the GPCR biological activity, relative to normal levels, indicate that the patient may have an increased risk for developing a muscular disease or disorder.

In still another aspect, the invention features yet another method for determining whether a patient has an increased risk for developing a muscular disease or disorder. The method includes the step of measuring the patient's expression levels of a polypeptide listed in Tables 22 and 33, wherein altered levels in the expression, relative to normal, indicate that the patient has an increased risk for developing a muscular disease or disorder. Preferably, the expression levels are determined by measuring levels of polypeptide or mRNA.

In another aspect, the invention features a non-human mammal (e.g., a mouse), having a transgene that includes a nucleic acid molecule encoding a GPCR polypeptide substantially identical to a polypeptide listed in Table 22.

In yet another aspect, the invention features a non-human mammal (e.g., a mouse), having a mutation in a nucleic acid molecule encoding a GPCR polypeptide substantially identical to a polypeptide listed in Table 22.

In a related aspect, the invention features a cell from a non-human mammal having a transgene that includes a nucleic acid molecule encoding a GPCR polypeptide substantially identical to a polypeptide listed in Table 22.

In another aspect, the invention features a cell from a non-human mammal having a mutation in a nucleic acid molecule encoding a GPCR polypeptide substantially identical to a polypeptide listed in Table 22.

In another aspect, the invention features a method of preventing or treating a disease of the ovary including introducing into a human an expression vector that includes a nucleic acid molecule encoding a GPCR polypeptide substantially identical to a polypeptide listed in Tables 23 and 33, operably linked to a promoter.

In still another aspect, the invention features a method of treating or preventing a disease of the ovary including administering to an animal (e.g., a human) a compound that modulates the biological activity of a GPCR polypeptide substantially identical to a polypeptide listed in Tables 23 and 33.

In yet another aspect, the invention features a method for determining whether a candidate compound is a compound that may be useful for the treatment of a disease or disorder of the ovary. This method includes the steps of (a) providing a GPCR polypeptide substantially identical to a polypeptide listed in Tables 23 and 33; (b) contacting the GPCR polypeptide with the candidate compound; and (c) measuring biological activity of the GPCR polypeptide, wherein altered biological activity, relative to that of the GPCR polypeptide not contacted with the compound, indicates that the candidate compound may be useful for the treatment of a disease or disorder of the ovary. The GPCR polypeptide can be in a cell or in a cell-free assay system.

In yet another aspect, the invention features a method for determining whether a candidate compound is a compound that may be useful for the treatment of disease or disorder of the ovary. This method includes the steps of (a) providing a transgenic non-human mammal (e.g., a knock-out mouse) having a disruption in a nucleic acid molecule encoding a GPCR polypeptide substantially identical to a polypeptide listed in Tables 23 and 33; (b) contacting the transgenic non-human mammal with the candidate compound; and (c) measuring biological activity of the GPCR polypeptide in the transgenic non-human mammal, wherein altered biological activity, relative to that of the transgenic non-human mammal not contacted with the compound, indicates that the candidate compound may be useful for the treatment of a disease or disorder of the ovary.

In yet another aspect, the invention features a method for determining whether a candidate compound is a compound that may be useful for the treatment of a disease or disorder of the ovary. This method includes the steps of (a) providing a transgenic non-human mammal (e.g., a mouse) overexpressing a nucleic acid molecule encoding a GPCR polypeptide substantially identical to a polypeptide listed in Tables 23 and 33; (b) contacting the transgenic non-human mammal with the candidate compound; and (c) measuring biological activity of the GPCR polypeptide in the transgenic non-human mammal, wherein altered biological activity, relative to that of the transgenic non-human mammal not contacted with the compound, indicates that the candidate compound may be useful for the treatment of a disease or disorder of the ovary.

In still another aspect, the invention features another method for determining whether a candidate compound may be useful for the treatment of a disease or disorder of the ovary. This method includes (a) providing a nucleic acid molecule comprising a promoter from a gene encoding a GPCR polypeptide listed in Tables 23 and 33, the promoter operably linked to a reporter system; (b) contacting the nucleic acid molecule with the candidate compound; and (c) measuring reporter activity, wherein altered reporter activity, relative to a nucleic acid molecule not contacted with the compound, indicates that the candidate compound may be useful for the treatment of a disease or disorder of the ovary.

In another aspect, the invention features yet another method for determining whether a candidate compound may be useful for the treatment of a disease or disorder of the ovary. This method includes the steps of: (a) providing a GPCR polypeptide substantially identical to a polypeptide listed in Tables 23 and 33; (b) contacting the polypeptide with the candidate compound; and (c) measuring interaction of the candidate compound to the polypeptide. Interaction of the compound to the polypeptide indicates that the candidate compound may be useful for the treatment of a disease or disorder of the ovary.

In still another aspect, the invention features another method for determining whether a candidate compound may be useful for the treatment of a disease or disorder of the ovary. This method includes (a) providing a GPCR polypeptide substantially identical to a polypeptide listed in Tables 23 and 33; (b) contacting the polypeptide with the candidate compound; and (c) measuring the half-life of the polypeptide, wherein an alteration in the half-life of the polypeptide, relative to that of the polypeptide not contacted with the compound, indicates that the candidate compound may be useful for the treatment of a disease or disorder of the ovary. Preferably the GPCR polypeptide is in a cell or a cell free assay system.

In another aspect, the invention features a method for determining whether a patient has an increased risk for developing a disease or disorder of the ovary. The method includes the step of determining whether the patient has a mutation in a gene encoding a polypeptide listed in Tables 23 and 33, wherein presence of the mutation indicates that the patient may have an increased risk for developing a disease or disorder of the ovary.

In a related aspect, the invention features another method for determining whether a patient has an increased risk for developing a disease or disorder of the ovary. This method includes the step of determining whether the patient has a polymorphism in a gene encoding a polypeptide listed in Tables 23 and 33, wherein presence of the polymorphism indicates that the patient may have an increased risk for developing a disease or disorder of the ovary.

In either of these two methods, the mutation or polymorphism is preferably associated with an alteration (for example, a decrease) in the biological activity of the polypeptide.

In another aspect, the invention features another method for determining whether a patient has an increased risk for developing a disease or disorder of the ovary. The method includes measuring biological activity of a GPCR polypeptide from the patient that is substantially identical to a polypeptide listed in Tables 23 and 33, wherein increased or decreased levels in the GPCR-biological activity, relative to normal levels, indicate that the patient may have an increased risk for developing a disease or disorder of the ovary.

In still another aspect, the invention features yet another method for determining whether a patient has an increased risk for developing a disease or disorder of the ovary. The method includes the step of measuring the patient's expression levels of a polypeptide listed in Tables 23 and 33, wherein altered levels in the expression, relative to normal, indicate that the patient has an increased risk for developing a disease or disorder of the ovary. Preferably, the expression levels are determined by measuring levels of polypeptide or mRNA.

In another aspect, the invention features a non-human mammal (e.g., a mouse), having a transgene that includes a nucleic acid molecule encoding a GPCR polypeptide substantially identical to a polypeptide listed in Table 23.

In yet another aspect, the invention features a non-human mammal (e.g., a mouse), having a mutation in a nucleic acid molecule encoding a GPCR polypeptide substantially identical to a polypeptide listed in Table 23.

In a related aspect, the invention features a cell from a non-human mammal having a transgene that includes a nucleic acid molecule encoding a GPCR polypeptide substantially identical to a polypeptide listed in Table 23.

In another aspect, the invention features a cell from a non-human mammal having a mutation in a nucleic acid molecule encoding a GPCR polypeptide substantially identical to a polypeptide listed in Table 23.

In another aspect, the invention features a method of preventing or treating blood disease, including introducing into a human an expression vector that includes a nucleic acid molecule encoding a GPCR polypeptide substantially identical to a polypeptide listed in Tables 24 and 33, operably linked to a promoter.

In still another aspect, the invention features a method of treating or preventing blood disease, including administering to an animal (e.g., a human) a compound that modulates the biological activity of a GPCR polypeptide substantially identical to a polypeptide listed in Tables 24 and 33.

In yet another aspect, the invention features a method for determining whether a candidate compound is a compound that may be useful for the treatment of a blood disease or disorder. This method includes the steps of (a) providing a GPCR polypeptide substantially identical to a polypeptide listed in Tables 24 and 33; (b) contacting the GPCR polypeptide with the candidate compound; and (c) measuring biological activity of the GPCR polypeptide, wherein altered biological activity, relative to that of the GPCR polypeptide not contacted with the compound, indicates that the candidate compound may be useful for the treatment of a blood disease or disorder. The GPCR polypeptide can be in a cell or in a cell-free assay system.

In yet another aspect, the invention features a method for determining whether a candidate compound is a compound that may be useful for the treatment of a blood disease or disorder. This method includes the steps of (a) providing a transgenic non-human mammal (e.g., a knock-out mouse) having a disruption in a nucleic acid molecule encoding a GPCR polypeptide substantially identical to a polypeptide listed in Tables 24 and 33; (b) contacting the transgenic non-human mammal with the candidate compound; and (c) measuring biological activity of the GPCR polypeptide in the transgenic non-human mammal, wherein altered biological activity, relative to that of the transgenic non-human mammal not contacted with the compound, indicates that the candidate compound may be useful for the treatment of a blood disease or disorder.

In yet another aspect, the invention features a method for determining whether a candidate compound is a compound that may be useful for the treatment of a blood disease or disorder. This method includes the steps of (a) providing a transgenic non-human mammal (e.g., a mouse) overexpressing a nucleic acid molecule encoding a GPCR polypeptide substantially identical to a polypeptide listed in Tables 24 and 33; (b) contacting the transgenic non-human mammal with the candidate compound; and (c) measuring biological activity of the GPCR polypeptide in the transgenic non-human mammal, wherein altered biological activity, relative to that of the transgenic non-human mammal not contacted with the compound, indicates that the candidate compound may be useful for the treatment of a blood disease or disorder.

In still another aspect, the invention features another method for determining whether a candidate compound may be useful for the treatment of a blood disease or disorder. This method includes (a) providing a nucleic acid molecule comprising a promoter from a gene encoding a GPCR polypeptide listed in Tables 24 and 33, the promoter operably linked to a reporter system; (b) contacting the nucleic acid molecule with the candidate compound; and (c) measuring reporter activity, wherein altered reporter activity, relative to a nucleic acid molecule not contacted with the compound, indicates that the candidate compound may be useful for the treatment of a blood disease or disorder.

In another aspect, the invention features yet another method for determining whether a candidate compound may be useful for the treatment of a blood disease or disorder. This method includes the steps of: (a) providing a GPCR polypeptide substantially identical to a polypeptide listed in Tables 24 and 33; (b) contacting the polypeptide with the candidate compound; and (c) measuring interaction of the candidate compound to the polypeptide. Interaction of the compound to the polypeptide indicates that the candidate compound may be useful for the treatment of a blood disease or disorder.

In still another aspect, the invention features another method for determining whether a candidate compound may be useful for the treatment of a blood disease or disorder. This method includes (a) providing a GPCR polypeptide substantially identical to a polypeptide listed in Tables 24 and 33; (b) contacting the polypeptide with the candidate compound; and (c) measuring the half-life of the polypeptide, wherein an alteration in the half-life of the polypeptide, relative to that of the polypeptide not contacted with the compound, indicates that the candidate compound may be useful for the treatment of a blood disease or disorder. Preferably the GPCR polypeptide is in a cell or a cell free assay system.

In another aspect, the invention features a method for determining whether a patient has an increased risk for developing a blood disease or disorder. The method includes the step of determining whether the patient has a mutation in a gene encoding a polypeptide listed in Tables 24 and 33, wherein presence of the mutation indicates that the patient may have an increased risk for developing a blood disease or disorder.

In a related aspect, the invention features another method for determining whether a patient has an increased risk for developing a blood disease or disorder. This method includes the step of determining whether the patient has a polymorphism in a gene encoding a polypeptide listed in Tables 24 and 33, wherein presence of the polymorphism indicates that the patient may have an increased risk for developing a blood disease or disorder.

In either of these two methods, the mutation or polymorphism is preferably associated with an alteration (for example, a decrease) in the biological activity of the polypeptide.

In another aspect, the invention features another method for determining whether a patient has an increased risk for developing a blood disease or disorder. The method includes measuring biological activity of a GPCR polypeptide from the patient that is substantially identical to a polypeptide listed in Tables 24 and 33, wherein increased or decreased levels in the GPCR biological activity, relative to normal levels, indicate that the patient may have an increased risk for developing a blood disease or disorder.

In still another aspect, the invention features yet another method for determining whether a patient has an increased risk for developing a blood disease or disorder. The method includes the step of measuring the patient's expression levels of a polypeptide listed in Tables 24 and 33, wherein altered levels in the expression, relative to normal, indicate that the patient has an increased risk for developing a blood disease or disorder. Preferably, the expression levels are determined by measuring levels of polypeptide or mRNA.

In another aspect, the invention features a non-human mammal (e.g., a mouse), having a transgene that includes a nucleic acid molecule encoding a GPCR polypeptide substantially identical to a polypeptide listed in Table 24.

In yet another aspect, the invention features a non-human mammal (e.g., a mouse), having a mutation in a nucleic acid molecule encoding a GPCR polypeptide substantially identical to a polypeptide listed in Table 24.

In a related aspect, the invention features a cell from a non-human mammal having a transgene that includes a nucleic acid molecule encoding a GPCR polypeptide substantially identical to a polypeptide listed in Table 24.

In another aspect, the invention features a cell from a non-human mammal having a mutation in a nucleic acid molecule encoding a GPCR polypeptide substantially identical to a polypeptide listed in Table 24.

In another aspect, the invention features a method of preventing or treating a disease of the prostate including introducing into a human an expression vector that includes a nucleic acid molecule encoding a GPCR polypeptide substantially identical to a polypeptide listed in Tables 25 and 33, operably linked to a promoter.

In still another aspect, the invention features a method of treating or preventing a disease of the prostate including administering to an animal (e.g., a human) a compound that modulates the biological activity of a GPCR polypeptide substantially identical to a polypeptide listed in Tables 25 and 33.

In yet another aspect, the invention features a method for determining whether a candidate compound is a compound that may be useful for the treatment of a disease or disorder of the prostate. This method includes the steps of (a) providing a GPCR polypeptide substantially identical to a polypeptide listed in Tables 25 and 33; (b) contacting the GPCR polypeptide with the candidate compound; and (c) measuring biological activity of the GPCR polypeptide, wherein altered biological activity, relative to that of the GPCR polypeptide not contacted with the compound, indicates that the candidate compound may be useful for the treatment of a disease or disorder of the prostate. The GPCR polypeptide can be in a cell or in a cell-free assay system.

In yet another aspect, the invention features a method for determining whether a candidate compound is a compound that may be useful for the treatment of a disease or disorder of the prostate. This method includes the steps of (a) providing a transgenic non-human mammal (e.g., a knock-out mouse) having a disruption in a nucleic acid molecule encoding a GPCR polypeptide substantially identical to a polypeptide listed in Tables 25 and 33; (b) contacting the transgenic non-human mammal with the candidate compound; and (c) measuring biological activity of the transgenic non-human mammal, wherein altered biological activity, relative to that of the transgenic non-human mammal not contacted with the compound, indicates that the candidate compound may be useful for the treatment of a disease or disorder of the prostate.

In yet another aspect, the invention features a method for determining whether a candidate compound is a compound that may be useful for the treatment of a blood disease or disorder of the prostate. This method includes the steps of (a) providing a transgenic non-human mammal (e.g., a mouse) overexpressing a nucleic acid molecule encoding a GPCR polypeptide substantially identical to a polypeptide listed in Tables 25 and 33; (b) contacting the transgenic non-human mammal with the candidate compound; and (c) measuring biological activity of the GPCR polypeptide in the transgenic non-human mammal, wherein altered biological activity, relative to that of the transgenic non-human mammal not contacted with the compound, indicates that the candidate compound may be useful for the treatment of a disease or disorder of the prostate.

In still another aspect, the invention features another method for determining whether a candidate compound may be useful for the treatment of a disease or disorder of the prostate. This method includes (a) providing a nucleic acid molecule comprising a promoter from a gene encoding a GPCR polypeptide listed in Tables 25 and 33, the promoter operably linked to a reporter system; (b) contacting the nucleic acid molecule with the candidate compound; and (c) measuring reporter activity, wherein altered reporter activity, relative to a nucleic acid molecule not contacted with the compound, indicates that the candidate compound may be useful for the treatment of a disease or disorder of the prostate.

In another aspect, the invention features yet another method for determining whether a candidate compound may be useful for the treatment of a disease or disorder of the prostate. This method includes the steps of: (a) providing a GPCR polypeptide substantially identical to a polypeptide listed in Tables 25 and 33; (b) contacting the polypeptide with the candidate compound; and (c) measuring interaction of the candidate compound to the polypeptide. Interaction of the compound to the polypeptide indicates that the candidate compound may be useful for the treatment of a disease or disorder of the prostate.

In still another aspect, the invention features another method for determining whether a candidate compound may be useful for the treatment of a disease or disorder of the prostate. This method includes (a) providing a GPCR polypeptide substantially identical to a polypeptide listed in Tables 25 and 33; (b) contacting the polypeptide with the candidate compound; and (c) measuring the half-life of the polypeptide, wherein an alteration in the half-life of the polypeptide, relative to that of the polypeptide not contacted with the compound, indicates that the candidate compound may be useful for the treatment of a disease or disorder of the prostate. Preferably the GPCR polypeptide is in a cell or a cell free assay system.

In another aspect, the invention features a method for determining whether a patient has an increased risk for developing a disease or disorder of the prostate. The method includes the step of determining whether the patient has a mutation in a gene encoding a polypeptide listed in Tables 25 and 33, wherein presence of the mutation indicates that the patient may have an increased risk for developing a disease or disorder of the prostate.

In a related aspect, the invention features another method for determining whether a patient has an increased risk for developing a disease or disorder of the prostate. This method includes the step of determining whether the patient has a polymorphism in a gene encoding a polypeptide listed in Tables 25 and 33, wherein presence of the polymorphism indicates that the patient may have an increased risk for developing a disease or disorder of the prostate.

In either of these two methods, the mutation or polymorphism is preferably associated with an alteration (for example, a decrease) in the biological activity of the polypeptide.

In another aspect, the invention features another method for determining whether a patient has an increased risk for developing a disease or disorder of the prostate. The method includes measuring biological activity of a GPCR polypeptide from the patient that is substantially identical to a polypeptide listed in Tables 25 and 33, wherein increased or decreased levels in the GPCR biological activity, relative to normal levels, indicate that the patient may have an increased risk for developing a disease or disorder of the prostate.

In still another aspect, the invention features yet another method for determining whether a patient has an increased risk for developing a disease or disorder of the prostate. The method includes the step of measuring the patient's expression levels of a polypeptide listed in Tables 25 and 33, wherein altered levels in the expression, relative to normal, indicate that the patient has an increased risk for developing a disease or disorder of the prostate. Preferably, the expression levels are determined by measuring levels of polypeptide or mRNA.

In another aspect, the invention features a non-human mammal (e.g., a mouse), having a transgene that includes a nucleic acid molecule encoding a GPCR polypeptide substantially identical to a polypeptide listed in Table 25.

In yet another aspect, the invention features a non-human mammal (e.g., a mouse), having a mutation in a nucleic acid molecule encoding a GPCR polypeptide substantially identical to a polypeptide listed in Table 25.

In a related aspect, the invention features a cell from a non-human mammal having a transgene that includes a nucleic acid molecule encoding a GPCR polypeptide substantially identical to a polypeptide listed in Table 25.

In another aspect, the invention features a cell from a non-human mammal having a mutation in a nucleic acid molecule encoding a GPCR polypeptide substantially identical to a polypeptide listed in Table 25.

In another aspect, the invention features a method of preventing or treating skin disease, including introducing into a human an expression vector that includes a nucleic acid molecule encoding a GPCR polypeptide substantially identical to a polypeptide listed in Tables 26 and 33, operably linked to a promoter.

In still another aspect, the invention features a method of treating or preventing skin disease, including administering to an animal (e.g., a human) a compound that modulates the biological activity of a GPCR polypeptide substantially identical to a polypeptide listed in Tables 26 and 33.

In yet another aspect, the invention features a method for determining whether a candidate compound is a compound that may be useful for the treatment of a skin disease or disorder. This method includes the steps of (a) providing a GPCR polypeptide substantially identical to a polypeptide listed in Tables 26 and 33; (b) contacting the GPCR polypeptide with the candidate compound; and (c) measuring biological activity of the GPCR polypeptide, wherein altered biological activity, relative to that of the GPCR polypeptide not contacted with the compound, indicates that the candidate compound may be useful for the treatment of a skin disease or disorder. The GPCR polypeptide can be in a cell or in a cell-free assay system.

In yet another aspect, the invention features a method for determining whether a candidate compound is a-compound that may be useful for the treatment of a skin disease or disorder. This method includes the steps of (a) providing a transgenic non-human mammal (e.g., a knock-out mouse) having a disruption in a nucleic acid molecule encoding a GPCR polypeptide substantially identical to a polypeptide listed in Tables 26 and 33; (b) contacting the transgenic non-human mammal with the candidate compound; and (c) measuring biological activity of the GPCR polypeptide in the transgenic non-human mammal, wherein altered biological activity, relative to that of the transgenic non-human mammal not contacted with the compound, indicates that the candidate compound may be useful for the treatment of a skin disease or disorder.

In yet another aspect, the invention features a method for determining whether a candidate compound is a compound that may be useful for the treatment of a skin disease or disorder. This method includes the steps of (a) providing a transgenic non-human mammal (e.g., a mouse) overexpressing a nucleic acid molecule encoding a GPCR polypeptide substantially identical to a polypeptide listed in Tables 26 and 33; (b) contacting the transgenic non-human mammal with the candidate compound; and (c) measuring biological activity of the GPCR polypeptide in the transgenic non-human mammal, wherein altered biological activity, relative to that of the transgenic non-human mammal not contacted with the compound, indicates that the candidate compound may be useful for the treatment of a disease skin disease or disorder.

In still another aspect, the invention features another method for determining whether a candidate compound may be useful for the treatment of a skin disease or disorder. This method includes (a) providing a nucleic acid molecule comprising a promoter from a gene encoding a GPCR polypeptide listed in Tables 26 and 33, the promoter operably linked to a reporter system; (b) contacting the nucleic acid molecule with the candidate compound; and (c) measuring reporter activity, wherein altered reporter activity, relative to a nucleic acid molecule not contacted with the compound, indicates that the candidate compound may be useful for the treatment of a skin disease or disorder.

In another aspect, the invention features yet another method for determining whether a candidate compound may be useful for the treatment of a skin disease or disorder. This method includes the steps of: (a) providing a GPCR polypeptide substantially identical to a polypeptide listed in Tables 26 and 33; (b) contacting the polypeptide with the candidate compound; and (c) measuring interaction of the candidate compound to the polypeptide. Interaction of the compound to the polypeptide indicates that the candidate compound may be useful for the treatment of a skin disease or disorder.

In still another aspect, the invention features another method for determining whether a candidate compound may be useful for the treatment of a skin disease or disorder. This method includes (a) providing a GPCR polypeptide substantially identical to a polypeptide listed in Tables 26 and 33; (b) contacting the polypeptide with the candidate compound; and (c) measuring the half-life of the polypeptide, wherein an alteration in the half-life of the polypeptide, relative to that of the polypeptide not contacted with the compound, indicates that the candidate compound may be useful for the treatment of a skin disease or disorder. Preferably the GPCR polypeptide is in a cell or a cell free assay system.

In another aspect, the invention features a method for determining whether a patient has an increased risk for developing a skin disease or disorder. The method includes the step of determining whether the patient has a mutation in a gene encoding a polypeptide listed in Tables 26 and 33, wherein presence of the mutation indicates that the patient may have an increased risk for developing a skin disease or disorder.

In a related aspect, the invention features another method for determining whether a patient has an increased risk for developing a skin disease or disorder. This method includes the step of determining whether the patient has a polymorphism in a gene encoding a polypeptide listed in Tables 26 and 33, wherein presence of the polymorphism indicates that the patient may have an increased risk for developing a skin disease or disorder.

In either of these two methods, the mutation or polymorphism is preferably associated with an alteration (for example, a decrease) in the biological activity of the polypeptide.

In another aspect, the invention features another method for determining whether a patient has an increased risk for developing a skin disease or disorder. The method includes measuring biological activity of a GPCR polypeptide from the patient that is substantially identical to a polypeptide listed in Tables 26 and 33, wherein increased or decreased levels in the GPCR biological activity, relative to normal levels, indicate that the patient may have an increased risk for developing a skin disease or disorder.

In still another aspect, the invention features yet another method for determining whether a patient has an increased risk for developing a skin disease or disorder. The method includes the step of measuring the patient's expression levels of a polypeptide listed in Tables 26 and 33, wherein altered levels in the expression, relative to normal, indicate that the patient has an increased risk for developing a skin disease or disorder. Preferably, the expression levels are determined by measuring levels of polypeptide or mRNA.

In another aspect, the invention features a non-human mammal (e.g., a mouse), having a transgene that includes a nucleic acid molecule encoding a GPCR polypeptide substantially identical to a polypeptide listed in Table 26.

In yet another aspect, the invention features a non-human mammal (e.g., a mouse), having a mutation in a nucleic acid molecule encoding a GPCR polypeptide substantially identical to a polypeptide listed in Table 26.

In a related aspect, the invention features a cell from a non-human mammal having a transgene that includes a nucleic acid molecule encoding a GPCR polypeptide substantially identical to a polypeptide listed in Table 26.

In another aspect, the invention features a cell from a non-human mammal having a mutation in a nucleic acid molecule encoding a GPCR polypeptide substantially identical to a polypeptide listed in Table 26.

In another aspect, the invention features a method of preventing or treating a disease of the spleen including introducing into a human an expression vector that includes a nucleic acid molecule encoding a GPCR polypeptide substantially identical to a polypeptide listed in Tables 27 and 33, operably linked to a promoter.

In still another aspect, the invention features a method of treating or preventing a disease of the spleen including administering to an animal (e.g., a human) a compound that modulates the biological activity of a GPCR polypeptide substantially identical to a polypeptide listed in Tables 27 and 33.

In yet another aspect, the invention features a method for determining whether a candidate compound is a compound that may be useful for the treatment of a disease or disorder of the spleen. This method includes the steps of (a) providing a GPCR polypeptide substantially identical to a polypeptide listed in Tables 27 and 33; (b) contacting the GPCR polypeptide with the candidate compound; and (c) measuring biological activity of the GPCR polypeptide, wherein altered biological activity, relative to that of the GPCR polypeptide not contacted with the compound, indicates that the candidate compound may be useful for the treatment of a disease or disorder of the spleen. The GPCR polypeptide can be in a cell or in a cell-free assay system.

In yet another aspect, the invention features a method for determining whether a candidate compound is a compound that may be useful for the treatment of a disease or disorder of the spleen. This method includes the steps of (a) providing a transgenic non-human mammal (e.g., a knock-out mouse) having a disruption in a nucleic acid molecule encoding a GPCR polypeptide substantially identical to a polypeptide listed in Tables 27 and 33; (b) contacting the transgenic non-human mammal with the candidate compound; and (c) measuring biological activity of the GPCR polypeptide in the transgenic non-human mammal, wherein altered biological activity, relative to that of the transgenic non-human mammal not contacted with the compound, indicates that the candidate compound may be useful for the treatment of a disease or disorder of the spleen.

In yet another aspect, the invention features a method for determining whether a candidate compound is a compound that may be useful for the treatment of a disease or disorder of the spleen. This method includes the steps of (a) providing a transgenic non-human mammal (e.g., a mouse) overexpressing a nucleic acid molecule encoding a GPCR polypeptide substantially identical to a polypeptide listed in Tables 27 and 33; (b) contacting the transgenic non-human mammal with the candidate compound; and (c) measuring biological activity of the GPCR polypeptide in the transgenic non-human mammal, wherein altered biological activity, relative to that of the transgenic non-human mammal not contacted with the compound, indicates that the candidate compound may be useful for the treatment of a disease disease or disorder of the spleen.

In still another aspect, the invention features another method for determining whether a candidate compound may be useful for the treatment of a disease or disorder of the spleen. This method includes (a) providing a nucleic acid molecule comprising a promoter from a gene encoding a GPCR polypeptide listed in Tables 27 and 33, the promoter operably linked to a reporter system; (b) contacting the nucleic acid molecule with the candidate compound; and (c) measuring reporter activity, wherein altered reporter activity, relative to a nucleic acid molecule not contacted with the compound, indicates that the candidate compound may be useful for the treatment of a disease or disorder of the spleen.

In another aspect, the invention features yet another method for determining whether a candidate compound may be useful for the treatment of a disease or disorder of the spleen. This method includes the steps of: (a) providing a GPCR polypeptide substantially identical to a polypeptide listed in Tables 27 and 33; (b) contacting the polypeptide with the candidate compound; and (c) measuring interaction of the candidate compound to the polypeptide. Interaction of the compound to the polypeptide indicates that the candidate compound may be useful for the treatment of a disease or disorder of the spleen.

In still another aspect, the invention features another method for determining whether a candidate compound may be useful for the treatment of a disease or disorder of the spleen. This method includes (a) providing a GPCR polypeptide substantially identical to a polypeptide listed in Tables 27 and 33; (b) contacting the polypeptide with the candidate compound; and (c) measuring the half-life of the polypeptide, wherein an alteration in the half-life of the polypeptide, relative to that of the polypeptide not contacted with the compound, indicates that the candidate compound may be useful for the treatment of a disease or disorder of the spleen. Preferably the GPCR polypeptide is in a cell or a cell free assay system.

In another aspect, the invention features a method for determining whether a patient has an increased risk for developing a disease or disorder of the spleen. The method includes the step of determining whether the patient has a mutation in a gene encoding a polypeptide listed in Tables 27 and 33, wherein presence of the mutation indicates that the patient may have an increased risk for developing a disease or disorder of the spleen.

In a related aspect, the invention features another method for determining whether a patient has an increased risk for developing a disease or disorder of the spleen. This method includes the step of determining whether the patient has a polymorphism in a gene encoding a polypeptide listed in Tables 27 and 33, wherein presence of the polymorphism indicates that the patient may have an increased risk for developing a disease or disorder of the spleen.

In either of these two methods, the mutation or polymorphism is preferably associated with an alteration (for example, a decrease) in the biological activity of the polypeptide.

In another aspect, the invention features another method for determining whether a patient has an increased risk for developing a disease or disorder of the spleen. The method includes measuring biological activity of a GPCR polypeptide from the patient that is substantially identical to a polypeptide listed in Tables 27 and 33, wherein increased or decreased levels in the GPCR biological activity, relative to normal levels, indicate that the patient may have an increased risk for developing a disease or disorder of the spleen.

In still another aspect, the invention features yet another method for determining whether a patient has an increased risk for developing a disease or disorder of the spleen. The method includes the step of measuring the patient's expression levels of a polypeptide listed in Tables 27 and 33, wherein altered levels in the expression, relative to normal, indicate that the patient has an increased risk for developing a disease or disorder of the spleen. Preferably, the expression levels are determined by measuring levels of polypeptide or mRNA.

In another aspect, the invention features a non-human mammal (e.g., a mouse), having a transgene that includes a nucleic acid molecule encoding a GPCR polypeptide substantially identical to a polypeptide listed in Table 27.

In yet another aspect, the invention features a non-human mammal (e.g., a mouse), having a mutation in a nucleic acid molecule encoding a GPCR polypeptide substantially identical to a polypeptide listed in Table 27.

In a related aspect, the invention features a cell from a non-human mammal having a transgene that includes a nucleic acid molecule encoding a GPCR polypeptide substantially identical to a polypeptide listed in Table 27.

In another aspect, the invention features a cell from a non-human mammal having a mutation in a nucleic acid molecule encoding a GPCR polypeptide substantially identical to a polypeptide listed in Table 27.

In another aspect, the invention features a method of preventing or treating a disease of the stomach including introducing into a human an expression vector that includes a nucleic acid molecule encoding a GPCR polypeptide substantially identical to a polypeptide listed in Tables 28 and 33, operably linked to a promoter.

In still another aspect, the invention features a method of treating or preventing a disease of the stomach including administering to an animal (e.g., a human) a compound that modulates the biological activity of a GPCR polypeptide substantially identical to a polypeptide listed in Tables 28 and 33.

In yet another aspect, the invention features a method for determining whether a candidate compound is a compound that may be useful for the treatment of a disease or disorder of the stomach. This method includes the steps of (a) providing a GPCR polypeptide substantially identical to a polypeptide listed in Tables 28 and 33; (b) contacting the GPCR polypeptide with the candidate compound; and (c) measuring biological activity of the GPCR polypeptide, wherein altered biological activity, relative to that of the GPCR polypeptide not contacted with the compound, indicates that the candidate compound may be useful for the treatment of a disease or disorder of the stomach. The GPCR polypeptide can be in a cell or in a cell-free assay system.

In yet another aspect, the invention features a method for determining whether a candidate compound is a compound that may be useful for the treatment of a disease or disorder of the stomach. This method includes the steps of (a) providing a transgenic non-human mammal (e.g., a knock-out mouse) having a disruption in a nucleic acid molecule encoding a GPCR polypeptide substantially identical to a polypeptide listed in Tables 28 and 33; (b) contacting the transgenic non-human mammal with the candidate compound; and (c) measuring biological activity of the GPCR polypeptide in the transgenic non-human mammal, wherein altered biological activity, relative to that of the transgenic non-human mammal not contacted with the compound, indicates that the candidate compound may be useful for the treatment of a disease or disorder of the stomach.

In yet another aspect, the invention features a method for determining whether a candidate compound is a compound that may be useful for the treatment of a disease or disorder of the stomach. This method includes the steps of (a) providing a transgenic non-human mammal (e.g., a mouse) overexpressing a nucleic acid molecule encoding a GPCR polypeptide substantially identical to a polypeptide listed in Tables 28 and 33; (b) contacting the transgenic non-human mammal with the candidate compound; and (c) measuring biological activity of the GPCR polypeptide in the transgenic non-human mammal, wherein altered biological activity, relative to that of the transgenic non-human mammal not contacted with the compound, indicates that the candidate compound may be useful for the treatment of a disease disease or disorder of the stomach.

In still another aspect, the invention features another method for determining whether a candidate compound may be useful for the treatment of a disease or disorder of the stomach. This method includes (a) providing a nucleic acid molecule comprising a promoter from a gene encoding a GPCR polypeptide listed in Tables 28 and 33, the promoter operably linked to a reporter system; (b) contacting the nucleic acid molecule with the candidate compound; and (c) measuring reporter activity, wherein altered reporter activity, relative to a nucleic acid molecule not contacted with the compound, indicates that the candidate compound may be useful for the treatment of a disease or disorder of the stomach.

In another aspect, the invention features yet another method for determining whether a candidate compound may be useful for the treatment of a disease or disorder of the stomach. This method includes the steps of: (a) providing a GPCR polypeptide substantially identical to a polypeptide listed in Tables 28 and 33; (b) contacting the polypeptide with the candidate compound; and (c) measuring interaction of the candidate compound to the polypeptide. Interaction of the compound to the polypeptide indicates that the candidate compound may be useful for the treatment of a disease or disorder of the stomach.

In still another aspect, the invention features another method for determining whether a candidate compound may be useful for the treatment of a disease or disorder of the stomach. This method includes (a) providing a GPCR polypeptide substantially identical to a polypeptide listed in Tables 28 and 33; (b) contacting the polypeptide with the candidate compound; and (c) measuring the half-life of the polypeptide, wherein an alteration in the half-life of the polypeptide, relative to that of the polypeptide not contacted with the compound, indicates that the candidate compound may be useful for the treatment of a disease or disorder of the stomach. Preferably the GPCR polypeptide is in a cell or a cell free assay system.

In another aspect, the invention features a method for determining whether a patient has an increased risk for developing a disease or disorder of the stomach. The method includes the step of determining whether the patient has a mutation in a gene encoding a polypeptide listed in Tables 28 and 33, wherein presence of the mutation indicates that the patient may have an increased risk for developing a disease or disorder of the stomach.

In a related aspect, the invention features another method for determining whether a patient has an increased risk for developing a disease or disorder of the stomach. This method includes the step of determining whether the patient has a polymorphism in a gene encoding a polypeptide listed in Tables 28 and 33, wherein presence of the polymorphism indicates that the patient may have an increased risk for developing a disease or disorder of the stomach.

In either of these two methods, the mutation or polymorphism is preferably associated with an alteration (for example, a decrease) in the biological activity of the polypeptide.

In another aspect, the invention features another method for determining whether a patient has an increased risk for developing a disease or disorder of the stomach. The method includes measuring biological activity of a GPCR polypeptide from the patient that is substantially identical to a polypeptide listed in Tables 28 and 33, wherein increased or decreased levels in the GPCR biological activity, relative to normal levels, indicate that the patient may have an increased risk for developing a disease or disorder of the stomach.

In still another aspect, the invention features yet another method for determining whether a patient has an increased risk for developing a disease or disorder of the stomach. The method includes the step of measuring the patient's expression levels of a polypeptide listed in Tables 28 and 33, wherein altered levels in the expression, relative to normal, indicate that the patient has an increased risk for developing a disease or disorder of the stomach. Preferably, the expression levels are determined by measuring levels of polypeptide or mRNA.

In another aspect, the invention features a non-human mammal (e.g., a mouse), having a transgene that includes a nucleic acid molecule encoding a GPCR polypeptide substantially identical to a polypeptide listed in Table 28.

In yet another aspect, the invention features a non-human mammal (e.g., a mouse), having a mutation in a nucleic acid molecule encoding a GPCR polypeptide substantially identical to a polypeptide listed in Table 28.

In a related aspect, the invention features a cell from a non-human mammal having a transgene that includes a nucleic acid molecule encoding a GPCR polypeptide substantially identical to a polypeptide listed in Table 28.

In another aspect, the invention features a cell from a non-human mammal having a mutation in a nucleic acid molecule encoding a GPCR polypeptide substantially identical to a polypeptide listed in Table 28.

In another aspect, the invention features a method of preventing or treating a disease of the testes including introducing into a human an expression vector that includes a nucleic acid molecule encoding a GPCR polypeptide substantially identical to a polypeptide listed in Tables 29 and 33, operably linked to a promoter.

In still another aspect, the invention features a method of treating or preventing a disease of the testes including administering to an animal (e.g., a human) a compound that modulates the biological activity of a GPCR polypeptide substantially identical to a polypeptide listed in Tables 29 and 33.

In yet another aspect, the invention features a method for determining whether a candidate compound is a compound that may be useful for the treatment of a disease or disorder of the testes. This method includes the steps of (a) providing a GPCR polypeptide substantially identical to a polypeptide listed in Tables 29 and 33; (b) contacting the GPCR polypeptide with the candidate compound; and (c) measuring biological activity of the GPCR polypeptide, wherein altered biological activity, relative to that of the GPCR polypeptide not contacted with the compound, indicates that the candidate compound may be useful for the treatment of a disease or disorder of the testes. The GPCR polypeptide can be in a cell or in a cell-free assay system.

In yet another aspect, the invention features a method for determining whether a candidate compound is a compound that may be useful for the treatment of a disease or disorder of the testes. This method includes the steps of (a) providing a transgenic non-human mammal (e.g., a knock-out mouse) having a disruption in a nucleic acid molecule encoding a GPCR polypeptide substantially identical to a polypeptide listed in Tables 29 and 33; (b) contacting the transgenic non-human mammal with the candidate compound; and (c) measuring biological activity of the GPCR polypeptide-in the transgenic non-human mammal, wherein altered biological activity, relative to that of the transgenic non-human mammal not contacted with the compound, indicates that the candidate compound may be useful for the treatment of a disease or disorder of the testes.

In yet another aspect, the invention features a method for determining whether a candidate compound is a compound that may be useful for the treatment of a disease or disorder of the testes. This method includes the steps of (a) providing a transgenic non-human mammal (e.g., a mouse) overexpressing a nucleic acid molecule encoding a GPCR polypeptide substantially identical to a polypeptide listed in Tables 29 and 33; (b) contacting the transgenic non-human mammal with the candidate compound; and (c) measuring biological activity of the GPCR polypeptide in the transgenic non-human mammal, wherein altered biological activity, relative to that of the transgenic non-human mammal not contacted with the compound, indicates that the candidate compound may be useful for the treatment of a disease disease or disorder of the testes.

In still another aspect, the invention features another method for determining whether a candidate compound may be useful for the treatment of a disease or disorder of the testes. This method includes (a) providing a nucleic acid molecule comprising a promoter from a gene encoding a GPCR polypeptide listed in Tables 29 and 33, the promoter operably linked to a reporter system; (b) contacting the nucleic acid molecule with the candidate compound; and (c) measuring reporter activity, wherein altered reporter activity, relative to a nucleic acid molecule not contacted with the compound, indicates that the candidate compound may be useful for the treatment of a disease or disorder of the testes.

In another aspect, the invention features yet another method for determining whether a candidate compound may be useful for the treatment of a disease or disorder of the testes. This method includes the steps of: (a) providing a GPCR polypeptide substantially identical to a polypeptide listed in Tables 29 and 33; (b) contacting the polypeptide with the candidate compound; and (c) measuring interaction of the candidate compound to the polypeptide. Interaction of the compound to the polypeptide indicates that the candidate compound may be useful for the treatment of a disease or disorder of the testes.

In still another aspect, the invention features another method for determining whether a candidate compound may be useful for the treatment of a disease or disorder of the testes. This method includes (a) providing a GPCR polypeptide substantially identical to a polypeptide listed in Tables 29 and 33; (b) contacting the polypeptide with the candidate compound; and (c) measuring the half-life of the polypeptide, wherein an alteration in the half-life of the polypeptide, relative to that of the polypeptide not contacted with the compound, indicates that the candidate compound may be useful for the treatment of a disease or disorder of the testes. Preferably the GPCR polypeptide is in a cell or a cell free assay system.

In another aspect, the invention features a method for determining whether a patient has an increased risk for developing a disease or disorder of the testes. The method includes the step of determining whether the patient has a mutation in a gene encoding a polypeptide listed in Tables 29 and 33, wherein presence of the mutation indicates that the patient may have an increased risk for developing a disease or disorder of the testes.

In a related aspect, the invention features another method for determining whether a patient has an increased risk for developing a disease or disorder of the testes. This method includes the step of determining whether the patient has a polymorphism in a gene encoding a polypeptide listed in Tables 29 and 33, wherein presence of the polymorphism indicates that the patient may have an increased risk for developing a disease or disorder of the testes.

In either of these two methods, the mutation or polymorphism is preferably associated with an alteration (for example, a decrease) in the biological activity of the polypeptide.

In another aspect, the invention features another method for determining whether a patient has an increased risk for developing a disease or disorder of the testes. The method includes measuring biological activity of a GPCR polypeptide from the patient that is substantially identical to a polypeptide listed in Tables 29 and 33, wherein increased or decreased levels in the GPCR biological activity, relative to normal levels, indicate that the patient may have an increased risk for developing a disease or disorder of the testes.

In still another aspect, the invention features yet another method for determining whether a patient has an increased risk for developing a disease or disorder of the testes. The method includes the step of measuring the patient's expression levels of a polypeptide listed in Tables 29 and 33, wherein altered levels in the expression, relative to normal, indicate that the patient has an increased risk for developing a disease or disorder of the testes. Preferably, the expression levels are determined by measuring levels of polypeptide or mRNA.

In another aspect, the invention features a non-human mammal (e.g., a mouse), having a transgene that includes a nucleic acid molecule encoding a GPCR polypeptide substantially identical to a polypeptide listed in Table 29.

In yet another aspect, the invention features a non-human mammal (e.g., a mouse), having a mutation in a nucleic acid molecule encoding a GPCR polypeptide substantially identical to a polypeptide listed in Table 29.

In a related aspect, the invention features a cell from a non-human mammal having a transgene that includes a nucleic acid molecule encoding a GPCR polypeptide substantially identical to a polypeptide listed in Table 29.

In another aspect, the invention features a cell from a non-human mammal having a mutation in a nucleic acid molecule encoding a GPCR polypeptide substantially identical to a polypeptide listed in Table 29.

In another aspect, the invention features a method of preventing or treating a disease of the thymus including introducing into a human an expression vector that includes a nucleic acid molecule encoding a GPCR polypeptide substantially identical to a polypeptide listed in Tables 30 and 33, operably linked to a promoter.

In still another aspect, the invention features a method of treating or preventing a disease of the thymus including administering to an animal (e.g., a human) a compound that modulates the biological activity of a GPCR polypeptide substantially identical to a polypeptide listed in Tables 30 and 33.

In yet another aspect, the invention features a method for determining whether a candidate compound is a compound that may be useful for the treatment of a disease or disorder of the thymus. This method includes the steps of (a) providing a GPCR polypeptide substantially identical to a polypeptide listed in Tables 30 and 33; (b) contacting the GPCR polypeptide with the candidate compound; and (c) measuring biological activity of the GPCR polypeptide, wherein altered biological activity, relative to that of the GPCR polypeptide not contacted with the compound, indicates that the candidate compound may be useful for the treatment of a disease or disorder of the thymus. The GPCR polypeptide can be in a cell or in a cell-free assay system.

In yet another aspect, the invention features a method for determining whether a candidate compound is a compound that may be useful for the treatment of a disease or disorder of the thymus. This method includes the steps of (a) providing a transgenic non-human mammal (e.g., a knock-out mouse) having a disruption in a nucleic acid molecule encoding a GPCR polypeptide substantially identical to a polypeptide listed in Tables 30 and 33; (b) contacting the transgenic non-human mammal with the candidate compound; and (c) measuring biological activity of the GPCR polypeptide in the transgenic non-human mammal, wherein altered biological activity, relative to that of the transgenic non-human mammal not contacted with the compound, indicates that the candidate compound may be useful for the treatment of a disease or disorder of the thymus.

In yet another aspect, the invention features a method for determining whether a candidate compound is a compound that may be useful for the treatment of a disease or disorder of the thymus. This method includes the steps of (a) providing a transgenic non-human mammal (e.g., a mouse) overexpressing a nucleic acid molecule encoding a GPCR polypeptide substantially identical to a polypeptide listed in Tables 30 and 33; (b) contacting the transgenic non-human mammal with the candidate compound; and (c) measuring biological activity of the GPCR polypeptide in the transgenic non-human mammal, wherein altered biological activity, relative to that of the transgenic non-human mammal not contacted with the compound, indicates that the candidate compound may be useful for the treatment of a disease disease or disorder of the thymus.

In still another aspect, the invention features another method for determining whether a candidate compound may be useful for the treatment of a disease or disorder of the thymus. This method includes (a) providing a nucleic acid molecule comprising a promoter from a gene encoding a GPCR polypeptide listed in Tables 30 and 33, the promoter operably linked to a reporter system; (b) contacting the nucleic acid molecule with the candidate compound; and (c) measuring reporter activity, wherein altered reporter activity, relative to a nucleic acid molecule not contacted with the compound, indicates that the candidate compound may be useful for the treatment of a disease or disorder of the thymus.

In another aspect, the invention features yet another method for determining whether a candidate compound may be useful for the treatment of a disease or disorder of the thymus. This method includes the steps of: (a) providing a GPCR polypeptide substantially identical to a polypeptide listed in Tables 30 and 33; (b) contacting the polypeptide with the candidate compound; and (c) measuring interaction of the candidate compound to the polypeptide. Interaction of the compound to the polypeptide indicates that the candidate compound may be useful for the treatment of a disease or disorder of the thymus.

In still another aspect, the invention features another method for determining whether a candidate compound may be useful for the treatment of a disease or disorder of the thymus. This method includes (a) providing a GPCR polypeptide substantially identical to a polypeptide listed in Tables 30 and 33; (b) contacting the polypeptide with the candidate compound; and (c) measuring the half-life of the polypeptide, wherein an alteration in the half-life of the polypeptide, relative to that of the polypeptide not contacted with the compound, indicates that the candidate compound may be useful for the treatment of a disease or disorder of the thymus. Preferably the GPCR polypeptide is in a cell or a cell free assay system.

In another aspect, the invention features a method for determining whether a patient has an increased risk for developing a disease or disorder of the thymus. The method includes the step of determining whether the patient has a mutation in a gene encoding a polypeptide listed in Tables 30 and 33, wherein presence of the mutation indicates that the patient may have an increased risk for developing a disease or disorder of the thymus.

In a related aspect, the invention features another method for determining whether a patient has an increased risk for developing a disease or disorder of the thymus. This method includes the step of determining whether the patient has a polymorphism in a gene encoding a polypeptide listed in Tables 30 and 33, wherein presence of the polymorphism indicates that the patient may have an increased risk for developing a disease or disorder of the thymus.

In either of these two methods, the mutation or polymorphism is preferably associated with an alteration (for example, a decrease) in the biological activity of the polypeptide.

In another aspect, the invention features another method for determining whether a patient has an increased risk for developing a disease or disorder of the thymus. The method includes measuring biological activity of a GPCR polypeptide from the patient that is substantially identical to a polypeptide listed in Tables 30 and 33, wherein increased or decreased levels in the GPCR biological activity, relative to normal levels, indicate that the patient may have an increased risk for developing a disease or disorder of the thymus.

In still another aspect, the invention features yet another method for determining whether a patient has an increased risk for developing a disease or disorder of the thymus. The method includes the step of measuring the patient's expression levels of a polypeptide listed in Tables 30 and 33, wherein altered levels in the expression, relative to normal, indicate that the patient has an increased risk for developing a disease or disorder of the thymus. Preferably, the expression levels are determined by measuring levels of polypeptide or mRNA.

In another aspect, the invention features a non-human mammal (e.g., a mouse), having a transgene that includes a nucleic acid molecule encoding a GPCR polypeptide substantially identical to a polypeptide listed in Table 30.

In yet another aspect, the invention features a non-human mammal (e.g., a mouse), having a mutation in a nucleic acid molecule encoding a GPCR polypeptide substantially identical to a polypeptide listed in Table 30.

In a related aspect, the invention features a cell from a non-human mammal having a transgene that includes a nucleic acid molecule encoding a GPCR polypeptide substantially identical to a polypeptide listed in Table 30.

In another aspect, the invention features a cell from a non-human mammal having a mutation in a nucleic acid molecule encoding a GPCR polypeptide substantially identical to a polypeptide listed in Table 30.

In another aspect, the invention features a method of preventing or treating a disease of the thyroid including introducing into a human an expression vector that includes a nucleic acid molecule encoding a GPCR polypeptide substantially identical to a polypeptide listed in Tables 31 and 33, operably linked to a promoter.

In still another aspect, the invention features a method of treating or preventing a disease of the thyroid including administering to an animal (e.g., a human) a compound that modulates the biological activity of a GPCR polypeptide substantially identical to a polypeptide listed in Tables 31 and 33.

In yet another aspect, the invention features a method for determining whether a candidate compound is a compound that may be useful for the treatment of a disease or disorder of the thyroid. This method includes the steps of (a) providing a GPCR polypeptide substantially identical to a polypeptide listed in Tables 31 and 33; (b) contacting the GPCR polypeptide with the candidate compound; and (c) measuring biological activity of the GPCR polypeptide, wherein altered biological activity, relative to that of the GPCR polypeptide not contacted with the compound, indicates that the candidate compound may be useful for the treatment of a disease or disorder of the thyroid. The GPCR polypeptide can be in a cell or in a cell-free assay system.

In yet another aspect, the invention features a method for determining whether a candidate compound is a compound that may be useful for the treatment of a disease or disorder of the thyroid. This method includes the steps of (a) providing a transgenic non-human mammal (e.g., a knock-out mouse) having a disruption in a nucleic acid molecule encoding a GPCR polypeptide substantially identical to a polypeptide listed in Tables 31 and 33; (b) contacting the transgenic non-human mammal with the candidate compound; and (c) measuring biological activity of transgenic non-human mammal, wherein altered biological activity, relative to that of the GPCR transgenic non-human mammal not contacted with the compound, indicates that the candidate compound may be useful for the treatment of a disease or disorder of the thyroid.

In yet another aspect, the invention features a method for determining whether a candidate compound is a compound that may be useful for the treatment of a disease or disorder of the thyroid. This method includes the steps of (a) providing a transgenic non-human mammal (e.g., a mouse) overexpressing a nucleic acid molecule encoding a GPCR polypeptide substantially identical to a polypeptide listed in Tables 31 and 33; (b) contacting the transgenic non-human mammal with the candidate compound; and (c) measuring biological activity of the GPCR polypeptide in the transgenic non-human mammal, wherein altered biological activity, relative to that of the transgenic non-human mammal not contacted with the compound, indicates that the candidate compound may be useful for the treatment of a disease disease or disorder of the thyroid.

In still another aspect, the invention features another method for determining whether a candidate compound may be useful for the treatment of a disease or disorder of the thyroid. This method includes (a) providing a nucleic acid molecule comprising a promoter from a gene encoding a GPCR polypeptide listed in Tables 31 and 33, the promoter operably linked to a reporter system; (b) contacting the nucleic acid molecule with the candidate compound; and (c) measuring reporter activity, wherein altered reporter activity, relative to a nucleic acid molecule not contacted with the compound, indicates that the candidate compound may be useful for the treatment of a disease or disorder of the thyroid.

In another aspect, the invention features yet another method for determining whether a candidate compound may be useful for the treatment of a disease or disorder of the thyroid. This method includes the steps of: (a) providing a GPCR polypeptide substantially identical to a polypeptide listed in Tables 31 and 33; (b) contacting the polypeptide with the candidate compound; and (c) measuring interaction of the candidate compound to the polypeptide. Interaction of the compound to the polypeptide indicates that the candidate compound may be useful for the treatment of a disease or disorder of the thyroid.

In still another aspect, the invention features another method for determining whether a candidate compound may be useful for the treatment of a disease or disorder of the thyroid. This method includes (a) providing a GPCR polypeptide substantially identical to a polypeptide listed in Tables 31 and 33; (b) contacting the polypeptide with the candidate compound; and (c) measuring the half-life of the polypeptide, wherein an alteration in the half-life of the polypeptide, relative to that of the polypeptide not contacted with the compound, indicates that the candidate compound may be useful for the treatment of a disease or disorder of the thyroid. Preferably the GPCR polypeptide is in a cell or a cell free assay system.

In another aspect, the invention features a method for determining whether a patient has an increased risk for developing a disease or disorder of the thyroid. The method includes the step of determining whether the patient has a mutation in a gene encoding a polypeptide listed in Tables 31 and 33, wherein presence of the mutation indicates that the patient may have an increased risk for developing a disease or disorder of the thyroid.

In a related aspect, the invention features another method for determining whether a patient has an increased risk for developing a disease or disorder of the thyroid. This method includes the step of determining whether the patient has a polymorphism in a gene encoding a polypeptide listed in Tables 31 and 33, wherein presence of the polymorphism indicates that the patient may have an increased risk for developing a disease or disorder of the thyroid.

In either of these two methods, the mutation or polymorphism is preferably associated with an alteration (for example, a decrease) in the biological activity of the polypeptide.

In another aspect, the invention features another method for determining whether a patient has an increased risk for developing a disease or disorder of the thyroid. The method includes measuring biological activity of a GPCR polypeptide from the patient that is substantially identical to a polypeptide listed in Tables 31 and 33, wherein increased or decreased levels in the GPCR biological activity, relative to normal levels, indicate that the patient may have an increased risk for developing a disease or disorder of the thyroid.

In still another aspect, the invention features yet another method for determining whether a patient has an increased risk for developing a disease or disorder of the thyroid. The method includes the step of measuring the patient's expression levels of a polypeptide listed in Tables 31 and 33, wherein altered levels in the expression, relative to normal, indicate that the patient has an increased risk for developing a disease or disorder of the thyroid. Preferably, the expression levels are determined by measuring levels of polypeptide or mRNA.

In another aspect, the invention features a non-human mammal (e.g., a mouse), having a transgene that includes a nucleic acid molecule encoding a GPCR polypeptide substantially identical to a polypeptide listed in Table 31.

In yet another aspect, the invention features a non-human mammal (e.g., a mouse), having a mutation in a nucleic acid molecule encoding a GPCR polypeptide substantially identical to a polypeptide listed in Table 31.

In a related aspect, the invention features a cell from a non-human mammal having a transgene that includes a nucleic acid molecule encoding a GPCR polypeptide substantially identical to a polypeptide listed in Table 31.

In another aspect, the invention features a cell from a non-human mammal having a mutation in a nucleic acid molecule encoding a GPCR polypeptide substantially identical to a polypeptide listed in Table 31.

In another aspect, the invention features a method of preventing or treating a disease of the uterus including introducing into a human an expression vector that includes a nucleic acid molecule encoding a GPCR polypeptide substantially identical to a polypeptide listed in Tables 32 and 33, operably linked to a promoter.

In still another aspect, the invention features a method of treating or preventing a disease of the uterus including administering to an animal (e.g., a human) a compound that modulates the biological activity of a GPCR polypeptide substantially identical to a polypeptide listed in Tables 32 and 33.

In yet another aspect, the invention features a method for determining whether a candidate compound is a compound that may be useful for the treatment of a disease or disorder of the uterus. This method includes the steps of (a) providing a GPCR polypeptide substantially identical to a polypeptide listed in Tables 32 and 33; (b) contacting the GPCR polypeptide with the candidate compound; and (c) measuring biological activity of the GPCR polypeptide, wherein altered biological activity, relative to that of the GPCR polypeptide not contacted with the compound, indicates that the candidate compound may be useful for the treatment of a disease or disorder of the uterus. The GPCR polypeptide can be in a cell or in a cell-free assay system.

In yet another aspect, the invention features a method for determining whether a candidate compound is a compound that may be useful for the treatment of a disease or disorder of the uterus. This method includes the steps of (a) providing a transgenic non-human mammal (e.g., a knock-out mouse) having a disruption in a nucleic acid molecule encoding a GPCR polypeptide substantially identical to a polypeptide listed in Tables 32 and 33; (b) contacting transgenic non-human mammal with the candidate compound; and (c) measuring biological activity of the GPCR transgenic non-human mammal, wherein altered biological activity, relative to that of the transgenic non-human mammal not contacted with the compound, indicates that the candidate compound may be useful for the treatment of a disease or disorder of the uterus.

In yet another aspect, the invention features a method for determining whether a candidate compound is a compound that may be useful for the treatment of a disease or disorder of the uterus. This method includes the steps of (a) providing a transgenic non-human mammal (e.g., a mouse) overexpressing a nucleic acid molecule encoding a GPCR polypeptide substantially identical to a polypeptide listed in Tables 32 and 33; (b) contacting the transgenic non-human mammal with the candidate compound; and (c) measuring biological activity of the GPCR polypeptide in the transgenic non-human mammal, wherein altered biological activity, relative to that of the transgenic non-human mammal not contacted with the compound, indicates that the candidate compound may be useful for the treatment of a disease disease or disorder of the uterus.

In still another aspect, the invention features another method for determining whether a candidate compound may be useful for the treatment of a disease or disorder of the uterus. This method includes (a) providing a nucleic acid molecule comprising a promoter from a gene encoding a GPCR polypeptide listed in Tables 32 and 33, the promoter operably linked to a reporter system; (b) contacting the nucleic acid molecule with the candidate compound; and (c) measuring reporter activity, wherein altered reporter activity, relative to a nucleic acid molecule not contacted with the compound, indicates that the candidate compound may be useful for the treatment of a disease or disorder of the uterus.

In another aspect, the invention features yet another method for determining whether a candidate compound may be useful for the treatment of a disease or disorder of the uterus.

This method includes the steps of: (a) providing a GPCR polypeptide substantially identical to a polypeptide listed in Tables 32 and 33; (b) contacting the polypeptide with the candidate compound; and (c) measuring interaction of the candidate compound to the polypeptide. Interaction of the compound to the polypeptide indicates that the candidate compound may be useful for the treatment of a disease or disorder of the uterus.

In still another aspect, the invention features another method for determining whether a candidate compound may be useful for the treatment of a disease or disorder of the uterus. This method includes (a) providing a GPCR polypeptide substantially identical to a polypeptide listed in Tables 32 and 33; (b) contacting the polypeptide with the candidate compound; and (c) measuring the half-life of the polypeptide, wherein an alteration in the half-life of the polypeptide, relative to that of the polypeptide not contacted with the compound, indicates that the candidate compound may be useful for the treatment of a disease or disorder of the uterus. Preferably the GPCR polypeptide is in a cell or a cell free assay system.

In another aspect, the invention features a method for determining whether a patient has an increased risk for developing a disease or disorder of the uterus. The method includes the step of determining whether the patient has a mutation in a gene encoding a polypeptide listed in Tables 32 and 33, wherein presence of the mutation indicates that the patient may have an increased risk for developing a disease or disorder of the uterus.

In a related aspect, the invention features another method for determining whether a patient has an increased risk for developing a disease or disorder of the uterus. This method includes the step of determining whether the patient has a polymorphism in a gene encoding a polypeptide listed in Tables 32 and 33, wherein presence of the polymorphism indicates that the patient may have an increased risk for developing a disease or disorder of the uterus.

In either of these two methods, the mutation or polymorphism is preferably associated with an alteration (for example, a decrease) in the biological activity of the polypeptide.

In another aspect, the invention features another method for determining whether a patient has an increased risk for developing a disease or disorder of the uterus. The method includes measuring biological activity of a GPCR polypeptide from the patient that is substantially identical to a polypeptide listed in Tables 32 and 33, wherein increased or decreased levels in the GPCR biological activity, relative to normal levels, indicate that the patient may have an increased risk for developing a disease or disorder of the uterus.

In still another aspect, the invention features yet another method for determining whether a patient has an increased risk for developing a disease or disorder of the uterus. The method includes the step of measuring the patient's expression levels of a polypeptide listed in Tables 32 and 33, wherein altered levels in the expression, relative to normal, indicate that the patient has an increased risk for developing a disease or disorder of the uterus. Preferably, the expression levels are determined by measuring levels of polypeptide or mRNA.

In another aspect, the invention features a non-human mammal (e.g., a mouse), having a transgene that includes a nucleic acid molecule encoding a GPCR polypeptide substantially identical to a polypeptide listed in Table 32.

In yet another aspect, the invention features a non-human mammal (e.g., a mouse), having a mutation in a nucleic acid molecule encoding a GPCR polypeptide substantially identical to a polypeptide listed in Table 32.

In a related aspect, the invention features a cell from a non-human mammal having a transgene that includes a nucleic acid molecule encoding a GPCR polypeptide substantially identical to a polypeptide listed in Table 32.

In another aspect, the invention features a cell from a non-human mammal having a mutation in a nucleic acid molecule encoding a GPCR polypeptide substantially identical to a polypeptide listed in Table 32.

In another aspect, the invention features a method of preventing or treating a disease of the pancreas including introducing into a human an expression vector that includes a nucleic acid molecule encoding a GPCR polypeptide substantially identical to a polypeptide listed in Table 1 operably linked to a promoter.

In still another aspect, the invention features a method of treating or preventing a disease of the pancreas including administering to an animal (e.g., a human) a compound that modulates the biological activity of a GPCR polypeptide substantially identical to a polypeptide listed in Table 1.

In yet another aspect, the invention features a method for determining whether a candidate compound is a compound that may be useful for the treatment of a disease or disorder of the pancreas. This method includes the steps of (a) providing a GPCR polypeptide substantially identical to a polypeptide listed in Table 1; (b) contacting the GPCR polypeptide with the candidate compound; and (c) measuring biological activity of the GPCR polypeptide, wherein altered biological activity, relative to that of the GPCR polypeptide not contacted with the compound, indicates that the candidate compound may be useful for the treatment of a disease or disorder of the pancreas. The GPCR polypeptide can be in a cell or in a cell-free assay system.

In yet another aspect, the invention features a method for determining whether a candidate compound is a compound that may be useful for the treatment of a disease or disorder of the pancreas. This method includes the steps of (a) providing a transgenic non-human mammal (e.g., a knock-out mouse) having a disruption in a nucleic acid molecule encoding a GPCR polypeptide substantially identical to a polypeptide listed in Table 1; (b) contacting the transgenic non-human mammal with the candidate compound; and (c) measuring biological activity of the GPCR polypeptide in the transgenic non-human mammal, wherein altered biological activity, relative to that of the transgenic non-human mammal not contacted with the compound, indicates that the candidate compound may be useful for the treatment of a disease or disorder of the pancreas.

In yet another aspect, the invention features a method for determining whether a candidate compound is a compound that may be useful for the treatment of a disease or disorder of the pancreas. This method includes the steps of (a) providing a transgenic non-human mammal (e.g., a mouse) overexpressing a nucleic acid molecule encoding a GPCR polypeptide substantially identical to a polypeptide listed in any one of Table 1; (b) contacting the transgenic non-human mammal with the candidate compound; and (c) measuring biological activity of the GPCR polypeptide in the transgenic non-human mammal, wherein altered biological activity, relative to that of the transgenic non-human mammal not contacted with the compound, indicates that the candidate compound may be useful for the treatment of a disease or disorder of the pancreas.

In still another aspect, the invention features another method for determining whether a candidate compound may be useful for the treatment of a disease or disorder of the pancreas. This method includes (a) providing a nucleic acid molecule comprising a promoter from a gene encoding a GPCR polypeptide listed in Table 1, the promoter operably linked to a reporter system; (b) contacting the nucleic acid molecule with the candidate compound; and (c) measuring reporter activity, wherein altered reporter activity, relative to a nucleic acid molecule not contacted with the compound, indicates that the candidate compound may be useful for the treatment of a disease or disorder of the pancreas.

In another aspect, the invention features yet another method for determining whether a candidate compound may be useful for the treatment of a disease or disorder of the pancreas. This method includes the steps of: (a) providing a GPCR polypeptide substantially identical to a polypeptide listed in Table 1; (b) contacting the polypeptide with the candidate compound; and (c) measuring interaction of the candidate compound to the polypeptide. Interaction of the compound to the polypeptide indicates that the candidate compound may be useful for the treatment of a disease or disorder of the pancreas.

In still another aspect, the invention features another method for determining whether a candidate compound may be useful for the treatment of a disease or disorder of the pancreas. This method includes (a) providing a GPCR polypeptide substantially identical to a polypeptide listed in Table 1; (b) contacting the polypeptide with the candidate compound; and (c) measuring the half-life of the polypeptide, wherein an alteration in the half-life of the polypeptide, relative to that of the polypeptide not contacted with the compound, indicates that the candidate compound may be useful for the treatment of a disease or disorder of the pancreas. Preferably the GPCR polypeptide is in a cell or a cell free assay system.

In another aspect, the invention features a method for determining whether a patient has an increased risk for developing a disease or disorder of the pancreas. The method includes the step of determining whether the patient has a mutation in a gene encoding a polypeptide listed in Table 1, wherein presence of the mutation indicates that the patient has an increased risk for developing a disease or disorder of the pancreas.

In a related aspect, the invention features another method for determining whether a patient has an increased risk for developing a disease or disorder of the pancreas. This method includes the step of determining whether the patient has a polymorphism in a gene encoding a polypeptide listed in Table 1, wherein presence of the polymorphism indicates that the patient may have an increased risk for developing a disease or disorder of the pancreas.

In either of these two methods, the mutation or polymorphism is preferably associated with an alteration (for example, a decrease) in the biological activity of the polypeptide.

In another aspect, the invention features another method for determining whether a patient has an increased risk for developing a disease or disorder of the pancreas. The method includes measuring biological activity of a GPCR polypeptide from the patient that is substantially identical to a polypeptide listed in Table 1, wherein increased or decreased levels in the GPCR biological activity, relative to normal levels, indicates that the patient has an increased risk for developing a disease or disorder of the pancreas.

In still another aspect, the invention features yet another method for determining whether a patient has an increased risk for developing a disease or disorder of the pancreas. The method includes the step of measuring the patient's expression levels of a polypeptide listed in Table 1, wherein altered levels in the expression, relative to normal, indicate that the patient has an increased risk for developing a disease or disorder of the pancreas. Preferably, the expression levels are determined by measuring levels of polypeptide or mRNA.

In another aspect, the invention features a non-human mammal (e.g., a mouse), having a transgene that includes a nucleic acid molecule encoding a GPCR polypeptide substantially identical to a polypeptide listed in Table 1.

In yet another aspect, the invention features a non-human mammal (e.g., a mouse), having a mutation in a nucleic acid molecule encoding a GPCR polypeptide substantially identical to a polypeptide listed in Table 1.

In a related aspect, the invention features a cell from a non-human mammal having a transgene that includes a nucleic acid molecule encoding a GPCR polypeptide substantially identical to a polypeptide listed in Table 1.

In another aspect, the invention features a cell from a non-human mammal having a mutation in a nucleic acid molecule encoding a GPCR polypeptide substantially identical to a polypeptide listed in Table 1.

In another aspect, the invention features a method of preventing or treating a disease of the bone and joints including introducing into a human an expression vector that includes a nucleic acid molecule encoding a GPCR polypeptide substantially identical to a polypeptide listed in Table I operably linked to a promoter.

In still another aspect, the invention features a method of treating or preventing a disease of the bone and joints including administering to an animal (e.g., a human) a compound that modulates the biological activity of a GPCR polypeptide substantially identical to a polypeptide listed in Table 1.

In yet another aspect, the invention features a method for determining whether a candidate compound is a compound that may be useful for the treatment of a disease or disorder of the bone and joints. This method includes the steps of (a) providing a GPCR polypeptide substantially identical to a polypeptide listed in Table 1; (b) contacting the GPCR polypeptide with the candidate compound; and (c) measuring biological activity of the GPCR polypeptide, wherein altered biological activity, relative to that of the GPCR polypeptide not contacted with the compound, indicates that the candidate compound may be useful for the treatment of a disease or disorder of the bone and joints. The GPCR polypeptide can be in a cell or in a cell-free assay system.

In yet another aspect, the invention features a method for determining whether a candidate compound is a compound that may be useful for the treatment of a disease or disorder of the bone and joints. This method includes the steps of (a) providing a transgenic non-human mammal (e.g., a knockout mouse) having a disruption in a nucleic acid molecule encoding a GPCR polypeptide substantially identical to a polypeptide listed in Table 1; (b) contacting the transgenic non-human mammal with the candidate compound; and (c) measuring biological activity of the GPCR polypeptide in the transgenic non-human mammal, wherein altered biological activity, relative to that of the transgenic non-human mammal not contacted with the compound, indicates that the candidate compound may be useful for the treatment of a disease or disorder of the bone and joints.

In yet another aspect, the invention features a method for determining whether a candidate compound is a compound that may be useful for the treatment of a disease or disorder of the bone and joints. This method includes the steps of (a) providing a transgenic non-human mammal (e.g., a mouse) overexpressing a nucleic acid molecule encoding a GPCR polypeptide substantially identical to a polypeptide listed in any one of Table 1; (b) contacting the transgenic non-human mammal with the candidate compound; and (c) measuring biological activity of the GPCR polypeptide in the transgenic non-human mammal, wherein altered biological activity, relative to that of the transgenic non-human mammal not contacted with the compound, indicates that the candidate compound may be useful for the treatment of a disease or disorder of the bone and joints.

In still another aspect, the invention features another method for determining whether a candidate compound may be useful for the treatment of a disease or disorder of the bone and joints. This method includes (a) providing a nucleic acid molecule comprising a promoter from a gene encoding a GPCR polypeptide listed in Table 1, the promoter operably linked to a reporter system; (b) contacting the nucleic acid molecule with the candidate compound; and (c) measuring reporter activity, wherein altered reporter activity, relative to a nucleic acid molecule not contacted with the compound, indicates that the candidate compound may be useful for the treatment of a disease or disorder of the bone and joints.

In another aspect, the invention features yet another method for determining whether a candidate compound may be useful for the treatment of a disease or disorder of the bone and joints. This method includes the steps of: (a) providing a GPCR polypeptide substantially identical to a polypeptide listed in Table 1; (b) contacting the polypeptide with the candidate compound; and (c) measuring interaction of the candidate compound to the polypeptide. Interaction of the compound to the polypeptide indicates that the candidate compound may be useful for the treatment of a disease or disorder of the bone and joints.

In still another aspect, the invention features another method for determining whether a candidate compound may be useful for the treatment of a disease or disorder of the bone and joints. This method includes (a) providing a GPCR polypeptide substantially identical to a polypeptide listed in Table 1; (b) contacting the polypeptide with the candidate compound; and (c) measuring the half-life of the polypeptide, wherein an alteration in the half-life of the polypeptide, relative to that of the polypeptide not contacted with the compound, indicates that the candidate compound may be useful for the treatment of a disease or disorder of the bone and joints. Preferably the GPCR polypeptide is in a cell or a cell free assay system.

In another aspect, the invention features a method for determining whether a patient has an increased risk for developing a disease or disorder of the bone and joints. The method includes the step of determining whether the patient has a mutation in a gene encoding a polypeptide listed in Table 1, wherein presence of the mutation indicates that the patient has an increased risk for developing a disease or disorder of the bone and joints.

In a related aspect, the invention features another method for determining whether a patient has an increased risk for developing a disease or disorder of the bone and joints. This method includes the step of determining whether the patient has a polymorphism in a gene encoding a polypeptide listed in Table 1, wherein presence of the polymorphism indicates that the patient may have an increased risk for developing a disease or disorder of the bone and joints.

In either of these two methods, the mutation or polymorphism is preferably associated with an alteration (for example, a decrease) in the biological activity of the polypeptide.

In another aspect, the invention features another method for determining whether a patient has an increased risk for developing a disease or disorder of the bone and joints. The method includes measuring biological activity of a GPCR polypeptide from the patient that is substantially identical to a polypeptide listed in Table 1, wherein increased or decreased levels in the GPCR biological activity, relative to normal levels, indicates that the patient has an increased risk for developing a disease or disorder of the bone and joints.

In still another aspect, the invention features yet another method for determining whether a patient has an increased risk for developing a disease or disorder of the bone and joints. The method includes the step of measuring the patient's expression levels of a polypeptide listed in Table 1, wherein altered levels in the expression, relative to normal, indicate that the patient has an increased risk for developing a disease or disorder of the bone and joints. Preferably, the expression levels are determined by measuring levels of polypeptide or mRNA.

In another aspect, the invention features a method of preventing or treating a disease of the breast including introducing into a human an expression vector that includes a nucleic acid molecule encoding a GPCR polypeptide substantially identical to a polypeptide listed in Table 1 operably linked to a promoter.

In still another aspect, the invention features a method of treating or preventing a disease of the breast including administering to an animal (e.g., a human) a compound that modulates the biological activity of a GPCR polypeptide substantially identical to a polypeptide listed in Table 1.

In yet another aspect, the invention features a method for determining whether a candidate compound is a compound that may be useful for the treatment of a disease or disorder of the breast. This method includes the steps of (a) providing a GPCR polypeptide substantially identical to a polypeptide listed in Table 1; (b) contacting the GPCR polypeptide with the candidate compound; and (c) measuring biological activity of the GPCR polypeptide, wherein altered biological activity, relative to that of the GPCR polypeptide not contacted with the compound, indicates that the candidate compound may be useful for the treatment of a disease or disorder of the breast. The GPCR polypeptide can be in a cell or in a cell-free assay system.

In yet another aspect, the invention features a method for determining whether a candidate compound is a compound that may be useful for the treatment of a disease or disorder of the breast. This method includes the steps of (a) providing a transgenic non-human mammal (e.g., a knock-out mouse) having a disruption in a nucleic acid molecule encoding a GPCR polypeptide substantially identical to a polypeptide listed in Table 1; (b) contacting the transgenic non-human mammal with the candidate compound; and (c) measuring biological activity of the GPCR polypeptide in the transgenic non-human mammal, wherein altered biological activity, relative to that of the transgenic non-human mammal not contacted with the compound, indicates that the candidate compound may be useful for the treatment of a disease or disorder of the breast.

In yet another aspect, the invention features a method for determining whether a candidate compound is a compound that may be useful for the treatment of a disease or disorder of the breast. This method includes the steps of (a) providing a transgenic non-human mammal (e.g., a mouse) overexpressing a nucleic acid molecule encoding a GPCR polypeptide substantially identical to a polypeptide listed in any one of Table 1; (b) contacting the transgenic non-human mammal with the candidate compound; and (c) measuring biological activity of the GPCR polypeptide in the transgenic non-human mammal, wherein altered biological activity, relative to that of the transgenic non-human mammal not contacted with the compound, indicates that the candidate compound may be useful for the treatment of a disease or disorder of the breast.

In still another aspect, the invention features another method for determining whether a candidate compound may be useful for the treatment of a disease or disorder of the breast. This method includes (a) providing a nucleic acid molecule comprising a promoter from a gene encoding a GPCR polypeptide listed in Table 1, the promoter operably linked to a reporter system; (b) contacting the nucleic acid molecule with the candidate compound; and (c) measuring reporter activity, wherein altered reporter activity, relative to a nucleic acid molecule not contacted with the compound, indicates that the candidate compound may be useful for the treatment of a disease or disorder of the breast.

In another aspect, the invention features yet another method for determining whether a candidate compound may be useful for the treatment of a disease or disorder of the breast. This method includes the steps of: (a) providing a GPCR polypeptide substantially identical to a polypeptide listed in Table 1; (b) contacting the polypeptide with the candidate compound; and (c) measuring interaction of the candidate compound to the polypeptide. Interaction of the compound to the polypeptide indicates that the candidate compound may be useful for the treatment of a disease or disorder of the breast.

In still another aspect, the invention features another method for determining whether a candidate compound may be useful for the treatment of a disease or disorder of the breast. This method includes (a) providing a GPCR polypeptide substantially identical to a polypeptide listed in Table 1; (b) contacting the polypeptide with the candidate compound; and (c) measuring the half-life of the polypeptide, wherein an alteration in the half-life of the polypeptide, relative to that of the polypeptide not contacted with the compound, indicates that the candidate compound may be useful for the treatment of a disease or disorder of the breast. Preferably the GPCR polypeptide is in a cell or a cell free assay system.

In another aspect, the invention features a method for determining whether a patient has an increased risk for developing a disease or disorder of the breast. The method includes the step of determining whether the patient has a mutation in a gene encoding a polypeptide listed in Table 1, wherein presence of the mutation indicates that the patient has an increased risk for developing a disease or disorder of the breast.

In a related aspect, the invention features another method for determining whether a patient has an increased risk for developing a disease or disorder of the breast. This method includes the step of determining whether the patient has a polymorphism in a gene encoding a polypeptide listed in Table 1, wherein presence of the polymorphism indicates that the patient may have an increased risk for developing a disease or disorder of the breast.

In either of these two methods, the mutation or polymorphism is preferably associated with an alteration (for example, a decrease) in the biological activity of the polypeptide.

In another aspect, the invention features another method for determining whether a patient has an increased risk for developing a disease or disorder of the breast. The method includes measuring biological activity of a GPCR polypeptide from the patient that is substantially identical to a polypeptide listed in Table 1, wherein increased or decreased levels in the GPCR biological activity, relative to normal levels, indicates that the patient has an increased risk for developing a disease or disorder of the breast.

In still another aspect, the invention features yet another method for determining whether a patient has an increased risk for developing a disease or disorder of the breast. The method includes the step of measuring the patient's expression levels of a polypeptide listed in Table 1, wherein altered levels in the expression, relative to normal, indicate that the patient has an increased risk for developing a disease or disorder of the breast. Preferably, the expression levels are determined by measuring levels of polypeptide or mRNA.

In another aspect, the invention features a method of preventing or treating a disease of the immune system including introducing into a human an expression vector that includes a nucleic acid molecule encoding a GPCR polypeptide substantially identical to a polypeptide listed in Table I operably linked to a promoter.

In still another aspect, the invention features a method of treating or preventing a disease of the immune system including administering to an animal (e.g., a human) a compound that modulates the biological activity of a GPCR polypeptide substantially identical to a polypeptide listed in Table 1.

In yet another aspect, the invention features a method for determining whether a candidate compound is a compound that may be useful for the treatment of a disease or disorder of the immune system. This method includes the steps of (a) providing a GPCR polypeptide substantially identical to a polypeptide listed in Table 1; (b) contacting the GPCR polypeptide with the candidate compound; and (c) measuring biological activity of the GPCR polypeptide, wherein altered biological activity, relative to that of the GPCR polypeptide not contacted with the compound, indicates that the candidate compound may be useful for the treatment of a disease or disorder of the immune system. The GPCR polypeptide can be in a cell or in a cell-free assay system.

In yet another aspect, the invention features a method for determining whether a candidate compound is a compound that may be useful for the treatment of a disease or disorder of the immune system. This method includes the steps of (a) providing a transgenic non-human mammal (e.g., a knock-out mouse) having a disruption in a nucleic acid molecule encoding a GPCR polypeptide substantially identical to a polypeptide listed in Table 1; (b) contacting the transgenic non-human mammal with the candidate compound; and (c) measuring biological activity of the GPCR polypeptide in the transgenic non-human mammal, wherein altered biological activity, relative to that of the transgenic non-human mammal not contacted with the compound, indicates that the candidate compound may be useful for the treatment of a disease or disorder of the immune system.

In yet another aspect, the invention features a method for determining whether a candidate compound is a compound that may be useful for the treatment of a disease or disorder of the immune system. This method includes the steps of (a) providing a transgenic non-human mammal (e.g., a mouse) overexpressing a nucleic acid molecule encoding a GPCR polypeptide substantially identical to a polypeptide listed in any one of Table 1; (b) contacting the transgenic non-human mammal with the candidate compound; and (c) measuring biological activity of the GPCR polypeptide in the transgenic non-human mammal, wherein altered biological activity, relative to that of the transgenic non-human mammal not contacted with the compound, indicates that the candidate compound may be useful for the treatment of a disease or disorder of the immune system.

In still another aspect, the invention features another method for determining whether a candidate compound may be useful for the treatment of a disease or disorder of the immune system. This method includes (a) providing a nucleic acid molecule comprising a promoter from a gene encoding a GPCR polypeptide listed in Table 1, the promoter operably linked to a reporter system; (b) contacting the nucleic acid molecule with the candidate compound; and (c) measuring reporter activity, wherein altered reporter activity, relative to a nucleic acid molecule not contacted with the compound, indicates that the candidate compound may be useful for the treatment of a disease or disorder of the immune system.

In another aspect, the invention features yet another method for determining whether a candidate compound may be useful for the treatment of a disease or disorder of the immune system. This method includes the steps of: (a) providing a GPCR polypeptide substantially identical to a polypeptide listed in Table 1; (b) contacting the polypeptide with the candidate compound; and (c) measuring interaction of the candidate compound to the polypeptide. Interaction of the compound to the polypeptide indicates that the candidate compound may be useful for the treatment of a disease or disorder of the immune system.

In still another aspect, the invention features another method for determining whether a candidate compound may be useful for the treatment of a disease or disorder of the immune system. This method includes (a) providing a GPCR polypeptide substantially identical to a polypeptide listed in Table 1; (b) contacting the polypeptide with the candidate compound; and (c) measuring the half-life of the polypeptide, wherein an alteration in the half-life of the polypeptide, relative to that of the polypeptide not contacted with the compound, indicates that the candidate compound may be useful for the treatment of a disease or disorder of the immune system. Preferably the GPCR polypeptide is in a cell or a cell free assay system.

In another aspect, the invention features a method for determining whether a patient has an increased risk for developing a disease or disorder of the immune system. The method includes the step of determining whether the patient has a mutation in a gene encoding a polypeptide listed in Table 1, wherein presence of the mutation indicates that the patient has an increased risk for developing a disease or disorder of the immune system.

In a related aspect, the invention features another method for determining whether a patient has an increased risk for developing a disease or disorder of the immune system. This method includes the step of determining whether the patient has a polymorphism in a gene encoding a polypeptide listed in Table 1, wherein presence of the polymorphism indicates that the patient may have an increased risk for developing a disease or disorder of the immune system.

In either of these two methods, the mutation or polymorphism is preferably associated with an alteration (for example, a decrease) in the biological activity of the polypeptide.

In another aspect, the invention features another method for determining whether a patient has an increased risk for developing a disease or disorder of the immune system. The method includes measuring biological activity of a GPCR polypeptide from the patient that is substantially identical to a polypeptide listed in Table 1, wherein increased or decreased levels in the GPCR biological activity, relative to normal levels, indicates that the patient has an increased risk for developing a disease or disorder of the immune system.

In still another aspect, the invention features yet another method for determining whether a patient has an increased risk for developing a disease or disorder of the immune system. The method includes the step of measuring the patient's expression levels of a polypeptide listed in Table 1, wherein altered levels in the expression, relative to normal, indicate that the patient has an increased risk for developing a disease or disorder of the immune system. Preferably, the expression levels are determined by measuring levels of polypeptide or mRNA.

In another aspect, the invention features a method of preventing or treating a metabolic or nutritive disease or disorder, including introducing into a human an expression vector that includes a nucleic acid molecule encoding a GPCR polypeptide substantially identical to a polypeptide listed in Table 1 operably linked to a promoter.

In still another aspect, the invention features a method of treating or preventing a metabolic or nutritive disease or disorder, including administering to an animal (e.g., a human) a compound that modulates the biological activity of a GPCR polypeptide substantially identical to a polypeptide listed in Table 1.

In yet another aspect, the invention features a method for determining whether a candidate compound is a compound that may be useful for the treatment of a metabolic or nutritive disease or disorder. This method includes the steps of (a) providing a GPCR polypeptide substantially identical to a polypeptide listed in Table 1; (b) contacting the GPCR polypeptide with the candidate compound; and (c) measuring biological activity of the GPCR polypeptide, wherein altered biological activity, relative to that of the GPCR polypeptide not contacted with the compound, indicates that the candidate compound may be useful for the treatment of a metabolic or nutritive disease or disorder. The GPCR polypeptide can be in a cell or in a cell-free assay system.

In yet another aspect, the invention features a method for determining whether a candidate compound is a compound that may be useful for the treatment of a metabolic or nutritive disease or disorder. This method includes the steps of (a) providing a transgenic non-human mammal (e.g., a knockout mouse) having a disruption in a nucleic acid molecule encoding a GPCR polypeptide substantially identical to a polypeptide listed in Table 1; (b) contacting the transgenic non-human mammal with the candidate compound; and (c) measuring biological activity of the GPCR polypeptide in the transgenic non-human mammal, wherein altered biological activity, relative to that of the transgenic non-human mammal not contacted with the compound, indicates that the candidate compound may be useful for the treatment of a metabolic or nutritive disease or disorder.

In yet another aspect, the invention features a method for determining whether a candidate compound is a compound that may be useful for the treatment of a metabolic or nutritive disease or disorder. This method includes the steps of (a) providing a transgenic non-human mammal (e.g., a mouse) overexpressing a nucleic acid molecule encoding a GPCR polypeptide substantially identical to a polypeptide listed in any one of Table 1; (b) contacting the transgenic non-human mammal with the candidate compound; and (c) measuring biological activity of the GPCR polypeptide in the transgenic non-human mammal, wherein altered biological activity, relative to that of the transgenic non-human mammal not contacted with the compound, indicates that the candidate compound may be useful for the treatment of a metabolic or nutritive disease or disorder.

In still another aspect, the invention features another method for determining whether a candidate compound may be useful for the treatment of a metabolic or nutritive disease or disorder. This method includes (a) providing a nucleic acid molecule comprising a promoter from a gene encoding a GPCR polypeptide listed in Table 1, the promoter operably linked to a reporter system; (b) contacting the nucleic acid molecule with the candidate compound; and (c) measuring reporter activity, wherein altered reporter activity, relative to a nucleic acid molecule not contacted with the compound, indicates that the candidate compound may be useful for the treatment of a metabolic or nutritive disease or disorder.

In another aspect, the invention features yet another method for determining whether a candidate compound may be useful for the treatment of a metabolic or nutritive disease or disorder. This method includes the steps of: (a) providing a GPCR polypeptide substantially identical to a polypeptide listed in Table 1; (b) contacting the polypeptide with the candidate compound; and (c) measuring interaction of the candidate compound to the polypeptide. Interaction of the compound to the polypeptide indicates that the candidate compound may be useful for the treatment of a metabolic or nutritive disease or disorder.

In still another aspect, the invention features another method for determining whether a candidate compound may be useful for the treatment of a metabolic or nutritive disease or disorder. This method includes (a) providing a GPCR polypeptide substantially identical to a polypeptide listed in Table 1; (b) contacting the polypeptide with the candidate compound; and (c) measuring the half-life of the polypeptide, wherein an alteration in the half-life of the polypeptide, relative to that of the polypeptide not contacted with the compound, indicates that the candidate compound may be useful for the treatment of a metabolic or nutritive disease or disorder. Preferably the GPCR polypeptide is in a cell or a cell free assay system.

In another aspect, the invention features a method for determining whether a patient has an increased risk for developing a metabolic or nutritive disease or disorder. The method includes the step of determining whether the patient has a mutation in a gene encoding a polypeptide listed in Table 1, wherein presence of the mutation indicates that the patient has an increased risk for developing a metabolic or nutritive disease or disorder.

In a related aspect, the invention features another method for determining whether a patient has an increased risk for developing a metabolic or nutritive disease or disorder. This method includes the step of determining whether the patient has a polymorphism in a gene encoding a polypeptide listed in Table 1, wherein presence of the polymorphism indicates that the patient may have an increased risk for developing a metabolic or nutritive disease or disorder.

In either of these two methods, the mutation or polymorphism is preferably associated with an alteration (for example, a decrease) in the biological activity of the polypeptide.

In another aspect, the invention features another method for determining whether a patient has an increased risk for developing a metabolic or nutritive disease or disorder. The method includes measuring biological activity of a GPCR polypeptide from the patient that is substantially identical to a polypeptide listed in Table 1, wherein increased or decreased levels in the GPCR biological activity, relative to normal levels, indicates that the patient has an increased risk for developing a metabolic or nutritive disease or disorder.

In still another aspect, the invention features yet another method for determining whether a patient has an increased risk for developing a metabolic or nutritive disease or disorder. The method includes the step of measuring the patient's expression levels of a polypeptide listed in Table 1, wherein altered levels in the expression, relative to normal, indicate that the patient has an increased risk for developing a metabolic or nutritive disease or disorder. Preferably, the expression levels are determined by measuring levels of polypeptide or mRNA.

In another aspect, the invention features a transgenic mouse expressing a transgene encoding a human GPCR polypeptide listed in Table 1. The transgene may be operably linked, e.g., to an inducible, cell-type, or tissue-specific promoter. In one embodiment, the transgenic mouse has a mutation in a gene that is orthologous to the transgene. For example, the transgene encoding the human GPCR polypeptide may entirely replace the coding sequence of the orthologous mouse gene or the transgene might complement a knock out of the orthologous mouse gene.

In a related embodiment, the transgenic mouse has a mutation (e.g., a deletion, frameshift, insertion or a point mutation) in a gene listed in Table 1.

In another aspect, the invention features an isolated cell or population of cells derived from a transgenic mouse either expressing a transgene encoding a human GPCR polypeptide listed in Table 1 or has a mutation (e.g., a deletion, frameshift, insertion or a point mutation) in a gene listed in Table 1.

The invention also features a method for identifying a compound that may be useful for the treatment of a disease or disorder described herein. The method includes the steps of administering a candidate compound to a transgenic mouse expressing a transgene encoding a GPCR polypeptide listed in Table 1; and determining whether the candidate compound decreases the biological activity of the GPCR polypeptide, wherein a decrease in the biological activity of the GPCR polypeptide identifies the candidate compound as a compound that may be useful for the treatment of a disease or disorder. In one embodiment, the transgenic mouse has a mutation (e.g., a deletion, frameshift, insertion or a point mutation) in a gene listed in Table 1. In a related embodiment, the mouse has a mutation in the gene that is orthologous to the transgene.

In a related aspect, the invention features another method for identifying a compound that may be useful for the treatment of a disease or disorder described herein. This method includes the steps of administering a candidate compound to a transgenic mouse expressing a transgene encoding a GPCR polypeptide in a gene listed in Table 1, and having a disease or disorder caused by the expression of the transgene; and determining whether the candidate compound treats the disease or disorder.

In a related aspect, the invention features another method for identifying a compound that may be useful for the treatment of a disease or disorder described herein. This method includes the steps of administering a candidate compound to a transgenic mouse transgenic mouse containing a mutation (e.g., a deletion, frameshift, insertion or a point mutation) in a gene listed in Table 1, and having a disease or disorder caused by gene disruption; and determining whether candidate compound treats the disease or disorder.

In still another aspect, the invention features a method for identifying a compound that may be useful for the treatment of a disease or disorder described herein. This method includes the steps of contacting a candidate compound with a cell from a transgenic mouse expressing a transgene encoding a GPCR polypeptide in a gene listed in Table 1; and determining whether the candidate compound decreases the biological activity of the GPCR polypeptide. A decrease in the biological activity of the GPCR polypeptide identifies the candidate compound as a compound that may be useful for the treatment of a disease or disorder. In one embodiment, the transgenic mouse from which the cell was derived has a mutation (e.g., a deletion, frameshift, insertion or a point mutation) in a gene listed in Table 1. In a related embodiment, the mouse has a mutation in the polypeptide that is orthologous to the GPCR polypeptide encoded by the transgene.

The invention also features a kit that includes a plurality of polynucleotides, wherein each polynucleotide hybridizes under high stringency conditions to a GPCR polynucleotide of Table 1. At least 50 different polynucleotides, each capable of hybridizing under high stringency conditions to a different human GPCR polynucleotide listed on Table 1, are present in the kit.

The invention features another kit that includes a plurality of polynucleotides. In this kit, polynucleotides that hybridize under high stringency conditions, each to a different GPCR polynucleotide listed on one of Tables 3-33, are present in the kit such that the kit includes polynucleotides that collectively hybridize to every GPCR polynucleotide listed on one of Tables 3-33.

The invention features another kit, this kit including a plurality of mice, each mouse having a mutation in a GPCR polynucleotide of Table 1, wherein at least 50 mice, each having a mutation in a different GPCR polynucleotide listed on Table 1, are present in the kit. This kit may optionally include a plurality of polynucleotides, wherein each polynucleotide hybridizes under high stringency conditions to a GPCR polynucleotide of Table 1, wherein at least 50 different polynucleotides, each capable of hybridizing under high stringency conditions to a different mouse GPCR polynucleotide listed on Table 1, are present in the kit.

The invention features another kit that includes a plurality of mice having a mutation in a GPCR polynucleotide. In this kit, mice having a mutation in each GPCR polynucleotide listed on one of Tables 3-33 are present in the kit.

In any of the foregoing kits, at least one of the GPCR polynucleotides is desirably a GPCR polynucleotide of Table 2.

In particular embodiment, the present invention provides methods of treating or preventing neurological and metabolic diseases and disorders, comprising administering to a patient a modulator of one or more G protein coupled receptors, including, e.g., GPR88, GPR 22, and the Super conserved Receptors Expressed in Brain (SREB) GPCRs. SREB GPCRs include GPR85 (SREB2), SREB3 (GPR173), and SREB1 (GPR27). In addition, the present invention provides related methods of diagnosing or detecting a neurological or metabolic disease or disorder, comprising measuring altered expression or activity of one or more G protein coupled receptors, or identifying a mutation in a one or more G protein coupled receptor genes, in a patient. The invention further provides related kits useful in the diagnosis and treatment of neurological and metabolic diseases and disorders.

In certain embodiments, the present invention includes a method of treating or preventing a neurological disease or disorder in a patient, said method comprising administering to said patient a first nucleic acid molecule encoding a GPCR polypeptide having the amino acid sequence set forth in any one of SEQ ID NOs:488, 243, 558 or 484, or a variant or fragment thereof. In one embodiment, this method comprises administering to said patient an expression vector comprising a nucleic acid molecule operably linked to a promoter, said nucleic acid molecule encoding a GPCR polypeptide having the amino acid sequence set forth in any one of SEQ ID NOs:488, 243, 558 or 484, or a variant or fragment thereof.

In a related embodiment, wherein said first nucleic acid molecule encodes a GPCR polypeptide having the amino acid sequence set forth in any one of SEQ ID NOs:488 or 243, the above method further comprises administering a second nucleic acid molecule encoding a GPCR polypeptide having the amino acid sequence set forth in any one of SEQ ID NOs:552, 488, or 243, or a variant or fragment thereof, wherein said first and second nucleic acid molecules encode different GPCR polypeptides. In one particular embodiment, the first and second nucleic acid molecules encode GPCR polypeptides having the amino acid sequences set forth in SEQ ID NO:488 and SEQ ID NO:552, respectively.

In another embodiment, the present invention includes a method of treating or preventing a neurological disease or disorder in a patient, said method comprising administering to said patient a first compound that modulates the biological activity or expression of a GPCR polypeptide having the amino acid sequence set forth in any one of SEQ ID NOs:488, 243, 558, or 484. In another embodiment, wherein said first nucleic acid molecule encodes a GPCR polypeptide having the amino acid sequence set forth in any one of SEQ ID NOs:488 or 243, the method further comprises administering to said patient a second compound that modulates the biological activity or expression of a GPCR polypeptide having the amino acid sequence set forth in any one of SEQ ID NOs:552, 488, or 243, wherein said first and second compounds modulate different GPCR polypeptides. In particular embodiments, said first or second compound is a nucleic acid molecule comprising a portion of the polynucleotide sequence set forth in any one of SEQ ID NOs:1046, 1014, 894, 1049, or 1012, or a complement thereof. In certain embodiments, the nucleic acid molecule may be a virus, plasmid, antisense RNA, ribozyme, or RNAi oligonucleotide. In other embodiments, the compound is an antibody that specifically binds a polypeptide having the amino acid sequence set forth in any one of SEQ ID NOs:552, 488, 243, 558, or 484. In yet another embodiment, the compound is a small molecule. In certain embodiments, said compound increases the biological activity or expression of a polypeptide having the amino acid sequence set forth in any one of SEQ ID NOs:552, 488, 243, 558, or 484. In other embodiments, said compound decreases the biological activity or expression of a polypeptide having the amino acid sequence set forth in any one of SEQ ID NOs:552, 488, 243, 558, or 484. In certain embodiments, two or more of such compounds are administered, wherein each binds a different polypeptide having the amino acid sequence set forth in any one of SEQ ID NOs:552, 488, or 243. In one embodiment, said first and second compounds modulate the biological activity or expression of GPCR polypeptides having the amino acid sequences set forth in SEQ ID NO:488 and SEQ ID NO:552, respectively.

In further related embodiments, the present invention includes methods for determining whether a patient has an increased risk for developing a neurological disease or disorder. In one embodiment, said method comprises determining the presence of a mutation or polymorphism in a first gene encoding a GPCR polypeptide having the amino acid sequence set forth in any one of SEQ ID NOs:488, 243, 558, or 484 in a patient, wherein the presence of said mutation or polymorphism indicates that said patient has an increased risk for developing a neurological disease or disorder. In a related embodiment, wherein the first gene encodes a GPCR polypeptide having the amino acid sequence set forth in any one of SEQ ID NOs:488 or 243, the method further comprises determining the presence of a mutation or polymorphism in a second gene encoding a GPCR polypeptide having the amino acid sequence set forth in any one of SEQ ID NOs:552, 488, or 243, wherein said first and second gene encode different GPCR polypeptides, and wherein the presence of mutations or polymorphisms in both genes indicates that said patient has an increased risk for developing a neurological disease or disorder.

In another embodiment, the method comprises measuring in said patient, or a biological sample obtained from said patient, the level of biological activity of a first GPCR polypeptide having the amino acid sequence set forth in any one of SEQ ID NOs:488, 243, 558, or 484, wherein an altered level in said biological activity, relative to a normal control level, indicates that said patient has an increased risk for developing a neurological disease or disorder. In a related embodiment, wherein the first GPCR polypeptide has the amino acid sequence set forth in any one of SEQ ID NOs:488 or 243, the method further comprises measuring in said patient, or a biological sample obtained from said patient, the level of biological activity of a second GPCR polypeptide having the amino acid sequence set forth in any one of SEQ ID NOs:552, 488, or 243, wherein said first and second GPCR polypeptides are different and wherein an altered level in biological activity of both the first and second GPCR polypeptides, relative to a normal control levels, indicates that said patient has an increased risk for developing a neurological disease or disorder.

In yet another embodiment, said method comprises measuring in said patient, or in a biological sample, e.g., cells, obtained from said patient, the level of expression of a first GPCR polypeptide having the amino acid sequence set forth in any one of SEQ ID NOs:488, 243, 558, or 484, wherein an altered level in said expression, relative to a normal control level, indicates that said patient has an increased risk for developing a neurological disease or disorder. In a related embodiment, wherein the first GPCR polypeptide has the amino acid sequence set forth in any one of SEQ ID NOs:488 or 243, the method further comprises measuring in said patient, or in a biological sample obtained from said patient, the expression of a second GPCR polypeptide having the amino acid sequence set forth in any one of SEQ ID NOs:552, 488, or 243, wherein said first and second GPCR polypeptide are different and wherein an altered level in expression of both GPCRs, relative to a normal control levels, indicates that said patient has an increased risk for developing a neurological disease or disorder. In one embodiment, expression is determined by measuring levels of said GPCR polypeptide. In particular embodiments, said expression is determined by measuring levels of RNA encoding said GPCR polypeptide.

The present invention also provides methods for identifying a compound for the treatment or prevention of a neurological disease or disorder, comprising: contacting a cell expressing a GPCR polypeptide substantially identical to a polypeptide having the amino acid sequence set forth in any one of SEQ ID NOs:488, 243, 558, or 484 with a candidate compound; and measuring the biological activity or expression of said GPCR polypeptide expressed in said cell, wherein altered biological activity or expression of said GPCR polypeptide, relative to a cell not contacted with said compound, indicates that said candidate compound useful for the treatment of a neurological disease or disorder.

In a related embodiment, the present invention includes a method for identifying a compound for the treatment or prevention of a neurological disease or disorder, said method comprising: contacting a GPCR polypeptide substantially identical to a polypeptide having the amino acid sequence set forth in any one of SEQ ID NOs:488, 243, 558, or 484 with a candidate compound; and determining whether said candidate compound binds to said GPCR polypeptide, wherein binding of said candidate compound to said GPCR polypeptide identifies said candidate compound as a compound useful for the treatment or prevention of a neurological disease or disorder.

In a further related embodiment, the invention includes a method for identifying a compound for the treatment of a neurological disease or disorder, said method comprising administering a candidate compound to a transgenic animal expressing a transgene encoding a human GPCR polypeptide substantially identical to a polypeptide having the amino acid sequence set forth in any one of SEQ ID NOs:488, 243, 558, or 484; and determining whether said candidate compound alters the biological activity or expression of said GPCR polypeptide, wherein a alteration in the biological activity or expression of said GPCR polypeptide identifies said candidate compound as a compound useful for the treatment of a neurological disease or disorder. In one embodiment, said animal has a mutation in the endogenous gene that is orthologous to said transgene.

In yet a further embodiment, the present invention includes a method for identifying a compound for the treatment of a neurological disease or disorder, said method comprising the steps of administering a candidate compound to a transgenic animal expressing in one of its neurological tissues a transgene encoding a human GPCR polypeptide substantially identical to a polypeptide having the amino acid sequence set forth in any one of SEQ ID NOs:488, 243, 558, or 484, said animal having a neurological disease or disorder; and determining whether said candidate compound treats said neurological disease or disorder.

In a related embodiment, the present invention provides a method for identifying a compound for the treatment of a neurological disease or disorder, said method comprising the steps of contacting a candidate compound with a cell from a transgenic animal expressing a transgene encoding a human GPCR polypeptide substantially identical to a polypeptide having the amino acid sequence set forth in any one of SEQ ID NOs:488, 243, 558, or 484; and determining whether said candidate compound alters the biological activity or expression of said GPCR polypeptide, wherein a alteration in the biological activity or expression of said GPCR polypeptide identifies said candidate compound as a compound useful for the treatment of a neurological disease or disorder.

In yet another embodiment, the present invention includes a method for identifying a compound for the treatment of a neurological disease or disorder, said method comprising administering a candidate compound to an animal comprising a mutation in a gene encoding a polypeptide substantially identical to a polypeptide having the amino acid sequence set forth in any one of SEQ ID NOs:488, 243, 558, or 484; and determining whether said candidate compound alters the biological activity or expression of said GPCR polypeptide, wherein a alteration in the biological activity or expression of said GPCR polypeptide identifies said candidate compound as a compound useful for the treatment of a neurological disease or disorder.

Another embodiment of the present invention includes a method for identifying a compound for the treatment of a neurological disease or disorder, said method comprising the steps of administering a candidate compound to an animal comprising a mutation in a gene encoding a polypeptide substantially identical to a polypeptide having the amino acid sequence set forth in any one of SEQ ID NOs:488, 243, 558, or 484, said animal having a neurological disease or disorder; and determining whether said candidate compound treats said neurological disease or disorder.

In a related embodiment, the present invention includes a method for identifying a compound for the treatment of a neurological disease or disorder, said method comprising the steps of contacting a candidate compound with a cell from an animal comprising a mutation in a gene encoding a polypeptide substantially identical to a polypeptide having the amino acid sequence set forth in any one of SEQ ID NOs:488, 243, 558, or 484; and determining whether said candidate compound alters the biological activity or expression of said GPCR polypeptide, wherein a alteration in the biological activity or expression of said GPCR polypeptide identifies said candidate compound as a compound useful for the treatment of a neurological disease or disorder.

In a related embodiment, the invention further provides an animal model of a neurological disease or disorder, wherein said animal model is a non-human mammal comprising a mutation in a first gene encoding a polypeptide having the amino acid sequence set forth in any one of SEQ ID NOs:488, 243, 558, or 484, and wherein said non-human mammal exhibits one or more symptoms of a neurological disease or disorder. In another embodiment, wherein the first gene encodes a GPCR polypeptide having the amino acid sequence set forth in any one of SEQ ID NOs:488 or 243, the mammal further comprises a mutation in a second gene encoding a polypeptide having the amino acid sequence set forth in any one of SEQ ID NOs:552, 488 or 243, wherein said first and second genes are different.

In yet another related embodiment, the invention includes an animal model of a neurological disease or disorder, wherein said animal model is a non-human mammal comprising a first transgene encoding a GPCR polypeptide having the amino acid sequence set forth in any one of SEQ ID NOs:488, 243, 558, or 484, and wherein said non-human mammal exhibits one or more symptoms of a neurological disease or disorder. In another embodiment, wherein the first transgene encodes a GPCR polypeptide having the amino acid sequence set forth in any one of SEQ ID NOs:488 or 243, the mammal further comprises a second transgene encoding a polypeptide having the amino acid sequence set forth in any one of SEQ ID NOs:552, 488 or 243, wherein said first and second genes are different.

In another embodiment, the present invention includes a cell isolated from a non-human mammal of the present invention.

In one embodiment, the present invention includes a kit for determining the presence of a neurological disease or disorder in a patient, wherein said kit comprises a first compound that specifically binds to a polynucleotide having the sequence set forth in any one of SEQ ID NOs:1014, 894, 1049, or 1012, or to a polypeptide having the sequence set forth in any one of SEQ ID NOs:488, 243, 558, or 484. In a related embodiment, wherein the first compound specifically binds to a polynucleotide having the sequence set forth in any one of SEQ ID NOs:1014 or 894 or to a polypeptide having the sequence set forth in any one of SEQ ID NOs:488 or 243, the kit further comprises a second compound that specifically binds to a polynucleotide having the sequence set forth in any on of SEQ ID NOs:1046, 1014, and 894 or to a polypeptide having the sequence set forth in any one of SEQ ID NOs:552, 488, or 243, wherein said first and second compounds bind to different polypeptides or polynucleotides. In certain embodiments, the compound is labeled. The kit may further include one or more control samples.

In certain embodiments, the present invention includes a method of treating or preventing a metabolic disease or disorder in a patient, said method comprising administering to said patient a first nucleic acid molecule encoding a GPCR polypeptide having the amino acid sequence set forth in any one of SEQ ID NOs:552, 488, or 243, or a variant or fragment thereof. In one embodiment, this method comprises administering to said patient an expression vector comprising a nucleic acid molecule operably linked to a promoter, said nucleic acid molecule encoding a GPCR polypeptide having the amino acid sequence set forth in any one of SEQ ID NOs:552, 488, or 243, or a variant or fragment thereof. In a related embodiment, the method further comprises administering a second nucleic acid molecule encoding a GPCR polypeptide having the amino acid sequence set forth in any one of SEQ ID NOs:552, 488, or 243, or a variant or fragment thereof, wherein said first and second nucleic acid molecules encode different GPCR polypeptides.

In related embodiments, the present invention includes a method of treating or preventing a metabolic disease or disorder in a patient, said method comprising administering to said patient a first compound that modulates the biological activity or expression of a GPCR polypeptide having the amino acid sequence set forth in any one of SEQ ID NOs:552, 488, or 243. In another embodiment, the method further comprises administering to said patient a second compound that modulates the biological activity or expression of a GPCR polypeptide having the amino acid sequence set forth in any on of SEQ ID NOs:552, 488, or 243, wherein said first and second compounds modulate different GPCR polypeptides. In particular embodiments, said compound is a nucleic acid molecule comprising a portion of the polynucleotide sequence set forth in any one of SEQ ID NOs:1046, 1014, or 894, or a complement thereof. In certain embodiments, the nucleic acid molecule may be a virus, plasmid, antisense RNA, ribozyme, or RNAi oligonucleotide. In other embodiments, the compound is an antibody that specifically binds a polypeptide having the amino acid sequence set forth in any one of SEQ ID NOs:552, 488, or 243. In yet another embodiment, the compound is a small molecule. In certain embodiments, said compound increases the biological activity or expression of a polypeptide having the amino acid sequence set forth in any one of SEQ ID NOs:552, 488, or 243. In other embodiments, said compound decreases the biological activity or expression of a polypeptide having the amino acid sequence set forth in any one of SEQ ID NOs:552, 488, or 243. In certain embodiments, two or more of such compounds are administered, wherein each binds a polypeptide having the amino acid sequence set forth in any one of SEQ ID NOs:552, 488, or 243.

In further related embodiments, the present invention includes methods for determining whether a patient has an increased risk for developing a metabolic disease or disorder. In one embodiment, said method comprises determining the presence of a mutation or polymorphism in a first gene encoding a GPCR polypeptide having the amino acid sequence set forth in any one of SEQ ID NOs:552, 488, or 243 in a patient, wherein the presence of said mutation or polymorphism indicates that said patient has an increased risk for developing a metabolic disease or disorder. In a related embodiment, the method further comprises determining the presence of a mutation or polymorphism in a second gene encoding a GPCR polypeptide having the amino acid sequence set forth in any one of SEQ ID NOs:552, 488, or 243, wherein said first and second gene encode different GPCR polypeptides, and wherein the presence of mutations or polymorphisms in both genes indicates that said patient has an increased risk for developing a metabolic disease or disorder.

In another embodiment, the method comprises measuring in said patient, or a biological sample obtained from said patient, the level of biological activity of a first GPCR polypeptide having the amino acid sequence set forth in any one of SEQ ID NOs:552, 488, or 243, wherein an altered level in said biological activity, relative to a normal control level, indicates that said patient has an increased risk for developing a metabolic disease or disorder. In a related embodiment, the method further comprises measuring in said patient, or a biological sample obtained from said patient, the level of biological activity of a second GPCR polypeptide having the amino acid sequence set forth in any one of SEQ ID NOs:552, 488, or 243, wherein said first and second GPCR polypeptides are different and wherein an altered level in biological activity of both the first and second GPCR polypeptides, relative to a normal control levels, indicates that said patient has an increased risk for developing a metabolic disease or disorder.

In yet another embodiment, said method comprises measuring in said patient, or in a biological sample obtained from said patient, the level of expression of a first GPCR polypeptide having the amino acid sequence set forth in any one of SEQ ID NOs:552, 488, or 243, wherein an altered level in said expression, relative to a normal control level, indicates that said patient has an increased risk for developing a metabolic disease or disorder. In a related embodiment, the method further comprises measuring in said patient, or in a biological sample obtained from said patient, the expression of a second GPCR polypeptide having the amino acid sequence set forth in any one of SEQ ID NOs:552, 488, or 243, wherein said first and second GPCR polypeptide are different and wherein an altered level in expression of both GPCRs, relative to a normal control levels, indicates that said patient has an increased risk for developing a metabolic disease or disorder. In one embodiment, expression is determined by measuring levels of said GPCR polypeptide. In particular embodiments, said expression is determined by measuring levels of RNA encoding said GPCR polypeptide.

The present invention also provides methods for identifying a compound for the treatment or prevention of a metabolic disease or disorder, comprising: contacting a cell expressing a GPCR polypeptide substantially identical to a polypeptide having the amino acid sequence set forth in any one of SEQ ID NOs:552, 488, or 243 with a candidate compound; and measuring the biological activity or expression of said GPCR polypeptide expressed in said cell, wherein altered biological activity or expression of said GPCR polypeptide, relative to a cell not contacted with said compound, indicates that said candidate compound useful for the treatment of a metabolic disease or disorder.

In a related embodiment, the present invention includes a method for identifying a compound for the treatment or prevention of a metabolic disease or disorder, said method comprising: contacting a GPCR polypeptide substantially identical to a polypeptide having the amino acid sequence set forth in any one of SEQ ID NOs:552, 488, or 243 with a candidate compound; and determining whether said candidate compound binds to said GPCR polypeptide, wherein binding of said candidate compound to said GPCR polypeptide identifies said candidate compound as a compound useful for the treatment or prevention of a metabolic disease or disorder.

In a further related embodiment, the invention includes a method for identifying a compound for the treatment of a metabolic disease or disorder, said method comprising administering a candidate compound to a transgenic animal expressing a transgene encoding a human GPCR polypeptide substantially identical to a polypeptide having the amino acid sequence set forth in any one of SEQ ID NOs:552, 488, or 243; and determining whether said candidate compound alters the biological activity or expression of said GPCR polypeptide, wherein a alteration in the biological activity or expression of said GPCR polypeptide identifies said candidate compound as a compound useful for the treatment of a metabolic disease or disorder. In one embodiment, said animal has a mutation in the endogenous gene that is orthologous to said transgene.

In yet a further embodiment, the present invention includes a method for identifying a compound for the treatment of a metabolic disease or disorder, said method comprising the steps of administering a candidate compound to a transgenic animal expressing in one of its neurological tissues a transgene encoding a human GPCR polypeptide substantially identical to a polypeptide having the amino acid sequence set forth in any one of SEQ ID NOs:552, 488, or 243, said animal having a metabolic disease or disorder; and determining whether said candidate compound treats said metabolic disease or disorder.

In a related embodiment, the present invention provides a method for identifying a compound for the treatment of a metabolic disease or disorder, said method comprising the steps of contacting a candidate compound with a cell from a transgenic animal expressing a transgene encoding a human GPCR polypeptide substantially identical to a polypeptide having the amino acid sequence set forth in any one of SEQ ID NOs:552, 488, or 243; and determining whether said candidate compound alters the biological activity or expression of said GPCR polypeptide, wherein a alteration in the biological activity or expression of said GPCR polypeptide identifies said candidate compound as a compound useful for the treatment of a metabolic disease or disorder.

In yet another embodiment, the present invention includes a method for identifying a compound for the treatment of a metabolic disease or disorder, said method comprising administering a candidate compound to an animal comprising a mutation in a gene encoding a polypeptide substantially identical to a polypeptide having the amino acid sequence set forth in any one of SEQ ID NOs:552, 488, or 243; and determining whether said candidate compound alters the biological activity or expression of said GPCR polypeptide, wherein a alteration in the biological activity or expression of said GPCR polypeptide identifies said candidate compound as a compound useful for the treatment of a metabolic disease or disorder.

Another embodiment of the present invention includes a method for identifying a compound for the treatment of a metabolic disease or disorder, said method comprising the steps of administering a candidate compound to an animal comprising a mutation in a gene encoding a polypeptide substantially identical to a polypeptide having the amino acid sequence set forth in any one of SEQ ID NOs:552, 488, or 243, said animal having a metabolic disease or disorder; and determining whether said candidate compound treats said metabolic disease or disorder.

In a related embodiment, the present invention includes a method for identifying a compound for the treatment of a metabolic disease or disorder, said method comprising the steps of contacting a candidate compound with a cell from an animal comprising a mutation in a gene encoding a polypeptide substantially identical to a polypeptide having the amino acid sequence set forth in any one of SEQ ID NOs:552, 488, or 243; and determining whether said candidate compound alters the biological activity or expression of said GPCR polypeptide, wherein a alteration in the biological activity or expression of said GPCR polypeptide identifies said candidate compound as a compound useful for the treatment of a metabolic disease or disorder.

In a related embodiment, the invention further provides an animal model of a metabolic disease or disorder, wherein said animal model is a non-human mammal comprising a mutation in a first gene encoding a polypeptide having the amino acid sequence set forth in any one of SEQ ID NOs:552, 488, or 243, and wherein said non-human mammal exhibits one or more symptoms of a metabolic disease or disorder. In another embodiment, the mammal further comprises a mutation in a second gene encoding a polypeptide having the amino acid sequence set forth in any one of SEQ ID NOs:552, 488, or 243, wherein said first and second genes are different.

In yet another related embodiment, the invention includes an animal model of a metabolic disease or disorder, wherein said animal model is a non-human mammal comprising a transgene encoding a GPCR polypeptide having the amino acid sequence set forth in any one of SEQ ID NOs:552, 488, or 243, and wherein said non-human mammal exhibits one or more symptoms of a metabolic disease or disorder.

In another embodiment, the present invention includes a cell isolated from the non-human mammal of the present invention.

In one embodiment, the present invention includes a kit for determining the presence of a metabolic disease or disorder in a patient, wherein said kit comprises a first compound that specifically binds to a polynucleotide having the sequence set forth in any on of SEQ ID NOs:1046, 1014, and 894 or to a polypeptide having the sequence set forth in any one of SEQ ID NOs:552, 488, or 243. In a related embodiment, the kit further comprises a second compound that specifically binds to a polynucleotide having the sequence set forth in any on of SEQ ID NOs:1046, 1014, and 894 or to a polypeptide having the sequence set forth in any one of SEQ ID NOs:552, 488, or 243, wherein said first and second compounds bind to different polypeptides or polynucleotides. In certain embodiments, the compound is labeled. The kit may further include one or more control samples.

In certain embodiments of the methods, animals, cells, and kits of the present invention related to GPR8243 and SREBs, the neurological or metabolic disease or disorder is psychosis, schizophrenia, mania, bipolar disorder, obsessive compulsive disorders, autism spectrum disorders, attention-deficit hyperactivity disorders, dementia, mental retardation, other abnormal social behaviors, or other neurodevelopmental disorders.

In certain embodiment, the metabolic disease or disorder is obesity, diabetes, metabolic syndrome, or anorexia.

In certain embodiments of the methods, animals, cells, and kits of the present invention related to GPR88, the neurological disease or disorder is a dopamine system-related and/or striatal function-related motor function disease or disorder or other neurological disease or disorder, such as, e.g., Parkinson's disease, Huntington's disease, motor skills disorder, restless legs syndrome, other movement disorders, psychosis, schizophrenia, mania, bipolar disorder, obsessive compulsive disorder, autism spectrum disorders, attention-deficit hyperactivity disorders, dementia, mental retardation, drug abuse and addiction, other abnormal social behaviors, or other neurodevelopmental disorders.

In certain embodiments of the methods, animals, cells, and kits of the present invention related to GPR22, the neurological disease or disorder is stress, post-traumatic stress disorder (PTSD), anxiety, panic attacks, or a mood or sleep disorder.

DEFINITIONS

By "polypeptide" is meant any chain of more than two amino acids, regardless of post-translational modification such as glycosylation or phosphorylation.

By "substantially identical" is meant a polypeptide or nucleic acid exhibiting at least 50%, preferably 85%, more preferably 90%, and most preferably 95% identity to a reference amino acid or nucleic acid sequence. For polypeptides, the length of comparison sequences will generally be at least 16 amino acids, preferably at least 20 amino acids, more preferably at least 25 amino acids, and most preferably 35 amino acids or the full-length polypeptide. For nucleic acids, the length of comparison sequences will generally be at least 50 nucleotides, preferably at least 60 nucleotides, more preferably at least 75 nucleotides, and most preferably 110 nucleotides or the full-length polynucleotide.

Sequence identity is typically measured using a sequence analysis program (e.g., BLAST 2; Tatusova et al., FEMS Microbiol Lett. 174:247-250, 1999) with the default parameters specified therein.

By "high stringency conditions" is meant hybridization in 2×SSC at 40° C. with a DNA probe length of at least 40 nucleotides. For other definitions of high stringency conditions, see F. Ausubel et al., Current Protocols in Molecular Biology, pp. 6.3.1-6.3.6, John Wiley & Sons, New York, N.Y., 1994, hereby incorporated by reference. "Substantially identical" polynucleotides also include those that hybridize under high stringency conditions. "Substantially identical" polypeptides include those encoded by polynucleotides that hybridize under high stringency conditions.

By "substantially pure polypeptide" is meant a polypeptide that has been separated from the components that naturally accompany it. Typically, the polypeptide is substantially pure when it is at least 60%, by weight, free from the proteins and naturally-occurring organic molecules with which it is naturally associated. Preferably, the polypeptide is a GPCR polypeptide that is at least 75%, more preferably at least 90%, and most preferably at least 99%, by weight, pure. A substantially pure GPCR polypeptide may be obtained, for example, by extraction from a natural source (e.g., a pancreatic cell), by expression of a recombinant nucleic acid encoding a GPCR polypeptide, or by chemically synthesizing the polypeptide. Purity can be measured by any appropriate method, e.g., by column chromatography, polyacrylamide gel electrophoresis, or HPLC analysis.

A polypeptide is substantially free of naturally associated components when it is separated from those contaminants that accompany it in its natural state. Thus, a polypeptide which is chemically synthesized or produced in a cellular system different from the cell from which it naturally originates will be substantially free from its naturally associated components. Accordingly, substantially pure polypeptides include those that naturally occur in eukaryotic organisms but are synthesized in E. coli, yeast or other microbial system.

By "purified antibody" is meant antibody that is at least 60%, by weight, free from proteins and naturally occurring organic molecules with which it is naturally associated. Preferably, the preparation is at least 75%, more preferably 90%, and most preferably at least 99%, by weight, antibody. A purified antibody may be obtained, for example, by affinity chromatography using recombinantly-produced protein or conserved motif peptides and standard techniques.

By "specifically binds" is meant any small molecule, peptide, antibody, or polypeptide that recognizes and binds, for example, a huma GPCR polypeptide but does not substantially recognize and bind other molecules in a sample, e.g., a biological sample, that naturally includes the protein.

By "polymorphism" is meant that a nucleotide or nucleotide region is characterized as occurring in several different sequence forms. A "mutation" is a form of a polymorphism in which the expression level, stability, function, or biological activity of the encoded protein is substantially altered.

By "GPCR related polypeptide" is meant a polypeptide having substantial identity to any of the polypeptides listed in Table 1, including polymorphic forms (e.g., sequences having one or more SNPs) and splice variants.

By "GPCR biological activity" is meant measurable effect or change in an organism or a cell resulting from the modulation of a GPCR at the molecular, cellular, physiological or behavioral levels or alteration in the extent of activation or deactivation that can be elicited by an agonist or antagonist.

"Dominant negative" means an effect of a mutant form of a gene product that dominately interferes with the function of the normal gene product.

"Reporter system" means any gene, compound or polypeptide whose product can be assayed, measured or monitored. Examples include, but are not limited to neomycin (Kang et al., Mol. Cells; 7:502-508, 1997), luciferase (Welsh et al., Curr. Opin. Biotechnol. 8:617-622, 1997), lacZ (Spergel et al., Prog. Neurobiol. 63:673-686, 2001), aequorin (Deo et al., J. Anal. Chem. 369:258-266, 2001) and green fluorescent protein (Tsien, Annu. Rev. Biochem. 67:509-544, 1998).

"Conditional mutant" is any gene, cell or organism for which the expression of the mutant phenotype can be controlled through alteration in the temperature, diet or other external conditions.

"Overexpression" means level of expression higher than the physiological level of expression.

"Isolated" or "purified" means altered from its natural state, i.e., if it occurs in nature, it has been changed or removed from its original environment, or both. For example, a polynucleotide or a polypeptide naturally present in a living organism is not "isolated," but the same polynucleotide or polypeptide separated from the coexisting materials of its natural state is "isolated," as the term is employed herein. Moreover, a polynucleotide or polypeptide that is introduced into an organism by transformation, genetic manipulation, or by any other recombinant method is "isolated" even if it is still present in the organism.

"Polynucleotide" generally refers to any polyribonucleotide (RNA) or polydeoxribonucleotide (DNA), which may be unmodified or modified RNA or DNA. Polynucleotides include, without limitation, single- and double-stranded DNA, DNA that is a mixture of single- and double-stranded regions, single- and double-stranded RNA, and RNA that is mixture of single- and double-stranded regions, hybrid molecules comprising DNA and RNA that may be single-stranded or, more typically, double-stranded or a mixture of single- and double-stranded regions. Polynucleotide can also refer to triple helix nucleic acids.

"Variant" refers to a polynucleotide or polypeptide that differs from a reference polynucleotide or polypeptide, but retains the essential properties thereof. A typical variant of a polynucleotide differs in nucleotide sequence from the reference polynucleotide. Changes in the nucleotide sequence of the variant may or may not alter the amino acid sequence of a polypeptide encoded by the reference polynucleotide. Nucleotide changes may result in amino acid substitutions, additions, deletions, fusions and truncations in the polypeptide encoded by the reference sequence, as discussed below. A typical variant of a polypeptide differs in amino acid sequence from the reference polypeptide. Generally, alterations are limited so that the sequences of the reference polypeptide and the variant are closely similar overall and, in many regions, identical. A variant and reference polypeptide may differ in amino acid sequence by one or more substitutions, insertions, or deletions in any combination. A substituted or inserted amino acid residue may or may not be one encoded by the genetic code. Typical conservative substitutions include Gly, Ala; Val, Ile, Leu; Asp, Glu; Asn, Gln; Ser, Thr; Lys, Arg; and Phe and Tyr. A variant of a polynucleotide or polypeptide may be naturally occurring such as an allele, or it may be a variant that is not known to occur naturally. Non-naturally occurring variants of polynucleotides and polypeptides may be made by mutagenesis techniques or by direct synthesis. Also included as variants are polypeptides having one or more post-translational modifications, for instance glycosylation, phosphorylation, methylation, ADP ribosylation and the like. Embodiments include methylation of the N-terminal amino acid, phosphorylations of serines and threonines and modification of C-terminal glycines.

"Allele" refers to one of two or more alternative forms of a gene occurring at a given locus in the genome.

A "transgenic organism," as used herein, is any organism, including but not limited to animals and plants, in which one or more of the cells of the organism contains heterologous nucleic acid introduced by way of human intervention, such as by transgenic techniques well known in the art. The nucleic acid is introduced into the cell, directly or indirectly by introduction into a precursor of the cell, by way of deliberate genetic manipulation, such as by microinjection, transfection or by infection with a recombinant virus. The transgenic organisms contemplated in accordance with the present invention include mice, bacteria, cyanobacteria, fungi, plants and animals. The isolated DNA of the present invention can be introduced into the host by methods known in the art, for example infection, transfection, transformation or transconjugation.

A "transgenic mice," as used herein, is a mouse, in which one or more of the cells of the organism contains nucleic acid introduced by way of human intervention, such as by transgenic techniques well known in the art. The nucleic acid is introduced into the cell, directly or indirectly by introduction into a precursor of the cell, by way of deliberate genetic manipulation, by methods known in the art, for example microinjection, infection, transfection, or transformation.

"Transgene" is any exogenously added nucleic acid.

"Antisense" or "Reverse complement" means a nucleic acid sequence complementary to the messenger RNA.

"Single nucleotide polymorphism" or "SNP" refers to the occurrence of nucleotide variability at a single nucleotide position in the genome, within a population. An SNP may occur within a gene or within intergenic regions of the genome. SNPs can be assayed using Allele Specific Amplification (ASA). For this process, at least three primers are required. A common primer is used in reverse complement to the polymorphism being assayed. This common primer can be between 50 and 1500 bps from the polymorphic base. The other two (or more) primers are identical to each other except that the final 3' base wobbles to match one of the two (or more) alleles that make up the polymorphism. Two (or more) PCR reactions are then conducted on sample DNA, each using the common primer and one of the Allele Specific Primers.

"Splice variant" as used herein refers to cDNA molecules produced from RNA molecules initially transcribed from the same genomic DNA sequence but which have undergone alternative RNA splicing. Alternative RNA splicing occurs when a primary RNA transcript undergoes splicing, generally for the removal of introns, which results in the production of more than one distinct mRNA molecules each of which may encode different amino acid sequences. The term splice variant also refers to the polypeptides encoded by the above mRNA molecules.

"Fusion protein" refers to a polypeptide encoded by two, often unrelated, fused genes or fragments thereof.

By "candidate compound" or "test compound" is meant a chemical, be it naturally-occurring or artificially-derived, that is assayed for its ability to modulate gene activity or protein stability or binding, expression levels, or activity, by employing any standard assay method. Test compounds may include, for example, peptides, polypeptides, synthesized organic molecules, naturally occurring organic molecules, polynucleotide molecules, and components thereof.

By "promoter" is meant a minimal sequence sufficient to direct transcription. Also included in the invention are those promoter elements which are sufficient to render promoter-dependent gene expression controllable for cell type-specific, tissue-specific, temporal-specific, or inducible by external signals or agents; such elements may be located in the 5' or 3' or intron sequence regions of the native gene.

By "operably linked" is meant that a gene and one or more regulatory sequences are connected in such a way as to permit gene expression.

Other features and advantages of the invention will be apparent from the following description of the preferred embodiments thereof and from the claims.

BRIEF DESCRIPTION OF THE DRAWINGS

FIG. 5A: GPR63 in the Ammons horn (CA) regions of the hippocampus. FIG. 5B: PGR7 in the habenula. FIG. 5C: GRCA in the cortex and thalamus. FIG. 5D: GPR63 in the Purkinje cells of the cerebellum. FIG. 5E: GPR37 in the frontal cortex. FIG. 5F: GPR26 in the inferior olive. FIG. 5G: GPR50 in the cells lining the third ventricle. FIG. 5H: PGR15 in the preoptic region of the hypothalamus. Vertical lines on sagittal mouse brain drawing represent approximate coronal plane of photomicrographs. Scale bars=500 μm.

FIG. 6A. illustrates the average 24 hour activity of GPR85 wild type and knock out female mice. FIG. 6B illustrates the average 24 hour activity of GPR85 wild type and knock out male mice.

FIGS. 7A-7B. Temperature differences between GPR85 knock out and wild type mice. FIG. 7A. SIH results showing an increased body temperature change for knock out compared to wild type mice. FIG. 7B. Baseline core body temperature difference between wild type and knock out mice.

FIG. 9A. Initial sensitivity to the hypothermic effects of ethanol as measured by the difference before and 30 minutes after an i.p injection of 2.5 g/kg ethanol on two consecutive treatment days. GPR85 knock out mice display a decreased initial sensitivity to the effects of ethanol. FIG. 9B. Tolerance to the hypothermic effects of ethanol as shown by the difference in the change of core body temperature for day 1 and day 2.

FIGS. 14A and 14B are graphs demonstrating that DKO mice have reduced aggressive behavior in the resident-intruder test. Only WT and DKO, but not GPR85 KO or SREB3 KO, were tested. The total numbers of all social interactive behavior exhibited by the WT or DKO resident mice, including sniffing, tail chasing and attacking, do not differ significantly by genotype (FIG. 14A). There is a significant reduction of aggressive behavior, i.e. attacking the intruder mice, in the DKO mice (**$p<0.01$, n=16DKO, 21WT, Student's t-test, FIG. 14B).

FIGS. 15A and 15B are graphs demonstrating that aged GPR85 KO mice are also impaired in nest building. When tested at 16-18 months of age, both male (FIG. 15A) and female (FIG. 15B) GPR85 KO mice show significant impairment in building the nest at all time points examined (*$p<0.05$, $p<0.01$, *$p<0.001$, n=6-9 per group, Mann-Whitney U test).

FIGS. 17A-17D are graphs depicting GPR85 KO mice body weight and body length. Growth curves were generated by measuring the animal's weight and length every one or two weeks. Both male and female KO mice have lower body weight and length than WT, with more significant genotype difference in female mice. P values at 70 weeks are: female weight $p<0.0001$ (FIG. 17A), male weight $p=0.12$ (FIG. 17B), female length $p<0.0001$ (FIG. 17C), male length $p<0.05$ (FIG. 17D) (n=8-10 per group, Student's t-test).

FIGS. 22A-22D are graphs demonstrating that female GPR85 KO mice have lower percentage of white fat. DEXA analysis shows that KO mice have significantly lower total fat mass than WT mice (p<0.05, n=10 per group, Student's t-test, FIG. 22A). KG mice have significantly lower amount of white fat (p<0.01, FIG. 21B) but normal amount of brown fat (FIG. 21C). The percentage of white fat versus the whole body weight is also significantly lower in KO mice (p<0.01) by ~33% (FIG. 22D).

FIGS. 24A-24D demonstrate that aged male GPR85 KO mice have improved glucose tolerance. Old (16 months) male GPR85 KO mice have significantly lower fed and fasting glucose levels compared to WT mice (FIGS. 24A and 24B, *p<0.05, **p<0.01, n=7-10 per group, Student's t-test). These mice are given an insulin challenge or a glucose challenge. In the insulin challenge test (FIG. 24C), mice are fasted for 4 hours and then injected with 0.75 U/kg insulin via i.p., and blood glucose levels are measured at different time points afterwards. KO mice have significantly lower glucose levels and are slower in recovery (*p<0.05, **p<0.01). In the glucose challenge test (FIG. 24D), mice are injected with 2 g/kg glucose via i.p., and blood glucose levels are measured at different time points afterwards. KO mice are faster in clearing glucose than WT at 1 hr post injection (p<0.05).

FIGS. 28A-28D are graphs demonstrating that GPR88 KO mice are hyperactive in the open field activity test, Mice were placed in the novel chamber and their locomotor activities were monitored for 20 min. Data plotted are in 4-min bins. Compared to WT mice (n=18), the KO mice (n=18) had increased horizontal activity (p<0.05, repeated measures ANOVA, FIG. 28A), total distance traveled in the chamber (p<0.05, FIG. 28B), vertical/rearing activity (p<0.001, FIG. 28C) and stereotypy behavior (p<0.05, FIG. 28D).

FIGS. 30A and 30B are graphs demonstrating that GPR88 KO mice tend to be more sensitive to amphetamine-induced reduction of prepulse inhibition (PPI). GPR88 KO (n=20) and WT (n=21) mice in the inbred 129sv background were tested for baseline PPI, and there was no significant difference between genotypes (p>0.3, repeated measures ANOVA). Several weeks later, the mice were injected with amphetamine (2.5 mg/kg) via i.p. and tested for PPI 30 minutes later. The startle responses to the 120 dB stimulus of both WT and KO were significantly decreased after amphetamine treatment, and there was no significant difference between genotypes (p>0.5, FIG. 30A). There was significant reduction of PPI in both WT and KO after amphetamine treatment (p<0.001 for both, FIG. 30B). There was a trend of more reduction of PPI in KO than WT (p=0.091, repeated measures ANOVA).

FIGS. 31A-31B are graphs demonstrating that GPR22 knock-out (KO) mice are hypoactive and more anxious in the open field activity test. Mice were placed in the novel chamber and their locomotor activities were monitored for 20 min. Data plotted are in 4-min bins. Compared to wild type (WT) mice (n=23), the KO mice (n=27) traveled less distance during the testing period (p<0.05, repeated measures ANOVA) (FIG. 31A), and spent less time in the center arena of the chamber (p<0.05, Student's t-test)(FIG. 31B).

DETAILED DESCRIPTION OF THE INVENTION

Figure 1N:
FIGS. 1A-1O are a list of GPCR polynucleotides of the invention in human and mouse.
FIG. 1P is a diagram depicting the arrangement of FIGS. 1A-1O. Polynucleotides are divided into four classes, A, B, C, and F/S, according to conventional classification of the GPCR superfamily. The "No Class" group includes five polynucleotides that cannot be assigned to any of the above four classes. Within each class, polynucleotides are further grouped into small families based on ligand specificity or, in the case of orphan receptors, significant sequence homology (≥40%) within each family. Orphan receptors that cannot be grouped by this criterion are alphabetically listed at the end of each class. Whenever available, names are adopted from the official gene names of the NCBI LocusLink database. Orphan GPCRs are indicated with an asterisk. Abbreviations: H, human; M, mouse; FMLP, fMet-Leu-Phe; GNRH, gonadotropin-releasing hormone; PAF, platelet-activating factor; INSL3, insulin-like 3; SPC, sphingosylphosphorylcholine; LPC, lysophosphatidylcholine; TRH, thyrotropin-releasing hormone; LGR, leucinerich repeat-containing G protein-coupled receptor; SREB, super conserved receptor expressed in brain; GIP, gastric inhibitory polypeptide; GHRH, growild typeh hormone-releasing hormone; PACAP, pituitary adenylate cyclase activating polypeptide; DAF, decay accelerating factor; GPRC5, G protein-coupled receptor family C group 5.
Figure 2A:
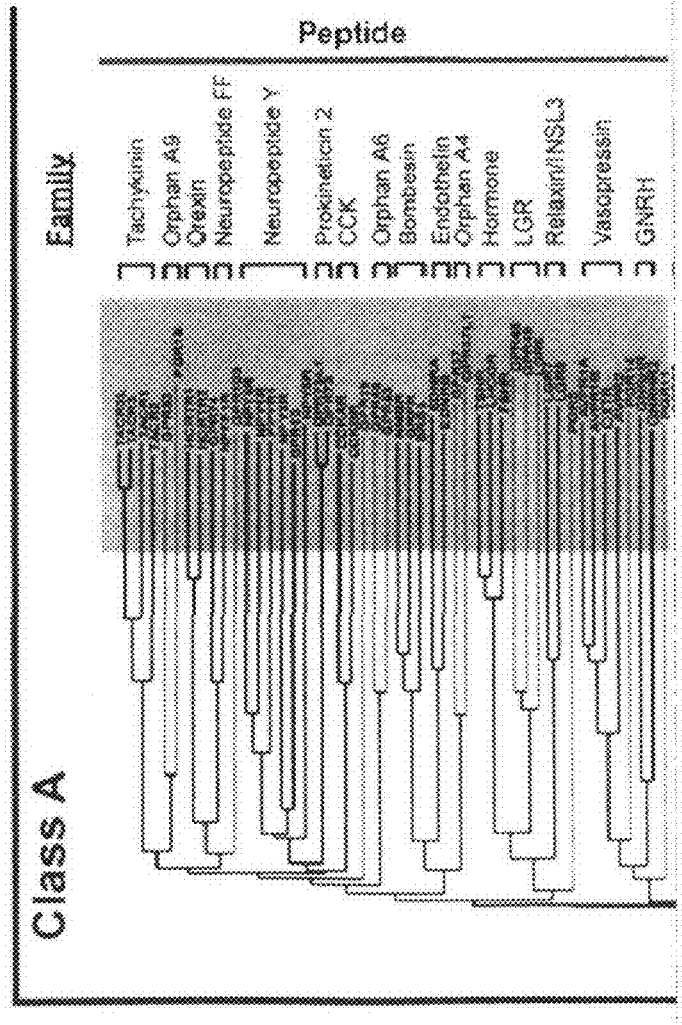
FIGS. 2A-2H are a series of phylogenetic trees of human GPCRs.
Figure 2B:
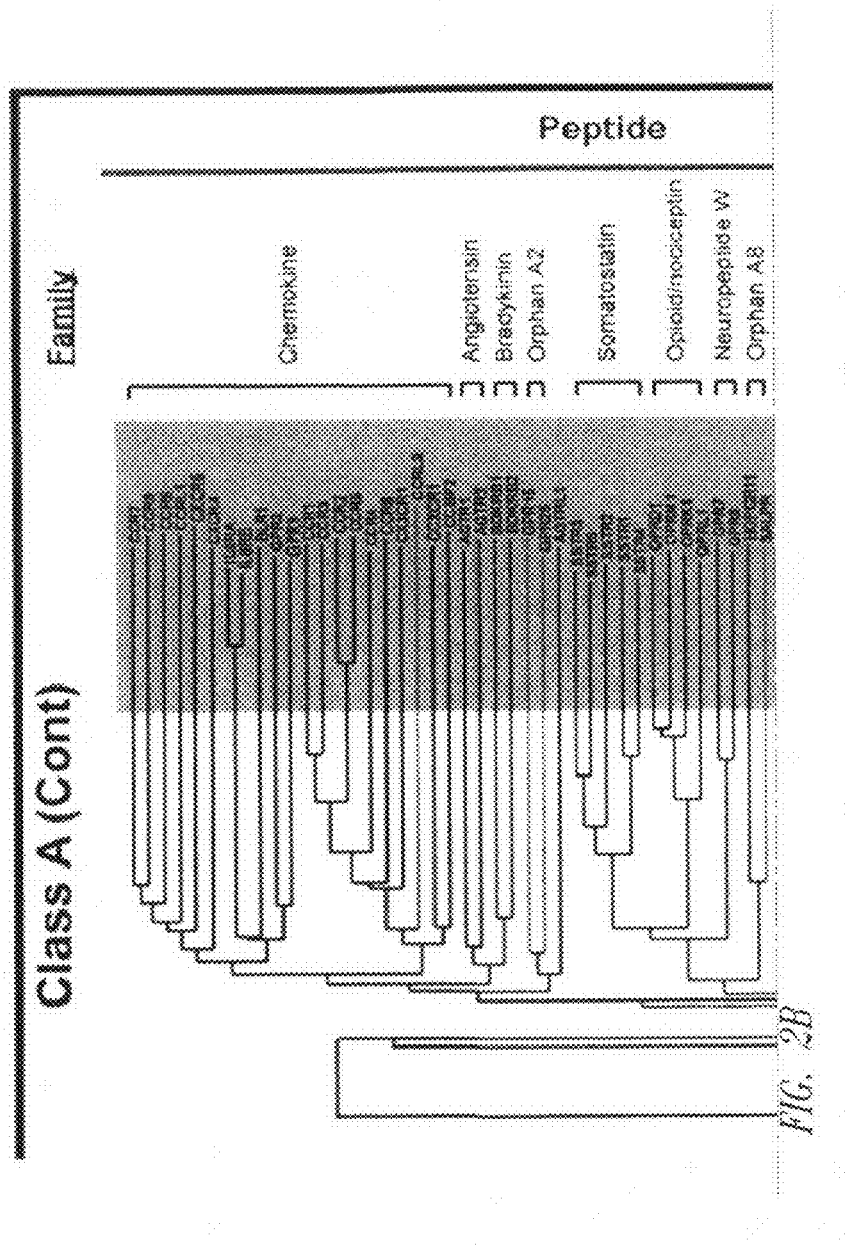
Figure 2C:
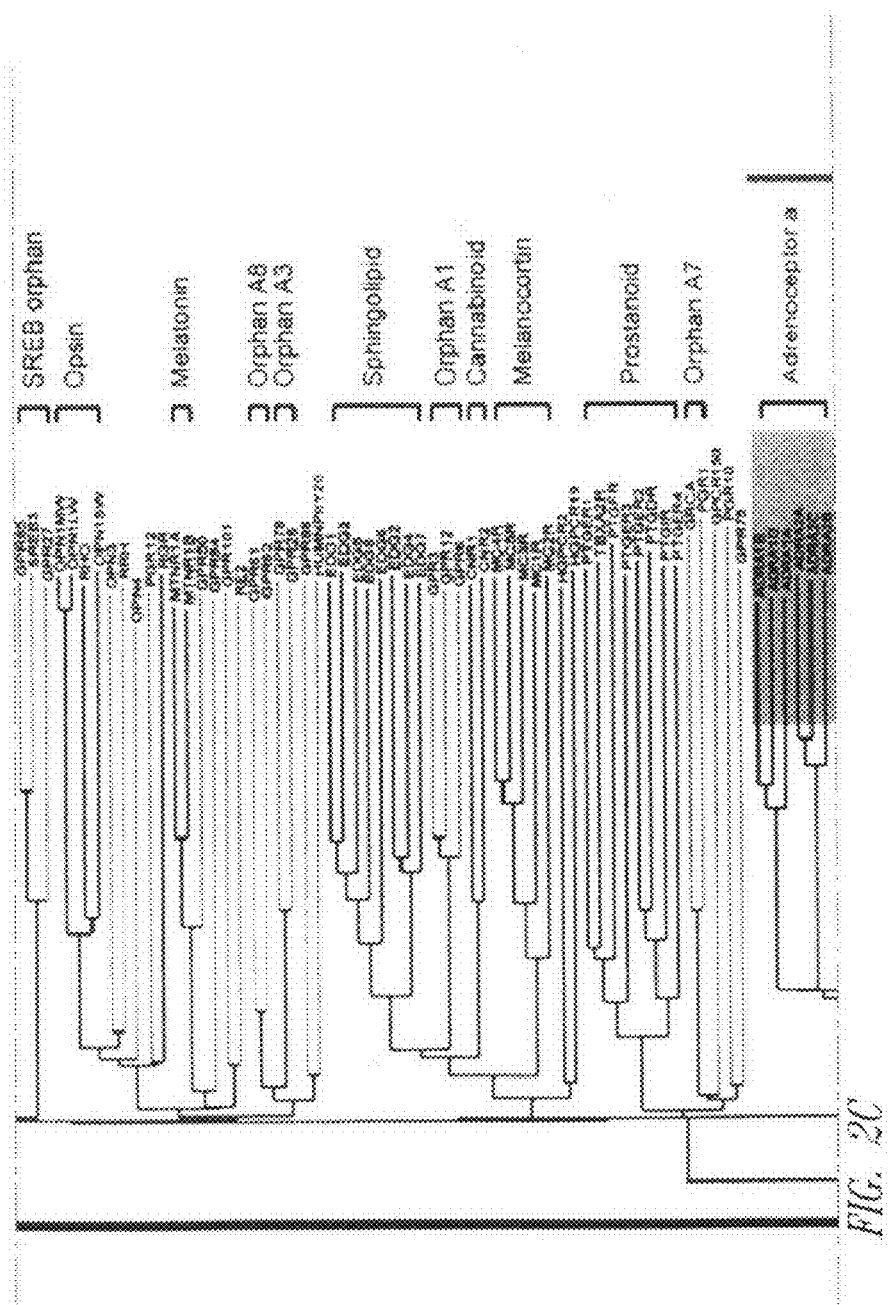
Figure 2D:
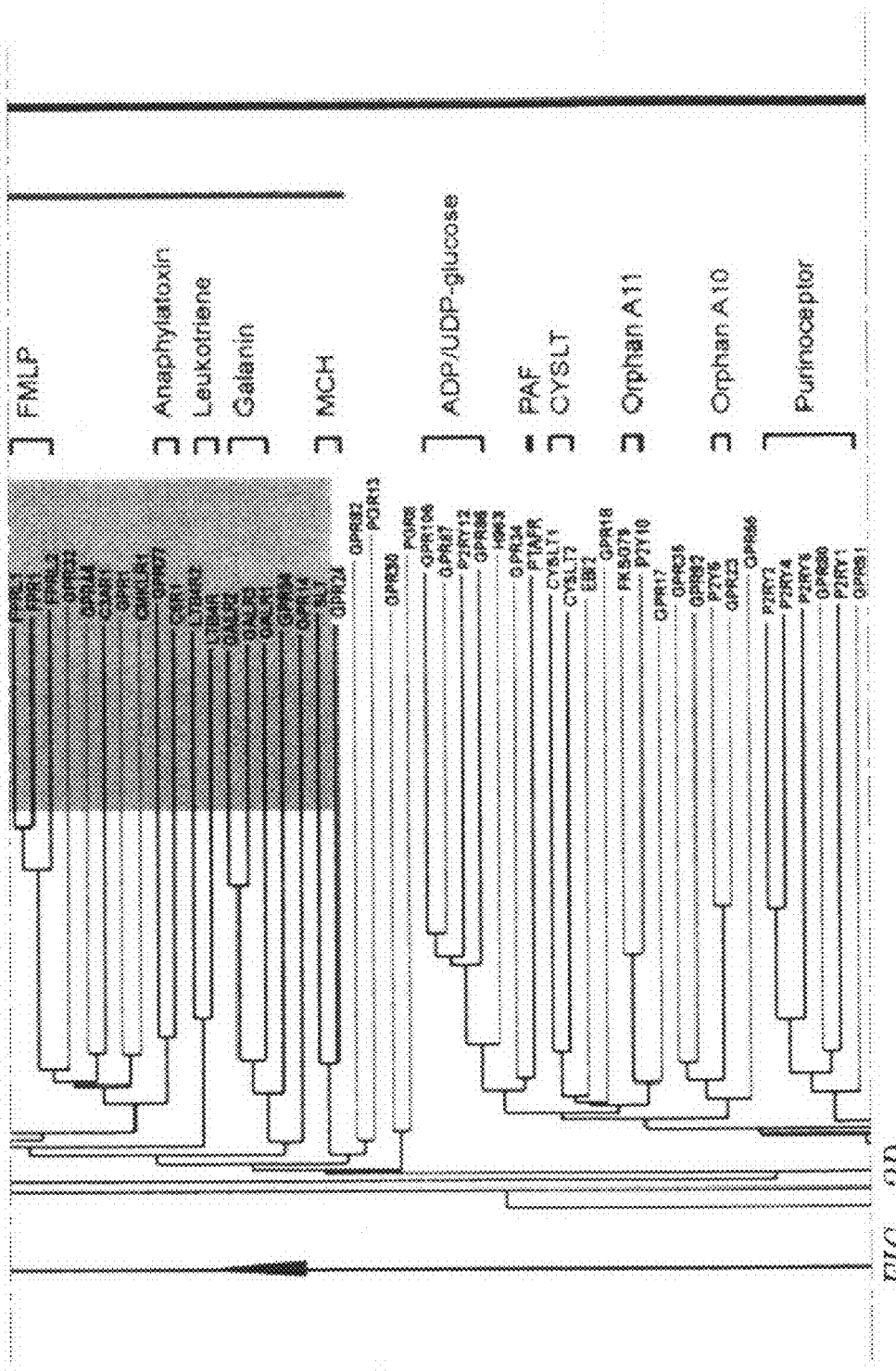
Figure 2E:
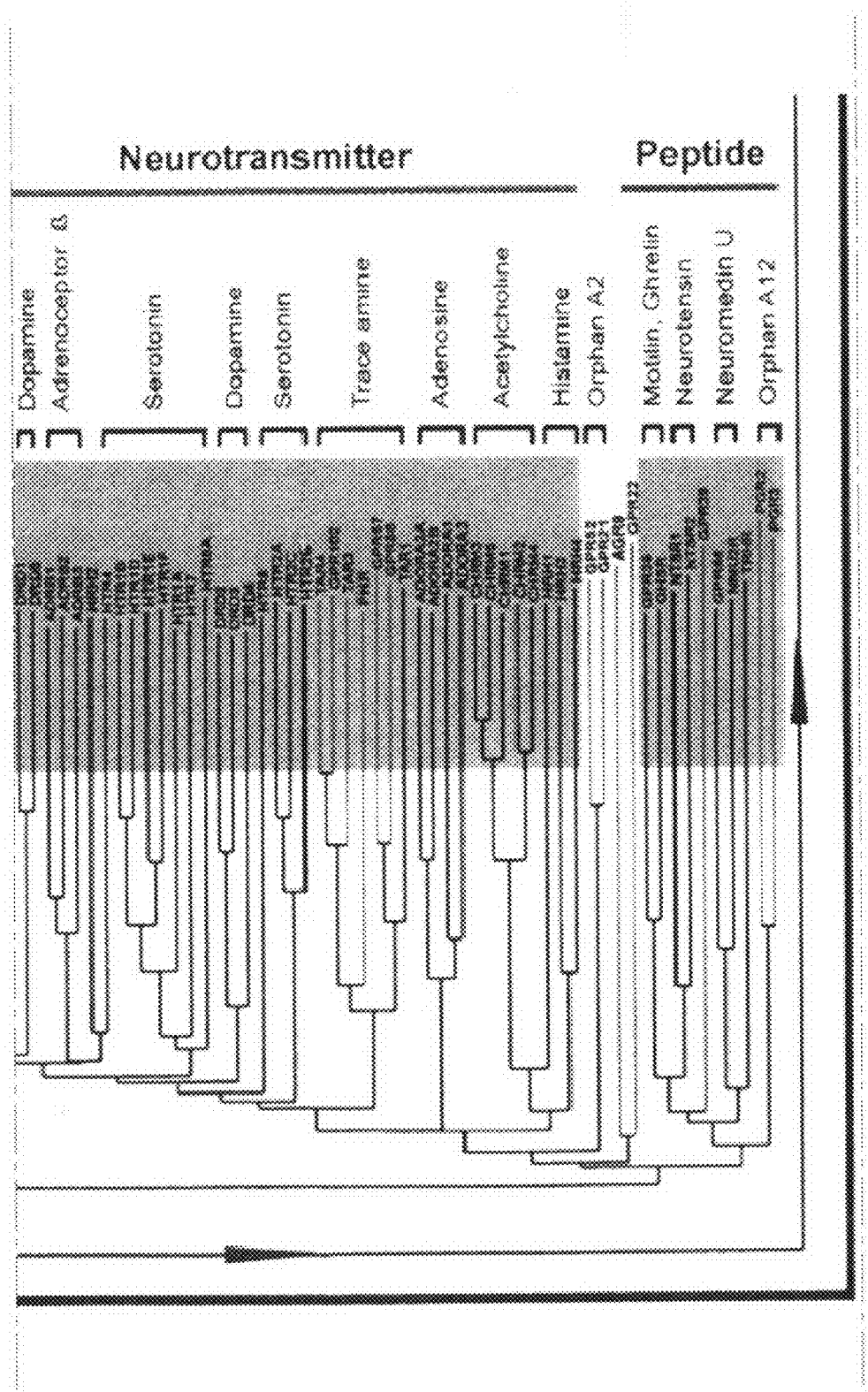
Figure 2F:
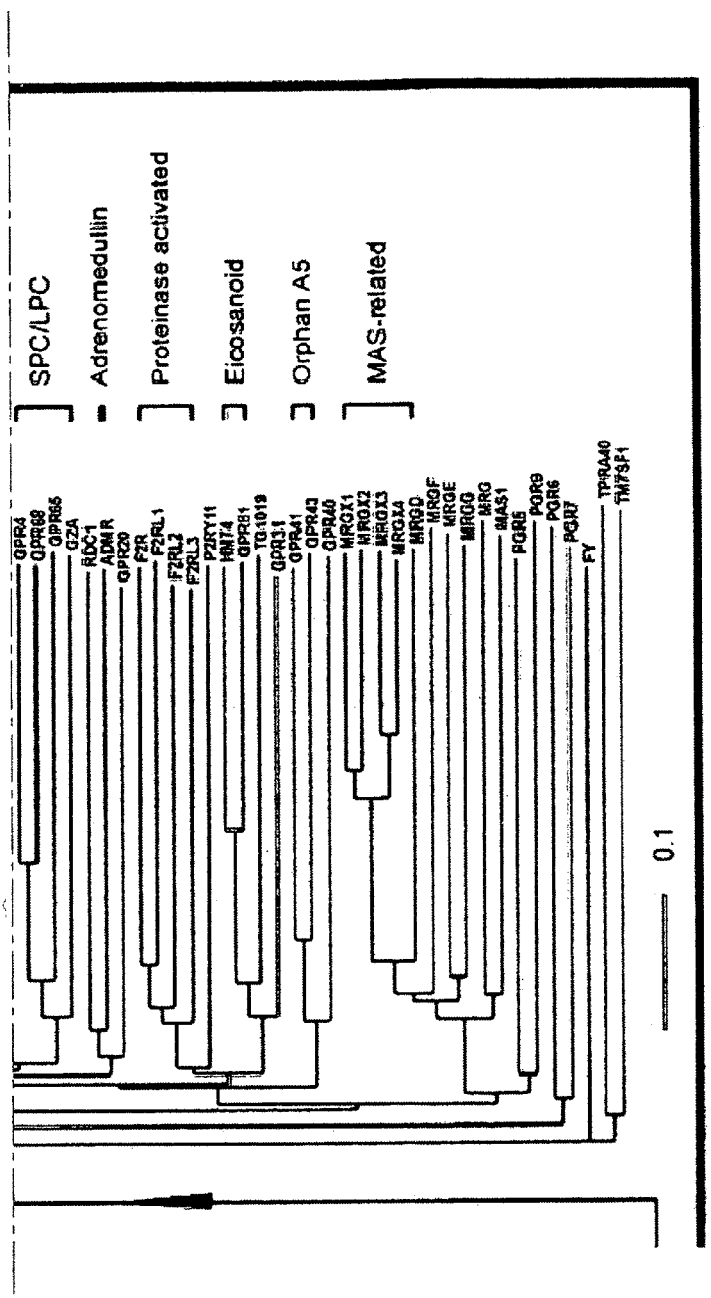
Figure 2G:
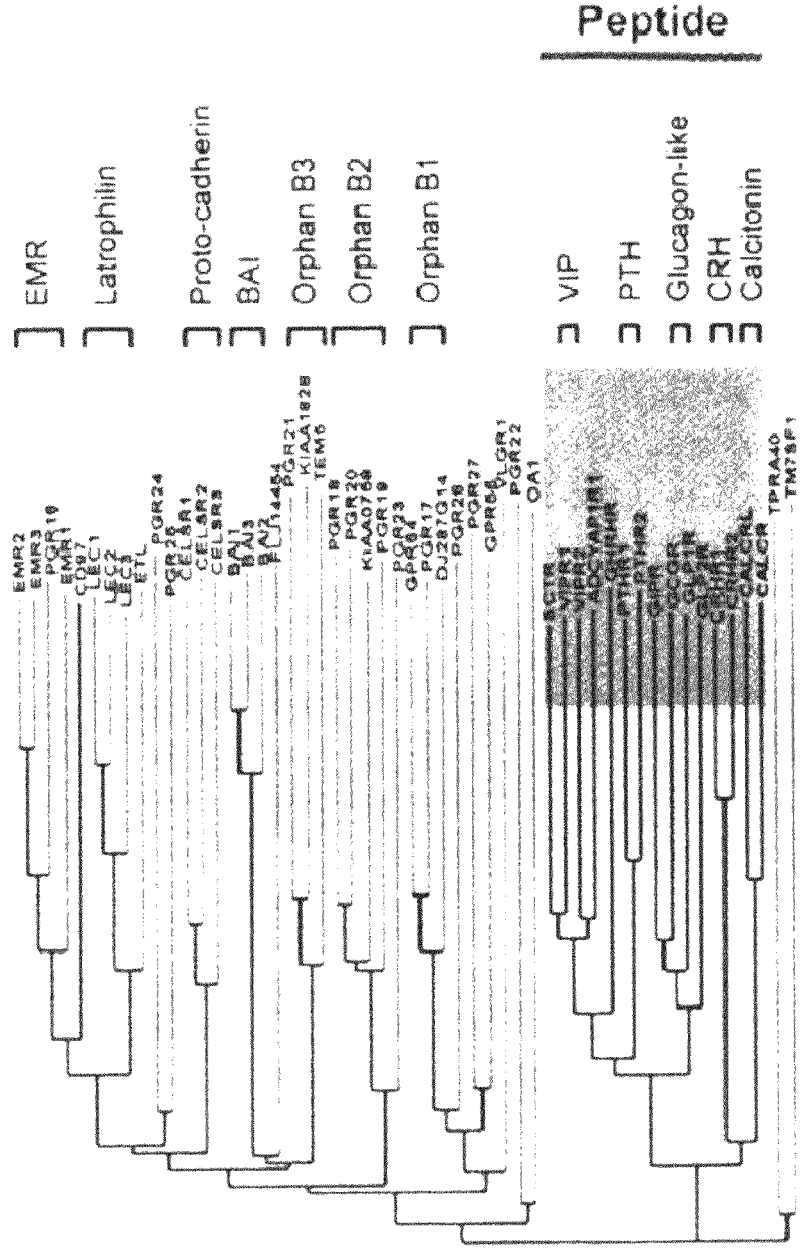
Figure 2H:
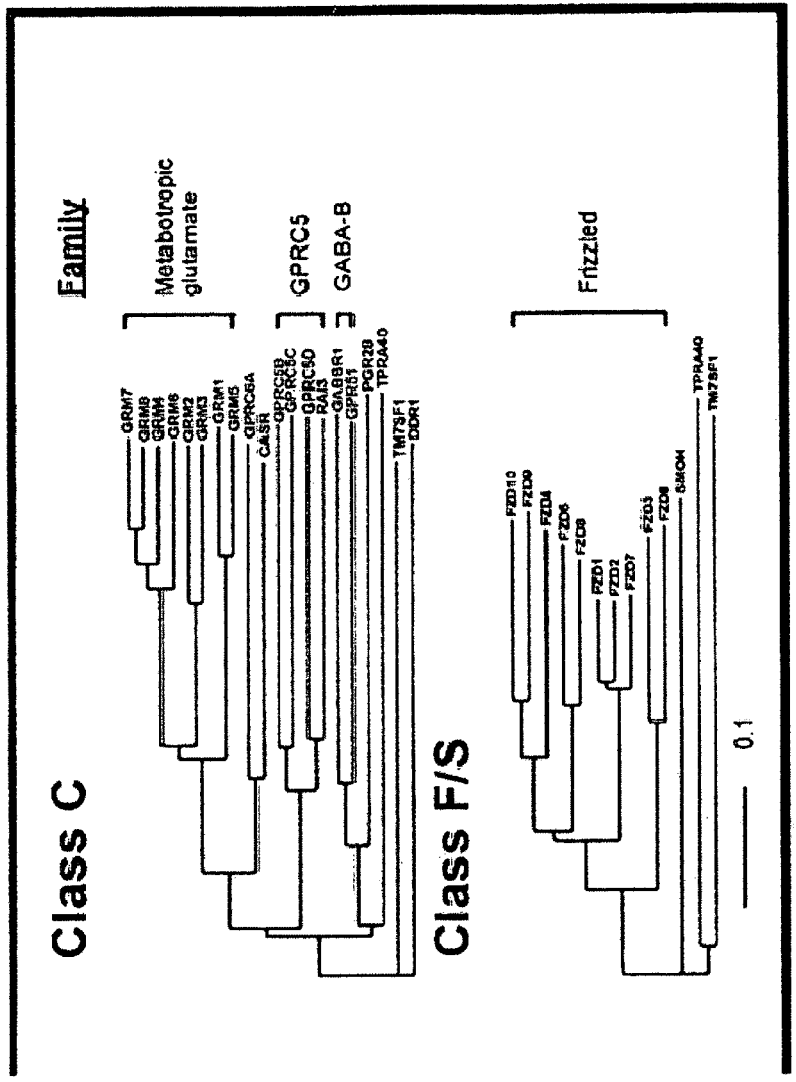
Figure 2I:
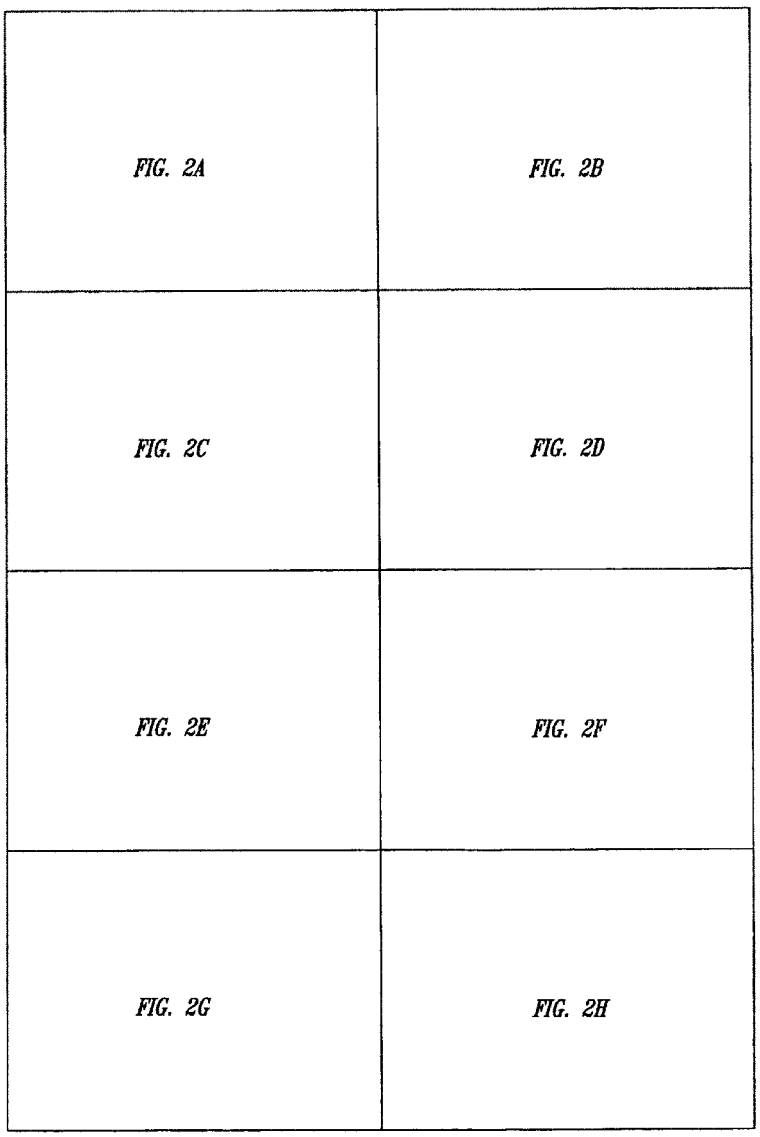
FIG. 2I is a diagram depicting the arrangement of FIGS. 2A-2H. Lines corresponding to individual polynucleotides are colored black for those with known ligands, red for orphan genes, and blue for genes with 7 trans-membrane domains but no homology to known GPCRs. The Class A tree was split into two parts due to size considerations (arrow line indicates the connection). Families are defined as described in FIGS. 1A-1O. Clusters of GPCRs with significant predictive value as to ligands are highlighted in purple on these bootstrap consensus trees (bootstrap values not shown). The ruler at the bottom of each tree indicates the horizontal distance equal to 10% sequence divergence.

G protein coupled receptors (GPCRs) include receptors for neurotransmitters, light, odors, hormones, and molecules used for communication in the immune system. GPCRs are by far the largest family of receptors known. It is believed that there are as many as 1,000 different GPCRs for odor recognition alone. The present invention is based, in part, upon the identification and characterization of novel human and mouse GPCRs.

The present invention is based, in part, on the identification of GPCRs that are expressed in the brain and associated with neurological and/or metabolic diseases and disorders, wherein said GPCRs are GPR88, GPR22, or belong to a family of polypeptides called SREBs (Super-Conserved Receptors Expressed in Brain), and have a polypeptide sequence set forth in any one of SEQ ID NOs: 552, 488, 243, 558, and 484. These sequences correspond to SREBs termed GPR85 (SREB2), GPR27 (SREB1), and GPR173 (SREB3), GPR88, and GPR22, respectively. The polynucleotide sequences of GPR85, SREB1, SREB3, GPR88, and GPR22 are provided in SEQ ID NO:s 1046, 1014, 894, 1049, and 1012, respectively. The sequences of the mouse polypeptide and polynucleotide homologs are provided in SEQ ID NOs: 553 and 1337 (mouse GPR85 polypeptide and polynucleotide), SEQ ID NOs:489 and 1305 (mouse SREB1 polypeptide and polynucleotide), SEQ ID NOs:244 and 245 (mouse SREB3 polypeptide and polynucleotide), SEQ ID NOs:559 and 1340 (mouse GPR88 polypeptide and polynucleotide), and SEQ ID NOs:485 and 1303 (mouse GPR22 polypeptide and polynucleotide. All of these sequences are included within the full scope of the present invention.

The SREB family of GPCRs is extraordinarily conserved among vertebrate species. The SREB family consists of at least three members, termed SREB1, SREB2, and SREB3. SREB members share 52-63% amino acid identity with each other and show some similarity to previously known rhodopsin-like GPCRs. Amino acid sequence identity between human and rat orthologues is 97% for SREB1 and 99% for SREB3, while the SREB2 sequence is surprisingly completely identical between the species. Furthermore, amino acid sequence of zebrafish SREB2 and SREB3 are 94 and 78% identical to mammal orthologues, respectively. Northern blot analysis revealed that SREB members are predominantly expressed in the brain regions and genital organs. Radiation hybrid analysis localized SREB1, SREB2, and SREB3 genes to different human chromosomes, namely 3p21-p14, 7q31 and Xp11, respectively. The high sequence conservation and abundant expression in the central nervous system suggest that SREBs play fundamental roles in the nervous system.

As described in US Patent Application Publication No. US 2006/0134109, SREB polynucleotides and/or polypeptides are expressed in a variety of neurological tissues, including, hypothalamus, amygdalae, pituitary, female brain, male brain, brainstem, cerebellum, cortex, frontal cortex, hippocampus, striatum, and thalamus. According to the present invention, it has now been found that disruption of two or more SREBs, e.g., GPR85 and SREB3, in mice leads to increased neurological abnormalities, thereby demonstrating that SREBs play a fundamental role in these biological processes underlying these neurological conditions. In addition, disruption of GPR85, alone or in combination with a disruption in a second SREB, resulted in lower body weight and improved glucose tolerance, suggesting that SREBs also play a role in metabolic diseases and disorder, such as obesity and diabetes. These results further suggest that the SREBs may play overlapping or redundant roles in the nervous and metabolic systems and that modulating the activity of expression of two or more SREBs may be used to treat associated neurological and metabolic diseases and disorders.

Accordingly, the present invention includes methods of modulating the biological activity or expression of one or more SREBs, which are useful in treating neurological and metabolic diseases and disorders. The present invention provides modulators of one or more SREBs, pharmaceutical compositions comprising modulators of one or more SREBs, and methods of use thereof to treat or prevent neurological and metabolic diseases. In addition, given the association between SREBs and neurological and metabolic diseases and disorders, the present invention further includes methods of diagnosing or detecting neurological and metabolic diseases or disorders based upon detecting mutations in one or more SREB genes, or alterations in the biological activity or expression of one or more SREBs as compared to normal.

In various embodiments, methods and compounds of the present invention may be used to modulate one of the three SREBs described herein, while in other embodiments, methods and compounds of the present invention are used to modulate two more more, e.g., two or three, of the SREBs. These methods may employ two or more different modulators, each targeting one or more different SREBs. However, given the high degree of sequence similarity between the SREBs, the present invention also contemplates using one modulator having the ability to modulate two or more SREBs. For example, such a modulator may be an antibody that binds to a conserved extracellular region of SREB1 and SREB2, SREB1 and SREB3, SREB2 and SREB3, or SREB1, SREB2, and SREB3.

The present invention is based, in part, on the identification that GPR88 is expressed in the brain and associated with neurological diseases and disorders. As described in US Patent Application Publication No. US 2006/0134109, GPR88 polynucleotides and/or polypeptides are expressed in a variety of neurological tissues, including, hypothalamus, amygdale, female brain, male brain, brainstem, cortex, frontal cortex, hippocampus, striatum, and thalamus. According to the present invention, it has now been found that GPR88 is anatomically and functionally involved with the dopamine system and striatal function, thereby suggesting that deregulation of GPR88 expression or activity is associated with a variety of dopamine system- or striatal function-related motor function disease or disorder or other neurological disease or disorder, such as, e.g., Parkinson's disease, Huntington's disease, motor skills disorder, restless legs syndrome, other movement disorders, psychosis, schizophrenia, mania, bipolar disorder, obsessive compulsive disorder, autism spectrum disorders, attention-deficit hyperactivity disorders, dementia, mental retardation, drug abuse and addiction, other abnormal social behaviors, or other neurodevelopmental disease or disorder.

Accordingly, the present invention includes methods of modulating the biological activity or expression of GPR88, which are useful in treating neurological diseases and disorders, including dopamine system or striatal function-related motor function disease or disorder or other neurological disease or disorder, such as, e.g., Parkinson's disease, Huntington's disease, motor skills disorder, restless legs syndrome, other movement disorders, psychosis, schizophrenia, mania, bipolar disorder, obsessive compulsive disorder, autism spectrum disorders, attention-deficit hyperactivity disorders, dementia, mental retardation, drug abuse and addiction, other abnormal social behaviors, or other neurodevelopmental disease or disorder. The present invention provides modulators of GPR88, pharmaceutical compositions comprising modulators of GPR88, and methods of use thereof to treat or prevent neurological diseases. In addition, given the association between GPR88 and neurological diseases and disorders, the present invention further includes methods of diagnosing or detecting neurological diseases or disorders based upon detecting mutations in the GPR88 gene, or alterations in the biological activity or expression of GPR88 as compared to normal.

The present invention is based, in part, on the identification that GPR22 is expressed in the brain and associated with neurological diseases and disorders, including stress, post-traumatic stress disorder (PTSD), anxiety, panic attacks, or a mood or sleep disorder. As described in US Patent Application Publication No. US 2006/0134109, GPR22 polynucleotides and/or polypeptides are expressed in a variety of neurological tissues, including, hypothalamus, amygdala, pituitary, female brain, male brain, brainstem, cerebellum, cortex, frontal cortex, hippocampus, striatum, and thalamus. According to the present invention, it has now been found that disruption of GPR22 in mice leads to increased anxiety and stress, thereby demonstrating that GPR22 plays a fundamental role in the biological processes underlying these neurological conditions.

Accordingly, the present invention includes methods of modulating the biological activity or expression of GPR22, which are useful in treating neurological diseases and disorders, including stress, post-traumatic stress disorder (PTSD), anxiety, panic attacks, and mood or sleep disorders. The present invention provides modulators of GPR22, pharmaceutical compositions comprising modulators of GPR22, and methods of use thereof to treat or prevent neurological diseases. In addition, given the association between GPR22 and neurological diseases and disorders, the present invention further includes methods of diagnosing or detecting neurological diseases or disorders based upon detecting mutations in the GPR22 gene, or alterations in the biological activity or expression of GPR22 as compared to normal.

Methods of Treating and Preventing Neurological and Metabolic Diseases and Disorders The present invention provides methods of treating or preventing a disease or disorder by modulating the activity or expression of a GPCR normally expressed in a tissue associated with the disease or disorder, including those tissues and associated diseases an disorders described herein.

In certain embodiment, the present invention includes methods of modulating the biological activity or expression of one or more SREBs, which methods may be used to treat or prevent a disease or disorder, including any one of those described herein. In particular embodiments, the neurological disease or disorder is psychosis, schizophrenia, mania, bipolar disorder, obsessive compulsive disorders, autism spectrum disorders, attention-deficit hyperactivity disorders, dementia, mental retardation, other abnormal social behaviors, or other neurodevelopmental disorders. In certain embodiments, the metabolic disease is obesity, diabetes, metabolic syndrome, or anorexia. In particular embodiments, these methods comprise modulating the biological activity or expression of two or more SREBs. In one embodiment, the methods comprise modulating the biological activity of GRCR85 and SREB1, or GPCR85 and SREB3.

The present invention also includes methods of modulating the biological activity or expression of GPR88, which methods may be used to treat or prevent a neurological condition, including any of those described in U.S. Patent Application Publication No. US2006/0134109. In particular embodiments, the neurological disease or disorder is a dopamine system- or striatal function-related motor function disease or disorder or other neurological disease or disorder, such as, e.g., Parkinson's disease, Huntington's disease, motor skills disorder, restless legs syndrome, other movement disorders, psychosis, schizophrenia, mania, bipolar disorder, obsessive compulsive disorder, autism spectrum disorders, attention-deficit hyperactivity disorders, dementia, mental retardation, drug abuse and addiction, other abnormal social behaviors, or other neurodevelopmental disease or disorder.

The present invention includes methods of modulating the biological activity or expression of GPR22, which methods may be used to treat or prevent a neurological condition. In particular embodiments, the neurological disease or disorder is stress, post-traumatic stress disorder (PTSD), anxiety, panic attacks, or a mood or sleep disorder.

In various embodiments, methods or modulating the biological activity or expression of a GPCR, e.g., one or more SREBs, GPR88, or GPR22, include either increasing the activity or expression of a GPCR or decreasing the activity or expression of a GPCR. This may be accomplished genetically, e.g., by introducing a GPCR transgene into a cell or animal or by mutating or disrupting genes encoding A GPCR in a cell or animal. This may also be accomplished using one or more compounds that bind to GPCR polypeptides or polynucleotides, or bind to another molecule that regulates the expression or activity or a GPCR, e.g., compounds that bind to a GPCR ligand or a transcriptional repressor that binds the promoter of a GPCR gene. Accordingly, the methods of the present invention may directly affect the activity or expression of a GPCR, or they may indirectly affect the activity or expression of a GPCR. In particular embodiments, wherein the activity of more than one SREB is modulated, these methods are practiced using more than one agent, each which modulates a particular SEB being modulated.

Methods that involve increasing the expression or activity of one or more GPCRs are particularly useful in treating or preventing disease states or conditions characterized by insufficient GPCR signaling (e.g., as a result of insufficient activity of one or more GPCR ligands). Methods that involve decreasing the expression or activity of one or more GPCRs are particularly useful in treating or preventing disease states or conditions characterized by excessive GPCR signaling. These methods may involve administering a compound that modulates one or more GPCRs, wherein the compound is either an agonist or antagonist of one or more GPCRs to a cell or patient.

In one embodiment, the present invention includes a method of treating or preventing a neurological or metabolic disease or disorder in a mammal, comprising administering one or more polynucleotides that encode a GPCR, or a functional variant or fragment thereof, to said mammal, wherein said polynucleotides are expressed in said mammal. In certain embodiments, the polynucleotide is an expression vector, and in other embodiments, the polynucleotide is a transgene. In particular embodiments, a neurological or metabolic disease is treated or prevented by administering one or more polynucleotides that encode a SREB. In particular embodiments, a neurological or metabolic disease is treated or prevented by administering two or more polynucleotides that encode polypeptides selected from SREB1, SREB2, and SREB3. In other embodiments, a neurological disease is treated or prevented by administered a polynucleotide that encodes GPR88 or GPR22.

In another embodiment, the present invention includes a method of treating or preventing a neurological or metabolic disease or disorder in a mammal, comprising administering one or more GPCR polypeptides, or a functional variant or fragment thereof, to said mammal. In particular embodiments, a neurological or metabolic disease is treated or prevented by administering one or more SREB polypeptides. In particular embodiments, a neurological or metabolic disease is treated or prevented by administering two or more polypeptides selected from SREB1, SREB2, and SREB3. In other embodiments, a neurological disease is treated or prevented by administered a GPR88 or GPR22 polypeptide.

In one embodiment, the present invention includes a method of treating or preventing a neurological or metabolic disease or disorder in a mammal, comprising administering one or more polynucleotides comprising a sequence identical to a region of a SREB polynucleotide sequence set forth in any one of SEQ ID NOs:2, 4, or 6 or a complement thereof, to said mammal, wherein said polynucleotide inhibits expression of one or more SREBs. In certain embodiments, the polynucleotide is an expression vector, and in particular embodiments, the polynucleotide is an antisense RNA, an RNAi molecule, or a ribozyme.

In one embodiment, the present invention includes a method of treating or preventing a neurological disease or disorder in a mammal, comprising administering a polynucleotide comprising a sequence identical to a region of the GPR88 polynucleotide sequence set forth in SEQ ID NO:2 or a complement thereof, to said mammal, wherein said polynucleotide inhibits expression of GPR88. In certain embodiments, the polynucleotide is an expression vector, and in particular embodiments, the polynucleotide is an antisense RNA, an RNAi molecule, or a ribozyme.

In one embodiment, the present invention includes a method of treating or preventing a neurological disease or disorder in a mammal, comprising administering a polynucleotide comprising a sequence identical to a region of the GPR22 polynucleotide sequence set forth in SEQ ID NO:2 or a complement thereof, to said mammal, wherein said polynucleotide inhibits expression of GPR22. In certain embodiments, the polynucleotide is an expression vector, and in particular embodiments, the polynucleotide is an antisense RNA, an RNAi molecule, or a ribozyme.

In another embodiment, the present invention includes a method of treating or preventing a neurological or metabolic disease or disorder in a mammal, comprising administering one or more antibodies that specifically bind to a SREB polypeptide having the sequence set forth in any one of SEQ ID NOs: 1, 3, or 5 to said mammal. In one embodiment, the antibodies inhibit a biological activity of a SREB, while in another embodiment, the antibodies increase a biological activity of a SREB.

In another embodiment, the present invention includes a method of treating or preventing a neurological disease or disorder in a mammal, comprising administering an antibody that specifically binds to the GPR88 polypeptide having the sequence set forth in SEQ ID NO:1 to said mammal. In one embodiment, the antibody inhibits a biological activity of GPR88, while in another embodiment, the antibody increases a biological activity of GPR88.

In another embodiment, the present invention includes a method of treating or preventing a neurological disease or disorder in a mammal, comprising administering an antibody that specifically binds to the GPR22 polypeptide having the sequence set forth in SEQ ID NO:1 to said mammal. In one embodiment, the antibody inhibits a biological activity of GPR22, while in another embodiment, the antibody increases a biological activity of GPR22.

The present invention further includes a method of treating or preventing a neurological or metabolic disease or disorder in a mammal, comprising administering one or more small molecules that specifically binds to a SREB polypeptide having the sequence set forth in any one of SEQ ID NOs: 1, 3, or 5 to said mammal. In one embodiment, the small molecule inhibits a biological activity of a SREB, while in another embodiment, the small molecule increases a biological activity of a SREB.

The present invention further includes a method of treating or preventing a neurological disease or disorder in a mammal, comprising administering a small molecule that specifically binds to the GPR88 polypeptide having the sequence set forth in SEQ ID NO:1 to said mammal. In one embodiment, the small molecule inhibits a biological activity of GPR88, while in another embodiment, the small molecule increases a biological activity of GPR88.

The present invention further includes a method of treating or preventing a neurological disease or disorder in a mammal, comprising administering a small molecule that specifically binds to the GPR22 polypeptide having the sequence set forth in SEQ ID NO:1 to said mammal. In one embodiment, the small molecule inhibits a biological activity of GPR22, while in another embodiment, the small molecule increases a biological activity of GPR22.

These methods may be readily adapted for use of any compound that modulates a biological activity or expression of a GPCR, including those specifically described herein. In certain embodiments, two or more compounds that modulate a GPCR, e.g., an SREB, are administered simultaneously or sequentially. These two or more compounds may modulate the same of different GPCRs, e.g., SREBs.

The methods of the present invention may be used to treat or prevent a variety of neurological or metabolic diseases and disorders in an animal. Thus, the present invention provide methods of treating or preventing a neurological or metabolic disease or disorder in an animal, comprising administering to the animal one or more compounds that modulate one or more GPCRs' biological activity or expression. In various embodiments, the compounds increase the expression or activity of one or more GPCRs, while in other embodiments, they decrease the expression or activity of one or more GPCRs. In particular embodiments, the animal is a mammal, and in one embodiment, the animal is a human. The animal may be diagnosed with or considered at risk of developing a neurological or metabolic disease or disorder. Neurological or metabolic diseases and disorders that may be treated or prevented include, but are not limited to, those described herein.

Compounds of the invention may be administered in a pharmaceutical composition. Pharmaceutical compositions of the present invention comprise one or more compounds that modulate the expression or activity of one or more GPCrs and a pharmaceutically-acceptable diluent, carrier, or excipient. Pharmaceutical compositions may be administered in unit dosage form.

Any appropriate route of administration may be employed, for example, parenteral, subcutaneous, intramuscular, intracranial, intraorbital, ophthalmic, intraventricular, intracapsular, intraarticular, intraspinal, intracisternal, intraperitoneal, intranasal, aerosol, or oral administration. Examples of specific routes of administration include parenteral, e.g., intravenous, intradermal, subcutaneous, oral (e.g., inhalation), transdermal (topical), transmucosal, and rectal administration.

Conventional pharmaceutical practice may be employed to provide suitable formulations or compositions to administer such compositions to patients. Methods well known in the art for making pharmaceutical compositions and formulations are found in, for example, Remington: The Science and Practice of Pharmacy, (20th ed.) ed. A. R. Gennaro A R., 2000, Lippincott: Philadelphia. Formulations for parenteral administration may, for example, contain excipients, sterile water, or saline, polyalkylene glycols such as polyethylene glycol, oils of vegetable origin, or hydrogenated napthalenes. Biocompatible, biodegradable lactide polymer, lactide/glycolide copolymer, or polyoxyethylene-polyoxypropylene copolymers may be used to control the release of the compounds. Other potentially useful parenteral delivery systems for compounds of the invention include ethylenevinyl acetate copolymer particles, osmotic pumps, implantable infusion systems, and liposomes. Formulations for inhalation may contain excipients, or example, lactose, or may be aqueous solutions containing, for example, polyoxyethylene-9-lauryl ether, glycocholate and deoxycholate, or may be oily solutions for administration in the form of nasal drops, or as a gel.

Therapeutic formulations may be in the form of liquid solutions or suspension; for oral administration, formulations may be in the form of tablets or capsules; and for intranasal formulations, in the form of powders, nasal drops, or aerosols. Solutions or suspensions used for parenteral, intradermal, or subcutaneous application can include the following components: a sterile diluent such as water for injection, saline solution, fixed oils, polyethylene glycols, glycerine, propylene glycol or other synthetic solvents; antibacterial agents such as benzyl alcohol or methyl parabens; antioxidants such as ascorbic acid or sodium bisulfite; chelating agents such as ethylenediaminetetraacetic acid; buffers such as acetates, citrates or phosphates and agents for the adjustment of tonicity such as sodium chloride or dextrose. The pH can be adjusted with acids or bases, such as hydrochloric acid or sodium hydroxide. The parenteral preparation can be enclosed in ampoules, disposable syringes or multiple dose vials made of glass or plastic.

Pharmaceutical compositions suitable for injectable use include sterile aqueous solutions (where water soluble) or dispersions and sterile powders for the extemporaneous preparation of sterile injectable solutions or dispersion. For intravenous administration, suitable carriers include physiological saline, bacteriostatic water, Cremophor ELTM (BASF, Parsippany, N.J.) or phosphate buffered saline (PBS).

The composition should be sterile and should be fluid to the extent that easy syringability exists. It should be stable under the conditions of manufacture and storage and should be preserved against the contaminating action of microorganisms such as bacteria and fungi. The carrier can be a solvent or dispersion medium containing, for example, water, ethanol, polyol (for example, glycerol, propylene glycol, and liquid polyetheylene glycol, and the like), and suitable mixtures thereof. The proper fluidity can be maintained, for example, by the use of a coating such as lecithin, by the maintenance of the required particle size in the case of dispersion and by the use of surfactants. Prevention of the action of microorganisms can be achieved by various antibacterial and antifungal agents, for example, parabens, chlorobutanol, phenol, ascorbic acid, thimerosal, and the like. In many cases, it will be preferable to include isotonic agents, for example, sugars, polyalcohols such as manitol, sorbitol, sodium chloride in the composition. Prolonged absorption of the injectable compositions can be brought about by including in the composition an agent which delays absorption, for example, aluminum monostearate and gelatin.

Sterile injectable solutions can be prepared by incorporating the active compound in the required amount in an appropriate solvent with one or a combination of ingredients enumerated above, as required, followed by filtered sterilization. Generally, dispersions are prepared by incorporating the active compound into a sterile vehicle which contains a basic dispersion medium and the required other ingredients from those enumerated above. In the case of sterile powders for the preparation of sterile injectable solutions, the preferred methods of preparation are vacuum drying and freeze-drying which yields a powder of the active ingredient plus any additional desired ingredient from a previously sterile-filtered solution thereof.

Oral compositions generally include an inert diluent or an edible carrier. They can be enclosed in gelatin capsules or compressed into tablets. For the purpose of oral therapeutic administration, the active compound can be incorporated with excipients and used in the form of tablets, troches, or capsules. Oral compositions can also be prepared using a fluid carrier for use as a mouthwash, wherein the compound in the fluid carrier is applied orally and swished and expectorated or swallowed. Pharmaceutically compatible binding agents, and/or adjuvant materials can be included as part of the composition. The tablets, pills, capsules, troches and the like can contain any of the following ingredients, or compounds of a similar nature: a binder such as microcrystalline cellulose, gum tragacanth or gelatin; an excipient such as starch or lactose, a disintegrating agent such as alginic acid, Primogel, or corn starch; a lubricant such as magnesium stearate or Sterotes; a glidant such as colloidal silicon dioxide; a sweetening agent such as sucrose or saccharin; or a flavoring agent such as peppermint, methyl salicylate, or orange flavoring.

For administration by inhalation, the compounds may be delivered in the form of an aerosol spray from pressured container or dispenser which contains a suitable propellant, e.g., a gas such as carbon dioxide, or a nebulizer.

Systemic administration can also be by transmucosal or transdermal means. For transmucosal or transdermal administration, penetrants appropriate to the barrier to be permeated are used in the formulation. Such penetrants are generally known in the art, and include, for example, for transmucosal administration, detergents, bile salts, and fusidic acid derivatives. Transmucosal administration can be accomplished through the use of nasal sprays or suppositories. For transdermal administration, the active compounds are formulated into ointments, salves, gels, or creams as generally known in the art.

The compounds can also be prepared in the form of suppositories (e.g., with conventional suppository bases such as cocoa butter and other glycerides) or retention enemas for rectal delivery. In one embodiment, the active compounds are prepared with carriers that will protect the compound against rapid elimination from the body, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, and polylactic acid.

Liposomal suspensions (including liposomes targeted to specific cell types) can also be used as pharmaceutically acceptable carriers. A variety of liposomal formulations suitable for delivering a compound to an animal have been described and demonstrated to be effective in delivering a variety of compound, including, e.g., small molecules, nucleic acids, and polypeptides.

It may be advantageous to formulate oral or parenteral compositions in dosage unit form for ease of administration and uniformity of dosage. Dosage unit form as used herein refers to physically discrete units suited as unitary dosages for the subject to be treated; each unit containing a predetermined quantity of active compound calculated to produce the desired therapeutic effect in association with the required pharmaceutical carrier. Depending on the type and severity of the disease, about 1 ug/kg to 15 mg/kg (e.g., 0.1 to 20 mg/kg) of antibody is an initial candidate dosage for administration to the patient, whether, for example, by one or more separate administrations, or by continuous infusion. A typical daily dosage might range from about 1 µg/kg to 100 mg/kg or more, depending on the factors mentioned above. For repeated administrations over several days or longer, depending on the condition, the treatment is sustained until a desired suppression of disease symptoms occurs. However, other dosage regimens may be useful. The progress of this therapy can be monitored by standard techniques and assays. The specification for the dosage unit forms of the invention are dictated by and directly dependent on the unique characteristics of the active compound and the particular therapeutic effect to be achieved, and the limitations inherent in the art of compounding such an active compound for the treatment of individuals.

Toxicity and therapeutic efficacy of such compounds can be determined by standard pharmaceutical procedures in cell cultures or experimental animals, e.g., for determining the LD50 (the dose lethal to 50% of the population) and the ED50 (the dose therapeutically effective in 50% of the population). The dose ratio between toxic and therapeutic effects is the therapeutic index and it can be expressed as the ratio LD50/ED50. Compounds that exhibit large therapeutic indices are preferred. While compounds that exhibit toxic side effects may be used, care should be taken to design a delivery system that targets such compounds to the site of affected tissue in order to minimize potential damage to uninfected cells and, thereby, reduce side effects.

Data obtained from cell culture assays and animal studies can be used in formulating a range of dosage for use in humans. The dosage of such compounds lies preferably within a range of circulating concentrations that include the ED50 with little or no toxicity. The dosage may vary within this range depending upon the dosage form employed and the route of administration utilized. For any compound used in the method of the invention, the therapeutically effective dose can be estimated initially from cell culture assays. A dose may be formulated in animal models to achieve a circulating plasma concentration range that includes the IC50 (i.e., the concentration of the test compound which achieves a half-maximal inhibition of symptoms) as determined in cell culture. Such information can be used to more accurately determine useful doses in humans. Levels in plasma may be measured, for example, by high performance liquid chromatography.

The skilled artisan will appreciate that certain factors may influence the dosage required to effectively treat a subject, including but not limited to the severity of the disease or disorder, previous treatments, the general health and/or age of the subject, and other diseases present. Moreover, treatment of a subject with a therapeutically effective amount of a protein, polypeptide, or antibody can include a single treatment or, preferably, can include a series of treatments.

The present invention encompasses compounds that modulate expression or activity. A compound may, for example, be a small molecule. For example, such small molecules include, but are not limited to, peptides, peptidomimetics, amino acids, amino acid analogs, polynucleotides, polynucleotide analogs, nucleotides, nucleotide analogs, organic or inorganic compounds (i.e. including heteroorganic and organometallic compounds) having a molecular weight less than about 10,000 grams per mole, organic or inorganic compounds having a molecular weight less than about 5,000 grams per mole, organic or inorganic compounds having a molecular weight less than about 1,000 grams per mole, organic or inorganic compounds having a molecular weight less than about 500 grams per mole, and salts, esters, and other pharmaceutically acceptable forms of such compounds.

It is understood that appropriate doses of small molecule agents depends upon a number of factors within the ken of the ordinarily skilled physician, veterinarian, or researcher. The dose(s) of the small molecule will vary, for example, depending upon the identity, size, and condition of the subject or sample being treated, further depending upon the route by which the composition is to be administered, if applicable, and the effect which the practitioner desires the small molecule to have upon the nucleic acid or polypeptide of the invention.

Appropriate doses of a small molecule also depend upon the potency of the small molecule with respect to the expression or activity to be modulated. Such appropriate doses may be determined using the assays described herein. When one or more of these small molecules is to be administered to an animal (e.g., a human) in order to modulate expression or activity of a polypeptide or nucleic acid of the invention, a physician, veterinarian, or researcher may, for example, prescribe a relatively low dose at first, subsequently increasing the dose until an appropriate response is obtained. In addition, it is understood that the specific dose level for any particular animal subject will depend upon a variety of factors including the activity of the specific compound employed, the age, body weight, general health, gender, and diet of the subject, the time of administration, the route of administration, the rate of excretion, any drug combination, and the degree of expression or activity to be modulated.

The present invention also encompasses a method of agonizing (stimulating) or antagonizing a GPCR's natural binding partner's associated activity in a mammal, comprising administering to said mammal one or more agonists or antagonists to a GPCR in an amount sufficient to effect said agonism or antagonism. One embodiment of the present invention, then, is a method of treating diseases in a mammal with an agonist or antagonist of a GPCR comprising administering the agonist or antagonist to a mammal in an amount sufficient to agonize or antagonize one or more GPCR-associated functions.

In one embodiment, the present invention provides a method for monitoring the effectiveness of treatment of a subject with a compound (e.g., an agonist, antagonist, peptidomimetic, protein, peptide, nucleic acid, small molecule, or other drug candidate identified by the screening assays described herein) including the steps of (i) obtaining a pre-administration biological sample from a subject prior to administration of the agent; (ii) detecting the level of expression of a GPCR polypeptide, mRNA, or genomic DNA in the preadministration sample; (iii) obtaining one or more post-administration biological samples from the subject; (iv) detecting the level of expression or activity of a GPCR polypeptide, mRNA, or genomic DNA in the post-administration samples; (v) comparing the level of expression or activity of a GPCR polypeptide, mRNA, or genomic DNA in the pre-administration sample with the polypeptide, mRNA, or genomic DNA in the post administration sample or samples; and (vi) altering the administration of the compound to the subject accordingly. For example, increased administration of the compound may be desirable to increase the expression or activity of a GPCR polypeptide to higher levels than detected, i.e., to increase the effectiveness of the agent. Alternatively, decreased administration of the compound may be desirable to decrease expression or activity of a GPCR polypeptide to lower levels than detected.

GPCR Expression Profiles: Related Diseases and Disorders

Expression profiles for GPCRs of the present invention were determined with human and mice tissues using RT-PCR and tissue in situ hybridization methods. Modulators of GPCR expression and/or activity, which include GPCR plypeptides and polynucleotides themselves, may be used to treat or prevent diseases and disorders associated with a tissue in which the GPCR is expressed. The findings are summarized below.

Methods

RT-PCR

Tissue harvesting: 8-10 week old male or female 129S1/SvIMJ mice (Jackson Laboratory) were used for tissue harvesting. Peripheral tissues were dissected fresh and stored in RNAlater at 4° C. (Ambion). Some tissues were also purchased from PelFreez and kept frozen at −80° C. until RNA extraction. Brains were removed and stored overnight at 4° C. in RNAlater, then microdissected under a Leica MZ6 dissecting microscope into nine regions, using landmarks from a mouse atlas.

RNA preparation: RNA was extracted using the Totally RNA kit (Ambion) including LiCl precipitation and DNAse (Epicenter) treatment. To test for genomic DNA contamination, intron/exon spanning PCR primers for several genes (ApoAI, Nurr1, Actin, G3PDH and Blue opsin) were used in RT-PCRs, performed in the presence or absence of RT, with 200 ng of input cDNA.

RT reactions: 5 μg of each RNA sample was reverse transcribed with random primers (Roche) in a 40 μl reaction with 40U MMLV-RT (Roche) and 20U RNAse inhibitor (Roche). cDNAs were treated with RNAse H (Epicenter) and RNAse A (Ambion) and normalized with 18S RNA primer sets (Ambion).

PCRs: Gene amplification was carried out in 25 μl reactions with 2 ng, 20 ng or 200 ng of input cDNA, in the presence of 1.25 U of AmpliTaq Gold Polymerase (Applied Biosystems) and 0.25 uM of each primer. Cycling conditions were: 94° C. for 5 minutes, followed by 37 or 40 cycles of 94° C./0.5 minute −65° C./0.5 minute −72° C./1 minute. Subsequently to the final cycle, reactions were extended for 7 minutes at 72° C. All PCR products were analyzed on a 2% agarose gel containing ethidium bromide and visualized on an Alpha Imager. Scanning was performed on an Alpha Imager by the Alpha Ease Program (Alpha Innotech).

Primers: Primers were designed using the Oligo 6.0 program (Mol. Bio. Insights). Their specificity was evaluated by BLAST searches of the human and mouse genomes and confirmed by sequencing the bands obtained from RT-PCR.

In Situ Hybridization

Tissue dissection and sectioning: 8-10 week old male 129SI/SvIMJ mice (Jackson Laboratory) were sacrificed and their brains were dissected, snap frozen on dry ice, and stored at −70° C. Brains were sectioned at 10-14 μm onto microscope slides. Sections were collected in series so that each gene was sampled at 100 μm intervals through the hypothalamus and amygdala, and at 500 μm intervals through the remainder of the brain.

Riboprobe preparation: T3 (sense) and T7 (antisense) promoters were attached to either side of the gene of interest and amplified by PCR, using primers with the corresponding gene and promoter sequences. Transcription reactions were performed using Ambion Maxiscript kits. PCR generated templates (500 ng) were added to 100 μCi of dried down $^{33}$P-UTP (Perkin Elmer) in 10 μl reactions.

Hybridization: Prehybridization and hybridization reactions were performed as previously described, with modifications. Briefly, $^{33}$P labeled riboprobes (~5×10$^6$ cpm/slide) were applied to slides overnight at 55° C. Slides were then digested with RNAse and rinsed in SSC, with a final rinse in 0.1×SSC at 70° C. for 30 min. Slides were subsequently dipped in NTB-2 emulsion, and developed after 3 weeks.

Analysis: Specific mRNA distributions were determined by examination of two complete brains for each gene, with light and darkfield microscopy. An additional brain was examined for sense labeling, to assess sites of non-specific signal. Specific signal was scored as clusters of silver grains over discrete cells or brain regions, without corresponding signal in sense slides. Sections were counterstained with cresyl violet for contrast and regional identification. Images were captured with a Photometric CoolSnap camera and Universal Imaging MetaMorph software (both Meridian Instruments).

Expression Profile Results

We have determined the expression pattern for GPCRs, providing functional information for these receptors (Table 1). In addition, we have identified several new GPCRs (Table 2). The GPCR polypeptides and polynucleotides may be relevant for the treatment or diagnosis of various disease or disorders, particularly behavioral disorders. In addition to the wild-type GPCR polypeptide, polymorphic, splice variant, mutagenzied, and recombinant forms of a GPCR polypeptide may also be targets for treatment or diagnosis of diseases and disorders or for assaying for therapeutic compounds.

TABLE 1

GPCRs

| Gene Name | Human Polypeptide SEQ ID NO: | Human Polynucleotide SEQ ID NO: | Mouse Polypeptide SEQ ID NO: | Mouse Polynucleotide SEQ ID NO: |
| --- | --- | --- | --- | --- |
| KIAA1828 | 1 | 2 | 3 | 4 |
| PGR10 | 5 | 6 | 7 | 8 |
| PGR11 | 9 | 10 | 11 | 12 |
| PGR12 | 13 | 14 | 15 | 16 |
| PGR13 | 17 | 18 | 19 | 20 |
| PGR14 | 21 | 22 | 23 | 24 |
| PGR15 | 25 | 26 | 27 | 28 |
| PGR17 | 29 | 30 | 31 | 32 |
| PGR2 | 33 | 34 | 35 | 36 |
| PGR20 | 37 | 38 | 39 | 40 |
| PGR22 | 41 | 42 | 43 | 44 |
| PGR25 | 45 | 46 | 47 | 48 |
| PGR26 | 49 | 50 | 51 | 52 |
| PGR3 | 53 | 54 | 55 | 56 |
| PGR5 | 57 | 58 | 59 | 60 |
| PGR1 | 61 | 62 | 63 | 836 |
| PGR16 | 64 | 65 | 66 | 837 |
| PGR18 | 67 | 68 | 69 | 838 |
| PGR19 | 70 | 71 | 72 | 839 |
| PGR21 | 73 | 74 | 75 | 840 |
| PGR23 | 76 | 77 | 78 | 841 |
| PGR24A | 79 | 80 | — | — |
| PGR24P | 1551 | 1552 | — | — |
| PGR27 | 81 | 82 | 83 | 842 |
| PGR28 | 84 | 85 | 86 | 843 |
| PGR4 | 87 | 88 | 89 | 844 |
| PGR6 | 90 | 91 | — | — |
| PGR7 | 92 | 93 | 94 | 845 |
| PGR9 | 95 | 96 | — | — |

TABLE 1-continued

GPCRs

| Gene Name | Human Polypeptide SEQ ID NO: | Human Polynucleotide SEQ ID NO: | Mouse Polypeptide SEQ ID NO: | Mouse Polynucleotide SEQ ID NO: |
|---|---|---|---|---|
| AGR9 | 97 | 846 | 98 | 99 |
| BAI1 | 100 | 847 | 101 | 102 |
| BAI2 | 103 | 848 | 104 | 105 |
| BAI3 | 106 | 849 | 107 | 108 |
| DJ287G14 | 109 | 850 | 110 | 111 |
| DRD1 | 112 | 851 | 113 | 114 |
| DRD5 | 115 | 852 | 116 | 117 |
| EBI2 | 118 | 853 | 119 | 120 |
| FLJ14454 | 121 | 854 | 122 | 123 |
| GHSR | 124 | 855 | 125 | 126 |
| GIPR | 127 | 856 | 128 | 129 |
| GLP2R | 130 | 857 | 131 | 132 |
| GPR101 | 133 | 858 | 134 | 135 |
| GPR103 | 136 | 859 | 137 | 138 |
| GPR17 | 139 | 860 | 140 | 141 |
| GPR20 | 142 | 861 | 143 | 144 |
| GPR21 | 145 | 862 | 146 | 147 |
| GPR23 | 148 | 863 | 149 | 150 |
| GPR25 | 151 | 864 | 152 | 153 |
| GPR26 | 154 | 865 | 155 | 156 |
| GPR37L1 | 157 | 866 | 158 | 159 |
| GPR39 | 160 | 867 | 161 | 162 |
| GPR4 | 163 | 868 | 164 | 165 |
| GPR48 | 166 | 869 | 167 | 168 |
| GPR51 | 169 | 870 | 170 | 171 |
| GPR58 | 172 | 871 | 173 | 174 |
| GPR62 | 175 | 872 | 176 | 177 |
| GPR64 | 178 | 873 | 179 | 180 |
| GPR68 | 181 | 874 | 182 | 183 |
| GPR82 | 184 | 875 | 185 | 186 |
| GPR92 | 187 | 876 | 188 | 189 |
| GRM2 | 190 | 877 | 191 | 192 |
| GRM4 | 193 | 878 | 194 | 195 |
| GRM5 | 196 | 879 | 197 | 198 |
| GRM6 | 199 | 880 | 200 | 201 |
| GRM7 | 202 | 881 | 203 | 204 |
| HCRTR1 | 205 | 882 | 206 | 207 |
| HCRTR2 | 208 | 883 | 209 | 210 |
| KIAA0758 | 211 | 884 | 212 | 213 |
| LEC1 | 214 | 885 | 215 | 216 |
| LEC2 | 217 | 886 | 218 | 219 |
| LEC3 | 220 | 887 | 221 | 222 |
| LGR6 | 223 | 888 | 224 | 225 |
| LGR7 | 226 | 889 | 227 | 228 |
| MTNR1B | 229 | 890 | 230 | 231 |
| NPFF1R | 232 | 891 | 233 | 234 |
| RE2 | 237 | 892 | 238 | 239 |
| SCTR | 240 | 893 | 241 | 242 |
| SREB3 | 243 | 894 | 244 | 245 |
| TAR2 | — | — | 246 | 247 |
| TAR3 | 248 | 895 | 249 | 250 |
| TM7SF1L2 | 251 | 896 | 252 | 253 |
| ADCYAP1R1 | 254 | 897 | 255 | 1188 |
| ADMR | 256 | 898 | 257 | 1189 |
| ADORA1 | 258 | 899 | 259 | 1190 |
| ADORA2A | 260 | 900 | 261 | 1191 |
| ADORA2B | 262 | 901 | 263 | 1192 |
| ADORA3 | 264 | 902 | 265 | 1193 |
| ADRA1A | 266 | 903 | 267 | 1194 |
| ADRA1B | 268 | 904 | 269 | 1195 |
| ADRA1D | 270 | 905 | 271 | 1196 |
| ADRA2A | 272 | 906 | 273 | 1197 |
| ADRA2B | 274 | 907 | 275 | 1198 |
| ADRA2C | 276 | 908 | 277 | 1199 |
| ADRB1 | 278 | 909 | 279 | 1200 |
| ADRB2 | 280 | 910 | 281 | 1201 |
| ADRB3 | 282 | 911 | 283 | 1202 |
| AGTR1 | 284 | 912 | 285 | 1203 |
| AGTR2 | 286 | 913 | 287 | 1204 |
| AGTRL1 | 288 | 914 | 289 | 1205 |
| AVPR1A | 290 | 915 | 291 | 1206 |
| AVPR1B | 292 | 916 | 293 | 1207 |
| AVPR2 | 294 | 917 | 295 | 1208 |
| BDKRB1 | 296 | 918 | 297 | 1209 |
| BDKRB2 | 298 | 919 | 299 | 1210 |
| BLR1 | 300 | 920 | 301 | 1211 |
| BRS3 | 302 | 921 | 303 | 1212 |
| C3AR1 | 304 | 922 | 305 | 1213 |
| C5R1 | 306 | 923 | 307 | 1214 |
| CALCR | 308 | 924 | 309 | 1215 |
| CALCRL | 310 | 925 | 311 | 1216 |
| CASR | 312 | 926 | 313 | 1217 |
| CCBP2 | 314 | 927 | 315 | 1218 |
| CCKAR | 316 | 928 | 317 | 1219 |
| CCKBR | 318 | 929 | 319 | 1220 |
| CCR1 | 320 | 930 | 321 | 1221 |
| CCR2 | 322 | 931 | 323 | 1222 |
| CCR3 | 324 | 932 | 325 | 1223 |
| CCR4 | 326 | 933 | 327 | 1224 |
| CCR5 | 328 | 934 | 329 | 1225 |
| CCR6 | 330 | 935 | 331 | 1226 |
| CCR7 | 332 | 936 | 333 | 1227 |
| CCR8 | 334 | 937 | 335 | 1228 |
| CCR9 | 336 | 938 | 337 | 1229 |
| CCRL1 | 338 | 939 | 339 | 1230 |
| CCXCR1 | 340 | 940 | 341 | 1231 |
| CD97 | 342 | 941 | 343 | 1232 |
| CELSR1 | 344 | 942 | 345 | 1233 |
| CELSR2 | 346 | 943 | 347 | 1234 |
| CELSR3 | 348 | 944 | 349 | 1235 |
| CHRM1 | 350 | 945 | 351 | 1236 |
| CHRM2 | 352 | 946 | 353 | 1237 |
| CHRM3 | 354 | 947 | 355 | 1238 |
| CHRM4 | 356 | 948 | 357 | 1239 |
| CHRM5 | 358 | 949 | 359 | 1240 |
| CMKLR1 | 360 | 950 | 361 | 1241 |
| CNR1 | 362 | 951 | 363 | 1242 |
| CNR2 | 364 | 952 | 365 | 1243 |
| CRHR1 | 366 | 953 | 367 | 1244 |
| CRHR2 | 368 | 954 | 369 | 1245 |
| CX3CR1 | 370 | 955 | 371 | 1246 |
| CXCR4 | 372 | 956 | 373 | 1247 |
| CXCR6 | 374 | 957 | 375 | 1248 |
| CYSLT1 | 376 | 958 | 377 | 1249 |
| CYSLT2 | 378 | 959 | 379 | 1250 |
| DRD2 | 380 | 960 | 381 | 1251 |
| DRD3 | 382 | 961 | 383 | 1252 |
| DRD4 | 384 | 962 | 385 | 1253 |
| EDG1 | 386 | 963 | 387 | 1254 |
| EDG2 | 388 | 964 | 389 | 1255 |
| EDG3 | 390 | 965 | 391 | 1256 |
| EDG4 | 392 | 966 | 393 | 1257 |
| EDG5 | 394 | 967 | 395 | 1258 |
| EDG6 | 396 | 968 | 397 | 1259 |
| EDG7 | 398 | 969 | 399 | 1260 |
| EDG8 | 400 | 970 | 401 | 1261 |
| EDNRA | 402 | 971 | 403 | 1262 |
| EDNRB | 404 | 972 | 405 | 1263 |
| EMR1 | 406 | 973 | 407 | 1264 |
| ETL | 408 | 974 | 409 | 1265 |
| F2R | 410 | 975 | 411 | 1266 |
| F2RL1 | 412 | 976 | 413 | 1267 |
| F2RL2 | 414 | 977 | 415 | 1268 |
| F2RL3 | 416 | 978 | 417 | 1269 |
| FKSG79 | 418 | 979 | 419 | 1270 |
| FPR1 | 420 | 980 | 421 | 1271 |
| FSHR | 422 | 981 | 423 | 1272 |
| FY | 424 | 982 | 425 | 1273 |
| FZD10 | 426 | 983 | 427 | 1274 |
| FZD2 | 428 | 984 | 429 | 1275 |
| FZD3 | 430 | 985 | 431 | 1276 |
| FZD4 | 432 | 986 | 433 | 1277 |
| FZD5 | 434 | 987 | 435 | 1278 |
| FZD6 | 436 | 988 | 437 | 1279 |
| FZD7 | 438 | 989 | 439 | 1280 |
| FZD8 | 440 | 990 | 441 | 1281 |

TABLE 1-continued

GPCRs

| Gene Name | Human Polypeptide SEQ ID NO: | Human Polynucleotide SEQ ID NO: | Mouse Polypeptide SEQ ID NO: | Mouse Polynucleotide SEQ ID NO: |
| --- | --- | --- | --- | --- |
| FZD9 | 442 | 991 | 443 | 1282 |
| G2A | 444 | 992 | 445 | 1283 |
| GABBR1 | 446 | 993 | 447 | 1284 |
| GALR1 | 448 | 994 | 449 | 1285 |
| GALR2 | 450 | 995 | 451 | 1286 |
| GALR3 | 452 | 996 | 453 | 1287 |
| GCGR | 454 | 997 | 455 | 1288 |
| GHRHR | 456 | 998 | 457 | 1289 |
| GLP1R | 458 | 999 | 459 | 1290 |
| GNRHR | 460 | 1000 | 461 | 1291 |
| GPCR150 | 462 | 1001 | 463 | 1292 |
| GPR1 | 464 | 1002 | 465 | 1293 |
| GPR10 | 466 | 1003 | 467 | 1294 |
| GPR102 | 468 | 1004 | — | — |
| GPR105 | 470 | 1005 | 471 | 1296 |
| GPR12 | 472 | 1006 | 473 | 1297 |
| GPR14 | 474 | 1007 | 475 | 1298 |
| GPR15 | 476 | 1008 | 477 | 1299 |
| GPR18 | 478 | 1009 | 479 | 1300 |
| GPR19 | 480 | 1010 | 481 | 1301 |
| GPR2 | 482 | 1011 | 483 | 1302 |
| GPR22 | 484 | 1012 | 485 | 1303 |
| GPR24 | 486 | 1013 | 487 | 1304 |
| GPR27 | 488 | 1014 | 489 | 1305 |
| GPR3 | 490 | 1015 | 491 | 1306 |
| GPR30 | 492 | 1016 | 493 | 1307 |
| GPR34 | 494 | 1017 | 495 | 1308 |
| GPR35 | 496 | 1018 | 497 | 1309 |
| GPR37 | 498 | 1019 | 499 | 1310 |
| GPR40 | 500 | 1020 | 501 | 1311 |
| GPR41 | 502 | 1021 | 503 | 1312 |
| GPR43 | 504 | 1022 | 505 | 1313 |
| GPR44 | 506 | 1023 | 507 | 1314 |
| GPR45 | 508 | 1024 | 509 | 1315 |
| GPR49 | 510 | 1025 | 511 | 1316 |
| GPR50 | 512 | 1026 | 513 | 1317 |
| GPR54 | 514 | 1027 | 515 | 1318 |
| GPR55 | 516 | 1028 | 517 | 1319 |
| GPR56 | 518 | 1029 | 519 | 1320 |
| GPR57 | 520 | 1030 | 521 | 1321 |
| GPR6 | 522 | 1031 | 523 | 1322 |
| GPR61 | 524 | 1032 | 525 | 1323 |
| GPR63 | 526 | 1033 | 527 | 1324 |
| GPR65 | 528 | 1034 | 529 | 1325 |
| GPR66 | 530 | 1035 | 531 | 1326 |
| GPR7 | 532 | 1036 | 533 | 1327 |
| GPR73 | 534 | 1037 | 535 | 1328 |
| GPR73L1 | 536 | 1038 | 537 | 1329 |
| GPR74 | 538 | 1039 | 539 | 1330 |
| GPR75 | 540 | 1040 | 541 | 1331 |
| GPR77 | 542 | 1041 | 543 | 1332 |
| GPR80 | 544 | 1042 | 545 | 1333 |
| GPR81 | 546 | 1043 | 547 | 1334 |
| GPR83 | 548 | 1044 | 549 | 1335 |
| GPR84 | 550 | 1045 | 551 | 1336 |
| GPR85 | 552 | 1046 | 553 | 1337 |
| GPR86 | 554 | 1047 | 555 | 1338 |
| GPR87 | 556 | 1048 | 557 | 1339 |
| GPR88 | 558 | 1049 | 559 | 1340 |
| GPR9 | 560 | 1050 | 561 | 1341 |
| GPR91 | 562 | 1051 | 563 | 1342 |
| GPRC5B | 564 | 1052 | 565 | 1343 |
| GPRC5C | 566 | 1053 | 567 | 1344 |
| GPRC5D | 568 | 1054 | 569 | 1345 |
| GPRC6A | 570 | 1055 | 571 | 1346 |
| GRCA | 572 | 1056 | 573 | 1347 |
| GRM1 | 574 | 1057 | 575 | 1348 |
| GRM3 | 576 | 1058 | 577 | 1349 |
| GRM8 | 578 | 1059 | 579 | 1350 |
| GRPR | 580 | 1060 | 581 | 1351 |
| H963 | 582 | 1061 | 583 | 1352 |
| HGPCR11 | 584 | 1062 | 585 | 1353 |
| HGPCR19 | 586 | 1063 | 587 | 1354 |
| HGPCR2 | 588 | 1064 | 589 | 1355 |
| HM74 | 590 | 1065 | 591 | 1356 |
| HRH1 | 592 | 1066 | 593 | 1357 |
| HRH2 | 594 | 1067 | 595 | 1358 |
| HRH3 | 596 | 1068 | 597 | 1359 |
| HRH4 | 598 | 1069 | 599 | 1360 |
| HTR1A | 600 | 1070 | 601 | 1361 |
| HTR1B | 602 | 1071 | 603 | 1362 |
| HTR1D | 604 | 1072 | 605 | 1363 |
| HTR1F | 606 | 1073 | 607 | 1364 |
| HTR2A | 608 | 1074 | 609 | 1365 |
| HTR2B | 610 | 1075 | 611 | 1366 |
| HTR2C | 612 | 1076 | 613 | 1367 |
| HTR4 | 614 | 1077 | 615 | 1368 |
| HTR5A | 616 | 1078 | 617 | 1369 |
| HTR6 | 618 | 1079 | 619 | 1370 |
| HTR7 | 620 | 1080 | 621 | 1371 |
| HUMNPIIY20 | 622 | 1081 | 623 | 1372 |
| IL8RA | 624 | 1082 | 625 | 1373 |
| IL8RB | 626 | 1083 | 627 | 1374 |
| LGR8 | 628 | 1084 | 629 | 1375 |
| LHCGR | 630 | 1085 | 631 | 1376 |
| LTB4R | 632 | 1086 | 633 | 1377 |
| LTB4R2 | 634 | 1087 | 635 | 1378 |
| MAS1 | 636 | 1088 | 637 | 1379 |
| MC1R | 638 | 1089 | 639 | 1380 |
| MC2R | 640 | 1090 | 641 | 1381 |
| MC3R | 642 | 1091 | 643 | 1382 |
| MC4R | 644 | 1092 | 645 | 1383 |
| MC5R | 646 | 1093 | 647 | 1384 |
| MRGD | 648 | 1094 | 649 | 1385 |
| MRGE | 650 | 1095 | 651 | 1386 |
| MRGF | 652 | 1096 | 653 | 1387 |
| MTNR1A | 654 | 1097 | 655 | 1388 |
| N8(MRGG) | 656 | 1098 | 657 | 1389 |
| NMBR | 658 | 1099 | 659 | 1390 |
| NMU2R | 660 | 1100 | 661 | 1391 |
| NPY1R | 662 | 1101 | 663 | 1392 |
| NPY2R | 664 | 1102 | 665 | 1393 |
| NPY5R | 666 | 1103 | 667 | 1394 |
| NPY6R | 668 | 1104 | 669 | 1395 |
| NTSR1 | 670 | 1105 | 671 | 1396 |
| NTSR2 | 672 | 1106 | 673 | 1397 |
| OA1 | 674 | 1107 | 675 | 1398 |
| OPN1MW | 676 | 1108 | 677 | 1399 |
| OPN1SW | 678 | 1109 | 679 | 1400 |
| OPN3 | 680 | 1110 | 681 | 1401 |
| OPN4 | 682 | 1111 | 683 | 1402 |
| OPRD1 | 684 | 1112 | 685 | 1403 |
| OPRK1 | 686 | 1113 | 687 | 1404 |
| OPRL1 | 688 | 1114 | 689 | 1405 |
| OPRM1 | 690 | 1115 | 691 | 1406 |
| OXTR | 692 | 1116 | 693 | 1407 |
| P2RY1 | 694 | 1117 | 695 | 1408 |
| P2RY12 | 696 | 1118 | 697 | 1409 |
| P2RY2 | 698 | 1119 | 699 | 1410 |
| P2RY4 | 700 | 1120 | 701 | 1411 |
| P2RY6 | 702 | 1121 | 703 | 1412 |
| P2Y10 | 704 | 1122 | 705 | 1413 |
| P2Y5 | 706 | 1123 | 707 | 1414 |
| PGR8 | 708 | 1124 | 709 | 1415 |
| PNR | 710 | 1125 | 711 | 1416 |
| PPYR1 | 712 | 1126 | 713 | 1417 |
| PTAFR | 714 | 1127 | 715 | 1418 |
| PTGDR | 716 | 1128 | 717 | 1419 |
| PTGER1 | 718 | 1129 | 719 | 1420 |
| PTGER2 | 720 | 1130 | 721 | 1421 |
| PTGER3 | 722 | 1131 | 723 | 1422 |
| PTGER4 | 724 | 1132 | 725 | 1423 |
| PTGFR | 726 | 1133 | 727 | 1424 |
| PTGIR | 728 | 1134 | 729 | 1425 |
| PTHR1 | 730 | 1135 | 731 | 1426 |
| PTHR2 | 732 | 1136 | 733 | 1427 |

TABLE 1-continued

GPCRs

| Gene Name | Human Polypeptide SEQ ID NO: | Human Polynucleotide SEQ ID NO: | Mouse Polypeptide SEQ ID NO: | Mouse Polynucleotide SEQ ID NO: |
|---|---|---|---|---|
| RAI3 | 734 | 1137 | 735 | 1428 |
| RDC1 | 736 | 1138 | 737 | 1429 |
| RGR | 738 | 1139 | 739 | 1430 |
| RHO | 740 | 1140 | 741 | 1431 |
| RRH | 742 | 1141 | 743 | 1432 |
| SALPR | 744 | 1142 | 745 | 1433 |
| SMOH | 746 | 1143 | 747 | 1434 |
| SSTR1 | 748 | 1144 | 749 | 1435 |
| SSTR2 | 750 | 1145 | 751 | 1436 |
| SSTR3 | 752 | 1146 | 753 | 1437 |
| SSTR4 | 754 | 1147 | 755 | 1438 |
| SSTR5 | 756 | 1148 | 757 | 1439 |
| TACR1 | 758 | 1149 | 759 | 1440 |
| TACR2 | 760 | 1150 | 761 | 1441 |
| TACR3 | 762 | 1151 | 763 | 1442 |
| TAR1 | 764 | 1152 | 765 | 1443 |
| TAR4 | 766 | 1153 | 767 | 1444 |
| TBXA2R | 768 | 1154 | 769 | 1445 |
| TEM5 | 770 | 1155 | 771 | 1446 |
| TM7SF1 | 772 | 1156 | 773 | 1447 |
| TM7SF1L1 | 774 | 1157 | 775 | 1448 |
| TM7SF3 | 776 | 1158 | 777 | 1449 |
| TPRA40 | 778 | 1159 | 779 | 1450 |
| TRHR | 780 | 1160 | 781 | 1451 |
| TSHR | 782 | 1161 | 783 | 1452 |
| VIPR1 | 784 | 1162 | 785 | 1453 |
| VIPR2 | 786 | 1163 | 787 | 1454 |
| VLGR1 | 788 | 1164 | 789 | 1455 |
| CCRL2 | 790 | 1165 | 1554 | 1553 |
| EMR2 | 791 | 1166 | — | — |
| EMR3 | 792 | 1167 | — | — |
| FPRL1 | 793 | 1168 | — | — |
| FPRL2 | 794 | 1169 | — | — |
| FZD1 | 795 | 1170 | 1545 | 1546 |
| GNRHR2 | 796 | 1171 | — | — |
| GPR31 | 797 | 1172 | 1547 | 1548 |
| GPR32 | 798 | 1173 | — | — |
| GPR38 | 799 | 1174 | — | — |
| GPR52 | 800 | 1175 | — | — |
| GPR78 | 801 | 1176 | — | — |
| GPR8 | 802 | 1177 | — | — |
| HTR1E | 803 | 1178 | — | — |
| MRG | 804 | 1179 | — | — |
| MRGX1 | 805 | 1180 | — | — |
| MRGX2 | 806 | 1181 | — | — |
| MRGX3 | 807 | 1182 | — | — |
| MRGX4 | 808 | 1183 | — | — |
| OPN1LW | 809 | 1184 | 1549 | 1550 |
| P2RY11 | 810 | 1185 | — | — |
| SLT | 811 | 1186 | — | — |
| TG1019 | 812 | 1187 | — | — |
| CMKBR1L1 | — | — | 813 | 1456 |
| CMKBR1L2 | — | — | 814 | 1457 |
| FPR-RS1 | — | — | 815 | 1458 |
| FPR-RS2 | — | — | 816 | 1459 |
| FPR-RS3 | — | — | 817 | 1460 |
| FPR-RS4 | — | — | 818 | 1461 |
| GPR33 | — | — | 819 | 1462 |
| GPR90 | — | — | 820 | 1463 |
| HTR5B | — | — | 821 | 1464 |
| MrgA1 | — | — | 822 | 1465 |
| MrgA2 | — | — | 823 | 1466 |
| MrgA3 | — | — | 824 | 1467 |
| MrgA4 | — | — | 825 | 1468 |
| MrgA5 | — | — | 826 | 1469 |
| MrgA6 | — | — | 827 | 1470 |
| MrgA7 | — | — | 828 | 1471 |
| MrgA8 | — | — | 829 | 1472 |
| MrgB1 | — | — | 830 | 1473 |
| MrgB2 | — | — | 831 | 1474 |
| MrgB3 | — | — | 832 | 1475 |
| MrgB4 | — | — | 833 | 1476 |
| MrgB5 | — | — | 834 | 1477 |
| TRHR2 | — | — | 835 | 1478 |
| F2RL | 1479 | 1480 | — | — |
| TA10 | — | — | 1481 | 1482 |
| TA11 | — | — | 1483 | 1484 |
| TA12 | — | — | 1485 | 1486 |
| TA14 | — | — | 1487 | 1488 |
| TA15 | — | — | 1489 | 1490 |
| HM74A | 1555 | 1556 | — | — |
| PGR15L | — | — | 1491 | 1492 |
| TA7 | — | — | 1493 | 1494 |
| TA8 | — | — | 1495 | 1496 |
| P2Y3L | 1497 | 1498 | 1499 | 1500 |
| TCP10C | — | — | 1501 | 1502 |
| GPR103L | — | — | 1503 | 1504 |
| OR51E1 | 1505 | 1515 | 1525 | 1535 |
| OR4N4 | 1506 | 1516 | 1526 | 1536 |
| OR51Q1 | 1507 | 1517 | 1527 | 1537 |
| OR51E2 | 1508 | 1518 | 1528 | 1538 |
| OR8B3 | 1509 | 1519 | 1529 | 1539 |
| OR7D2 | 1510 | 1520 | 1530 | 1540 |
| OR2A7 | 1511 | 1521 | 1531 | 1541 |
| OR7E102 | 1512 | 1522 | 1532 | 1542 |
| OR2A1 | 1513 | 1523 | 1533 | 1543 |
| OR2I2 | 1514 | 1524 | 1534 | 1544 |

TABLE 2

GPCRs

| Gene Name | Human Polypeptide SEQ ID NO: | Human Polynucleotide SEQ ID NO: | Mouse Polypeptide SEQ ID NO: | Mouse Polynucleotide SEQ ID NO: |
|---|---|---|---|---|
| KIAA1828 | 1 | 2 | 3 | 4 |
| PGR10 | 5 | 6 | 7 | 8 |
| PGR11 | 9 | 10 | 11 | 12 |
| PGR12 | 13 | 14 | 15 | 16 |
| PGR13 | 17 | 18 | 19 | 20 |
| PGR14 | 21 | 22 | 23 | 24 |
| PGR15 | 25 | 26 | 27 | 28 |
| PGR17 | 29 | 30 | 31 | 32 |
| PGR2 | 33 | 34 | 35 | 36 |
| PGR20 | 37 | 38 | 39 | 40 |
| PGR22 | 41 | 42 | 43 | 44 |
| PGR25 | 45 | 46 | 47 | 48 |
| PGR26 | 49 | 50 | 51 | 52 |
| PGR3 | 53 | 54 | 55 | 56 |
| PGR5 | 57 | 58 | 59 | 60 |
| PGR1 | 61 | 62 | 63 | 836 |
| PGR16 | 64 | 65 | 66 | 837 |
| PGR18 | 67 | 68 | 69 | 838 |
| PGR19 | 70 | 71 | 72 | 839 |
| PGR21 | 73 | 74 | 75 | 840 |
| PGR23 | 76 | 77 | 78 | 841 |
| PGR24A | 79 | 80 | — | — |
| PGR24P | 1551 | 1552 | — | — |
| PGR27 | 81 | 82 | 83 | 842 |
| PGR28 | 84 | 85 | 86 | 843 |
| PGR4 | 87 | 88 | 89 | 844 |
| PGR6 | 90 | 91 | — | — |
| PGR7 | 92 | 93 | 94 | 845 |
| PGR9 | 95 | 96 | — | — |
| AGR9 | 97 | 846 | 98 | 99 |
| BAI1 | 100 | 847 | 101 | 102 |
| BAI2 | 103 | 848 | 104 | 105 |
| BAI3 | 106 | 849 | 107 | 108 |
| DJ287G14 | 109 | 850 | 110 | 111 |
| DRD1 | 112 | 851 | 113 | 114 |
| DRD5 | 115 | 852 | 116 | 117 |

TABLE 2-continued

GPCRs

| Gene Name | Human Polypeptide SEQ ID NO: | Human Polynucleotide SEQ ID NO: | Mouse Polypeptide SEQ ID NO: | Mouse Polynucleotide SEQ ID NO: |
|---|---|---|---|---|
| EBI2 | 118 | 853 | 119 | 120 |
| FLJ14454 | 121 | 854 | 122 | 123 |
| GHSR | 124 | 855 | 125 | 126 |
| GIPR | 127 | 856 | 128 | 129 |
| GLP2R | 130 | 857 | 131 | 132 |
| GPR101 | 133 | 858 | 134 | 135 |
| GPR103 | 136 | 859 | 137 | 138 |
| GPR17 | 139 | 860 | 140 | 141 |
| GPR20 | 142 | 861 | 143 | 144 |
| GPR21 | 145 | 862 | 146 | 147 |
| GPR23 | 148 | 863 | 149 | 150 |
| GPR25 | 151 | 864 | 152 | 153 |
| GPR26 | 154 | 865 | 155 | 156 |
| GPR37L1 | 157 | 866 | 158 | 159 |
| GPR39 | 160 | 867 | 161 | 162 |
| GPR4 | 163 | 868 | 164 | 165 |
| GPR48 | 166 | 869 | 167 | 168 |
| GPR51 | 169 | 870 | 170 | 171 |
| GPR58 | 172 | 871 | 173 | 174 |
| GPR62 | 175 | 872 | 176 | 177 |
| GPR64 | 178 | 873 | 179 | 180 |
| GPR68 | 181 | 874 | 182 | 183 |
| GPR82 | 184 | 875 | 185 | 186 |
| GPR92 | 187 | 876 | 188 | 189 |
| GRM2 | 190 | 877 | 191 | 192 |
| GRM4 | 193 | 878 | 194 | 195 |
| GRM5 | 196 | 879 | 197 | 198 |
| GRM6 | 199 | 880 | 200 | 201 |
| GRM7 | 202 | 881 | 203 | 204 |
| HCRTR1 | 205 | 882 | 206 | 207 |
| HCRTR2 | 208 | 883 | 209 | 210 |
| KIAA0758 | 211 | 884 | 212 | 213 |
| LEC1 | 214 | 885 | 215 | 216 |
| LEC2 | 217 | 886 | 218 | 219 |
| LEC3 | 220 | 887 | 221 | 222 |
| LGR6 | 223 | 888 | 224 | 225 |
| LGR7 | 226 | 889 | 227 | 228 |
| MTNR1B | 229 | 890 | 230 | 231 |
| NPFF1R | 232 | 891 | 233 | 234 |
| PGR15L | — | — | 1491 | 1492 |
| RE2 | 237 | 892 | 238 | 239 |
| SCTR | 240 | 893 | 241 | 242 |
| SREB3 | 243 | 894 | 244 | 245 |
| TAR2 | — | — | 246 | 247 |
| TAR3 | 248 | 895 | 249 | 250 |
| TM7SF1L2 | 251 | 896 | 252 | 253 |

Nervous System Tissues

Hypothalamus. GPCRs expressed in the hypothalamus are listed in Table 3. These receptors are thus potential targets for therapeutic compounds that may modulate their activity, expression, or stability in the hypothalamus. These polypeptides, or polymorphs of these polypeptides, may form the basis of a therapeutic regimen, or a diagnostic test to determine, e.g., the presence of a disease involving the hypothalamus, the risk of developing a particular disease or disorder, or an appropriate therapeutic course.

TABLE 3

GPCRs Expressed in the Hypothalamus

ADCYAP1R1
ADMR
ADORA1
ADORA2A
ADORA2B
ADORA3
ADRA1A
ADRA1D
ADRA2A
ADRA2B
ADRA2C
ADRB1
ADRB2
AGR9
AGTR1
AGTR2
AGTRL1
AVPR1A
AVPR2
BAI1
BAI2
BAI3
BDKRB1
BDKRB2
BLR1
BRS3
C3AR1
C5R1
CALCR
CALCRL
CASR
CCBP2
CCKAR
CCKBR
CCR1
CCR2
CCR4
CCR5
CCR6
CCR8
CCR9
CCRL1
CD97
CELSR1
CELSR2
CELSR3
CHRM1
CHRM2
CHRM3
CHRM4
CHRM5
CMKBR1L2
CMKLR1
CNR1
CNR2
CRHR1
CRHR2
CX3CR1
CXCR4
CXCR6
CYSLT1
DJ287G14
DRD1
DRD2
DRD3
DRD4
DRD5
EBI2
EDG1
EDG2
EDG3
EDG4
EDG5
EDG7
EDG8
EDNRA
EDNRB
EMR1
ETL
F2R
F2RL1
F2RL2
F2RL3
FKSG79
FPR1

TABLE 3-continued

GPCRs Expressed in the Hypothalamus

FPR-RS2
FY
FZD1
FZD10
FZD2
FZD3
FZD4
FZD5
FZD6
FZD7
FZD8
G2A
GABBR1
GALR1
GALR2
GALR3
GHSR
GIPR
GLP1R
GLP2R
GNRHR
GPCR150
GPR1
GPR10
GPR101
GPR103
GPR105
GPR12
GPR14
GPR15
GPR17
GPR18
GPR19
GPR2
GPR20
GPR21
GPR22
GPR23
GPR24
GPR26
GPR27
GPR30
GPR31
GPR34
GPR35
GPR37
GPR37L1
GPR4
GPR43
GPR44
GPR45
GPR48
GPR49
GPR50
GPR51
GPR54
GPR55
GPR56
GPR6
GPR61
GPR62
GPR63
GPR64
GPR65
GPR66
GPR68
GPR7
GPR73
GPR73L1
GPR74
GPR75
GPR77
GPR80
GPR81
GPR82
GPR83
GPR84
GPR85

TABLE 3-continued

GPCRs Expressed in the Hypothalamus

GPR86
GPR87
GPR88
GPR90
GPR92
GPRC5B
GPRC5C
GPRC5D
GRCA
GRM1
GRM2
GRM3
GRM4
GRM5
GRM7
GRM8
GRPR
H963
HCRTR1
HCRTR2
HGPCR11
HGPCR2
HM74
HRH1
HRH2
HRH3
HTR1A
HTR1B
HTR1D
HTR1F
HTR2A
HTR2B
HTR2C
HTR4
HTR5A
HTR6
HTR7
HUMNPIIY20
IL8RA
KIAA0758
KIAA1828
LEC1
LEC2
LEC3
LGR6
LGR7
LGR8
LHCGR
LTB4R
LTB4R2
MAS1
MC2R
MC3R
MC4R
MC5R
MRG
MRGE
MRGF
MTNR1A
NMBR
NMU2R
NPFF1R
NPY1R
NPY2R
NPY5R
NPY6R
NTSR1
NTSR2
OA1
OPN1MW
OPN1SW
OPN3
OPRD1
OPRK1
OPRL1
OPRM1
OXTR
P2RY1

TABLE 3-continued

| GPCRs Expressed in the Hypothalamus |
|---|
| P2RY12 |
| P2RY2 |
| P2RY4 |
| P2RY6 |
| P2Y10 |
| P2Y5 |
| PGR1 |
| PGR10 |
| PGR11 |
| PGR12 |
| PGR13 |
| PGR14 |
| PGR15 |
| PGR16 |
| PGR17 |
| PGR18 |
| PGR20 |
| PGR21 |
| PGR22 |
| PGR23 |
| PGR25 |
| PGR26 |
| PGR27 |
| PGR28 |
| PGR3 |
| PGR4 |
| PGR5 |
| PGR7 |
| PGR8 |
| PTAFR |
| PTGDR |
| PTGER1 |
| PTGER2 |
| PTGER3 |
| PTGER4 |
| PTGFR |
| PTHR1 |
| PTHR2 |
| RAI3 |
| RDC1 |
| RE2 |
| RHO |
| RRH |
| SALPR |
| SCTR |
| SMOH |
| SREB3 |
| SSTR1 |
| SSTR2 |
| SSTR3 |
| SSTR4 |
| SSTR5 |
| TACR1 |
| TACR3 |
| TBXA2R |
| TEM5 |
| TM7SF1 |
| TM7SF1L1 |
| TM7SF1L2 |
| TM7SF3 |
| TPRA40 |
| TRHR |
| TRHR2 |
| VIPR2 |
| VLGR1 |

Amygdala. GPCRs expressed in the amygdala are listed in Table 4. These receptors are thus potential targets for therapeutic compounds that may modulate the activity, expression, or stability of the GPCR in the amydala. These polypeptides, or polymorphs of these polypeptides, may form the basis of a therapeutic regimen, or a diagnostic test to determine, e.g., the presence of disease, the risk of developing a particular disease or disorder, or an appropriate therapeutic course.

TABLE 4

| GPCRs Expressed in the Amygdala |
|---|
| ADCYAP1R1 |
| ADMR |
| ADORA1 |
| ADORA2A |
| ADORA2B |
| ADORA3 |
| ADRA1A |
| ADRA1D |
| ADRA2A |
| ADRA2C |
| ADRB1 |
| ADRB2 |
| AGR9 |
| AGTR1 |
| AGTR2 |
| AGTRL1 |
| BAI1 |
| BAI2 |
| BAI3 |
| BRS3 |
| C5R1 |
| CALCRL |
| CASR |
| CCBP2 |
| CCKBR |
| CCR5 |
| CCR6 |
| CCR9 |
| CCRL1 |
| CD97 |
| CELSR1 |
| CELSR2 |
| CELSR3 |
| CHRM1 |
| CHRM2 |
| CHRM3 |
| CHRM4 |
| CHRM5 |
| CMKBR1L2 |
| CMKLR1 |
| CNR1 |
| CRHR1 |
| CRHR2 |
| CX3CR1 |
| CXCR6 |
| DJ287G14 |
| DRD1 |
| DRD2 |
| DRD5 |
| EBI2 |
| EDG1 |
| EDG2 |
| EDG4 |
| EDG5 |
| EDG7 |
| EDG8 |
| EDNRA |
| EDNRB |
| EMR1 |
| ETL |
| F2R |
| F2RL2 |
| FPR1 |
| FPR-RS2 |
| FY |
| FZD1 |
| FZD10 |
| FZD2 |
| FZD3 |
| FZD4 |
| FZD5 |
| FZD6 |
| FZD7 |
| GABBR1 |
| GALR1 |
| GALR2 |
| GIPR |
| GLP1R |

TABLE 4-continued

GPCRs Expressed in the Amygdala

GPCR150
GPR1
GPR10
GPR101
GPR103
GPR105
GPR12
GPR14
GPR15
GPR17
GPR19
GPR2
GPR21
GPR22
GPR23
GPR24
GPR26
GPR27
GPR3
GPR30
GPR34
GPR37
GPR37L1
GPR4
GPR45
GPR48
GPR50
GPR51
GPR54
GPR55
GPR56
GPR6
GPR61
GPR62
GPR63
GPR64
GPR66
GPR7
GPR73L1
GPR75
GPR77
GPR80
GPR81
GPR82
GPR83
GPR84
GPR85
GPR86
GPR87
GPR88
GPR9
GPR92
GPRC5B
GPRC5C
GRCA
GRM1
GRM2
GRM3
GRM4
GRM5
GRM7
GRM8
GRPR
H963
HCRTR1
HCRTR2
HRH1
HRH2
HRH3
HTR1A
HTR1B
HTR1D
HTR1F
HTR2A
HTR2B
HTR2C
HTR4
HTR5A
HTR7
HUMNPIIY20
KIAA0758
KIAA1828
LEC1
LEC2
LEC3
LGR7
LHCGR
LTB4R
MAS1
MC2R
MC3R
MC4R
MC5R
MRG
MRGE
MRGF
NMBR
NMU2R
NPFF1R
NPY2R
NPY5R
NTSR1
NTSR2
OPN1MW
OPN3
OPRD1
OPRK1
OPRL1
OPRM1
OXTR
P2RY1
P2RY12
P2RY2
P2RY6
P2Y5
PGR1
PGR10
PGR11
PGR13
PGR14
PGR15
PGR18
PGR20
PGR21
PGR22
PGR25
PGR28
PGR3
PGR7
PTAFR
PTGDR
PTGER1
PTGER2
PTGER3
PTGER4
PTHR1
PTHR2
RAI3
RDC1
RE2
SALPR
SCTR
SMOH
SREB3
SSTR1
SSTR2
SSTR3
SSTR4
SSTR5
TACR1
TACR2
TACR3
TEM5
TM7SF1
TM7SF1L1
TM7SF1L2

TABLE 4-continued

GPCRs Expressed in the Amygdala

TM7SF3
TPRA40
TRHR
TRHR2

Pituitary. GPCRs expressed in the pituitary are listed in Table 5. These receptors are thus potential targets for therapeutic compounds that may modulate the activity, expression, or stability of the GPCR in the pituitary. These polypeptides, or polymorphs of these polypeptides, may form the basis of a therapeutic regimen, or a diagnostic test to determine, e.g., the presence of disease, the risk of developing a particular disease or disorder, or an appropriate therapeutic course.

TABLE 5

GPCRs Expressed in the Pituitary

ADCYAP1R1
ADMR
ADORA1
ADORA2A
ADORA2B
ADORA3
ADRB1
ADRB2
AGTR1
AGTRL1
AVPR1B
BAI2
BAI3
BDKRB1
BDKRB2
C3AR1
C5R1
CALCRL
CASR
CCKBR
CCR1
CCR2
CCR4
CCR5
CCR6
CCR7
CCR8
CCRL1
CD97
CELSR1
CELSR2
CELSR3
CHRM1
CHRM2
CHRM3
CHRM4
CHRM5
CMKBR1L2
CMKLR1
CNR1
CNR2
CRHR1
CX3CR1
CXCR4
CXCR6
CYSLT1
CYSLT2
DJ287G14
DRD1
DRD2
DRD3
DRD4
EBI2
EDG1
EDG2
EDG3

TABLE 5-continued

GPCRs Expressed in the Pituitary

EDG4
EDG5
EDG6
EDNRA
EDNRB
EMR1
ETL
F2R
F2RL1
F2RL2
F2RL3
FKSG79
FPR1
FPR-RS2
FSHR
FY
FZD1
FZD10
FZD2
FZD3
FZD4
FZD5
FZD6
G2A
GABBR1
GALR1
GALR3
GHRHR
GHSR
GLP1R
GNRHR
GPCR150
GPR10
GPR105
GPR12
GPR18
GPR19
GPR20
GPR21
GPR22
GPR23
GPR24
GPR27
GPR30
GPR31
GPR34
GPR35
GPR37L1
GPR39
GPR4
GPR43
GPR45
GPR48
GPR49
GPR50
GPR51
GPR54
GPR56
GPR6
GPR62
GPR63
GPR65
GPR66
GPR68
GPR7
GPR73
GPR73L1
GPR74
GPR75
GPR81
GPR82
GPR84
GPR85
GPR86
GPR87
GPR9
GPR92
GPRC5B

TABLE 5-continued

GPCRs Expressed in the Pituitary

GPRC5C
GRCA
GRM5
GRM6
GRPR
H963
HCRTR1
HGPCR11
HM74
HRH1
HRH2
HRH3
HTR1D
HTR1F
HTR2A
HTR2B
HTR4
IL8RA
KIAA0758
KIAA1828
LEC1
LEC2
LEC3
LGR6
LHCGR
LTB4R
MAS1
MC1R
MC3R
MC4R
MRG
MrgA1
MrgG
NMU2R
NTSR2
OPRL1
OPRM1
OXTR
P2RY1
P2RY12
P2RY2
P2RY6
P2Y10
P2Y5
PGR1
PGR10
PGR12
PGR13
PGR15
PGR16
PGR19
PGR21
PGR22
PGR25
PGR26
PGR27
PGR28
PGR3
PGR4
PGR7
PGR8
PTAFR
PTGDR
PTGER2
PTGER3
PTGER4
PTGFR
RAI3
RDC1
RE2
RHO
SALPR
SMOH
SREB3
SSTR1
SSTR2
SSTR3
SSTR4
SSTR5
TEM5
TM7SF1
TM7SF1L1
TM7SF1L2
TM7SF3
TPRA40
TRHR
TRHR2
TSHR
VIPR2
VLGR1

Brain. GPCRs expressed in the female brain are listed in Table 6, and GPCRs expressed in the male brain are listed in Table 7. These receptors are thus potential targets for therapeutic compounds that may modulate their activity, expression, or stability in the female or male nervous system. These polypeptides, or polymorphs of these polypeptides, may form the basis of a therapeutic regimen, or a diagnostic test to determine, e.g., the presence of a disease or disorder of the nervous system, the risk of developing a particular disease or disorder, or an appropriate therapeutic course.

TABLE 6

GPCRs Expressed in the Female Brain

ADCYAP1R1
ADMR
ADORA1
ADORA2A
ADORA2B
ADORA3
ADRA1A
ADRA1D
ADRA2A
ADRA2B
ADRB1
ADRB2
AGR9
AGTR2
AGTRL1
AVPR2
BAI1
BAI2
BAI3
BDKRB1
BLR1
BRS3
C3AR1
C5R1
CALCR
CALCRL
CASR
CCBP2
CCKAR
CCKBR
CCR1
CCR2
CCR5
CCR6
CCR8
CCRL1
CD97
CELSR1
CELSR2
CELSR3
CHRM1
CHRM2
CHRM3
CHRM4
CHRM5
CMKLR1

TABLE 6-continued

GPCRs Expressed in the Female Brain

| | |
|---|---|
| CNR1 | GPR45 |
| CNR2 | GPR48 |
| CRHR1 | GPR49 |
| CRHR2 | GPR50 |
| CX3CR1 | GPR51 |
| CXCR4 | GPR54 |
| CXCR6 | GPR55 |
| CYSLT1 | GPR56 |
| DJ287G14 | GPR57 |
| DRD1 | GPR6 |
| DRD2 | GPR61 |
| DRD3 | GPR62 |
| DRD4 | GPR63 |
| DRD5 | GPR64 |
| EBI2 | GPR65 |
| EDG1 | GPR66 |
| EDG2 | GPR68 |
| EDG3 | GPR7 |
| EDG4 | GPR73 |
| EDG5 | GPR73L1 |
| EDG6 | GPR75 |
| EDG7 | GPR77 |
| EDG8 | GPR80 |
| EDNRA | GPR81 |
| EDNRB | GPR82 |
| EMR1 | GPR83 |
| ETL | GPR84 |
| F2R | GPR85 |
| F2RL1 | GPR86 |
| F2RL2 | GPR88 |
| F2RL3 | GPR92 |
| FKSG79 | GPRC5B |
| FPR1 | GPRC5C |
| FPR-RS2 | GPRC5D |
| FY | GRCA |
| FZD1 | GRM1 |
| FZD10 | GRM2 |
| FZD2 | GRM3 |
| FZD3 | GRM4 |
| FZD4 | GRM5 |
| FZD5 | GRM6 |
| FZD6 | GRM7 |
| FZD7 | GRM8 |
| FZD8 | GRPR |
| GABBR1 | H963 |
| GALR1 | HCRTR1 |
| GALR2 | HCRTR2 |
| GHSR | HGPCR11 |
| GIPR | HGPCR2 |
| GLP1R | HRH1 |
| GLP2R | HRH2 |
| GPCR150 | HRH3 |
| GPR1 | HTR1A |
| GPR10 | HTR1B |
| GPR101 | HTR1D |
| GPR103 | HTR1F |
| GPR105 | HTR2A |
| GPR12 | HTR2B |
| GPR14 | HTR2C |
| GPR15 | HTR4 |
| GPR17 | HTR5A |
| GPR18 | HTR6 |
| GPR19 | HTR7 |
| GPR20 | HUMNPIIY20 |
| GPR21 | KIAA0758 |
| GPR22 | KIAA1828 |
| GPR23 | LEC1 |
| GPR24 | LEC2 |
| GPR26 | LEC3 |
| GPR27 | LGR6 |
| GPR3 | LGR7 |
| GPR30 | LGR8 |
| GPR34 | LTB4R2 |
| GPR35 | MAS1 |
| GPR37 | MC3R |
| GPR37L1 | MC4R |
| GPR4 | MC5R |
| GPR43 | MRG |

TABLE 6-continued

GPCRs Expressed in the Female Brain

MrgA1
MRGE
MRGF
MrgG
MTNR1A
NMBR
NMU2R
NPFF1R
NPY1R
NPY5R
NTSR1
NTSR2
OA1
OPN1MW
OPN1SW
OPN3
OPRD1
OPRK1
OPRL1
OPRM1
OXTR
P2RY1
P2RY12
P2RY6
P2Y10
P2Y5
PGR1
PGR10
PGR11
PGR12
PGR13
PGR14
PGR15
PGR18
PGR20
PGR21
PGR22
PGR25
PGR27
PGR28
PGR3
PGR5
PGR7
PGR8
PTAFR
PTGDR
PTGER1
PTGER2
PTGER3
PTGER4
PTGFR
PTHR1
PTHR2
RAI3
RDC1
RE2
RRH
SCTR
SMOH
SREB3
SSTR1
SSTR2
SSTR3
SSTR4
SSTR5
TACR1
TACR3
TBXA2R
TEM5
TM7SF1
TM7SF1L1
TM7SF1L2
TM7SF3
TPRA40
TRHR
TRHR2
TSHR
VIPR1

TABLE 6-continued

GPCRs Expressed in the Female Brain

VIPR2
VLGR1

TABLE 7

GPCRs Expressed in the Male Brain

ADCYAP1R1
ADMR
ADORA1
ADORA2A
ADORA2B
ADORA3
ADRA1A
ADRA1D
ADRA2A
ADRA2B
ADRA2C
ADRB1
ADRB2
AGR9
AGTR1
AGTR2
AGTRL1
AVPR2
BAI1
BAI2
BAI3
BDKRB1
BDKRB2
BRS3
C3AR1
C5R1
CALCR
CALCRL
CASR
CCBP2
CCKAR
CCKBR
CCR1
CCR4
CCR5
CCR6
CCR7
CCR8
CCRL1
CD97
CELSR1
CELSR2
CELSR3
CHRM1
CHRM2
CHRM3
CHRM4
CHRM5
CMKLR1
CNR1
CRHR1
CRHR2
CX3CR1
CXCR4
CXCR6
CYSLT1
DJ287G14
DRD1
DRD2
DRD3
DRD4
DRD5
EBI2
EDG1
EDG2
EDG3
EDG4
EDG5

TABLE 7-continued

GPCRs Expressed in the Male Brain

EDG6
EDG7
EDG8
EDNRA
EDNRB
EMR1
ETL
F2R
F2RL1
F2RL2
F2RL3
FKSG79
FPR-RS2
FY
FZD1
FZD10
FZD2
FZD3
FZD4
FZD5
FZD6
FZD7
FZD8
G2A
GABBR1
GALR1
GALR2
GCGR
GIPR
GLP1R
GLP2R
GPCR150
GPR1
GPR10
GPR101
GPR103
GPR105
GPR12
GPR14
GPR15
GPR17
GPR18
GPR19
GPR21
GPR22
GPR23
GPR24
GPR26
GPR27
GPR3
GPR30
GPR34
GPR35
GPR37
GPR37L1
GPR4
GPR43
GPR44
GPR45
GPR48
GPR49
GPR50
GPR51
GPR54
GPR55
GPR56
GPR6
GPR61
GPR62
GPR63
GPR65
GPR66
GPR68
GPR7
GPR73L1
GPR75
GPR77
GPR80
GPR81
GPR82
GPR83
GPR84
GPR85
GPR86
GPR88
GPR92
GPRC5B
GPRC5C
GPRC5D
GRCA
GRM1
GRM2
GRM3
GRM4
GRM5
GRM6
GRM7
GRM8
GRPR
H963
HCRTR1
HCRTR2
HRH1
HRH2
HRH3
HTR1A
HTR1B
HTR1D
HTR1F
HTR2A
HTR2B
HTR2C
HTR4
HTR5A
HTR6
HTR7
HUMNPIIY20
KIAA0758
KIAA1828
LEC1
LEC2
LEC3
LGR6
LGR7
LGR8
LHCGR
LTB4R
MAS1
MC3R
MC4R
MC5R
MRG
MRGE
MRGF
MTNR1A
NMBR
NMU2R
NPFF1R
NPY1R
NPY2R
NPY5R
NTSR1
NTSR2
OA1
OPN1MW
OPN3
OPRD1
OPRK1
OPRL1
OPRM1
OXTR
P2RY1
P2RY12
P2RY2
P2RY6
P2Y5

TABLE 7-continued

GPCRs Expressed in the Male Brain

PGR1
PGR10
PGR11
PGR13
PGR14
PGR15
PGR17
PGR18
PGR20
PGR21
PGR22
PGR25
PGR27
PGR28
PGR3
PGR7
PGR8
PTAFR
PTGDR
PTGER1
PTGER3
PTGER4
PTGFR
PTHR1
PTHR2
RAI3
RDC1
RE2
RRH
SMOH
SREB3
SSTR1
SSTR2
SSTR3
SSTR4
SSTR5
TACR1
TACR3
TEM5
TM7SF1
TM7SF1L1
TM7SF1L2
TM7SF3
TPRA40
TRHR
TRHR2
TSHR
VIPR2
VLGR1

Brainstem and midbrain. GPCRs expressed in the brainstem and midbrain are listed in Table 8. These receptors are thus potential targets for therapeutic compounds that may modulate their activity, expression, or stability in the nervous system. These polypeptides, or polymorphs of these polypeptides, may form the basis of a therapeutic regimen, or a diagnostic test to determine, e.g., the presence of a disease or disorder of the nervous system, the risk of developing a particular disease or disorder, or an appropriate therapeutic course.

TABLE 8

GPCRs Expressed in the Brainstem

ADCYAP1R1
ADMR
ADORA1
ADORA2A
ADORA2B
ADORA3
ADRA1A
ADRA1D
ADRA2A

TABLE 8-continued

GPCRs Expressed in the Brainstem

ADRA2B
ADRB1
ADRB2
AGR9
AGTR1
AGTR2
AGTRL1
AVPR1A
AVPR2
BAI1
BAI2
BAI3
BDKRB1
BDKRB2
BLR1
BRS3
C5R1
CALCR
CALCRL
CASR
CCBP2
CCKAR
CCKBR
CCR1
CCR5
CCR6
CCR7
CCRL1
CD97
CELSR1
CELSR2
CELSR3
CHRM1
CHRM2
CHRM3
CHRM4
CHRM5
CMKBR1L2
CMKLR1
CNR1
CNR2
CRHR1
CRHR2
CX3CR1
CXCR4
CXCR6
CYSLT1
DJ287G14
DRD1
DRD2
DRD3
DRD5
EBI2
EDG1
EDG2
EDG3
EDG4
EDG5
EDG6
EDG7
EDG8
EDNRA
EDNRB
EMR1
ETL
F2R
F2RL1
F2RL2
FKSG79
FPR1
FPR-RS2
FY
FZD1
FZD10
FZD2
FZD3
FZD4
FZD5

TABLE 8-continued

GPCRs Expressed in the Brainstem

FZD6
FZD7
G2A
GABBR1
GALR1
GALR2
GHSR
GIPR
GLP1R
GPCR150
GPR1
GPR10
GPR101
GPR103
GPR105
GPR12
GPR14
GPR15
GPR17
GPR18
GPR19
GPR2
GPR20
GPR21
GPR22
GPR23
GPR24
GPR26
GPR27
GPR3
GPR30
GPR31
GPR34
GPR35
GPR37
GPR37L1
GPR4
GPR41
GPR43
GPR45
GPR48
GPR49
GPR50
GPR51
GPR54
GPR56
GPR6
GPR61
GPR62
GPR63
GPR65
GPR66
GPR68
GPR7
GPR73
GPR73L1
GPR74
GPR75
GPR77
GPR80
GPR81
GPR82
GPR83
GPR84
GPR85
GPR86
GPR87
GPR88
GPR90
GPR92
GPRC5B
GPRC5C
GPRC5D
GRCA
GRM1
GRM2
GRM3
GRM4
GRM5
GRM7
GRM8
GRPR
H963
HCRTR1
HCRTR2
HGPCR11
HGPCR2
HRH1
HRH2
HRH3
HTR1A
HTR1B
HTR1D
HTR1F
HTR2A
HTR2B
HTR2C
HTR4
HTR5A
HTR6
HTR7
HUMNPIIY20
KIAA0758
KIAA1828
LEC1
LEC2
LEC3
LGR6
LGR8
LHCGR
MAS1
MC2R
MC3R
MC4R
MC5R
MRG
MRGE
MRGF
MTNR1A
NMBR
NMU2R
NPFF1R
NPY2R
NPY5R
NTSR1
NTSR2
OA1
OPN1MW
OPN3
OPRD1
OPRK1
OPRL1
OPRM1
OXTR
P2RY1
P2RY12
P2RY2
P2RY6
P2Y5
PGR10
PGR11
PGR13
PGR14
PGR15
PGR16
PGR18
PGR20
PGR21
PGR22
PGR23
PGR27
PGR28
PGR3
PGR7
PPYR1
PTAFR

TABLE 8-continued

GPCRs Expressed in the Brainstem

PTGDR
PTGER1
PTGER2
PTGER3
PTGER4
PTGFR
PTGIR
RAI3
RDC1
RE2
RRH
SALPR
SCTR
SMOH
SREB3
SSTR1
SSTR2
SSTR3
SSTR4
TACR2
TACR3
TEM5
TM7SF1
TM7SF1L1
TM7SF1L2
TM7SF3
TPRA40
TRHR
TRHR2
TSHR
VIPR2
VLGR1

Cerebellum. GPCRs expressed in the cerebellum are listed in Table 9. These receptors are thus potential targets for therapeutic compounds that may modulate the activity, expression, or stability of the GPCR in the cerebellum. These polypeptides, or polymorphs of these polypeptides, may form the basis of a therapeutic regimen, or a diagnostic test to determine, e.g., the presence of disease, the risk of developing a particular disease or disorder, or an appropriate therapeutic course.

TABLE 9

GPCRs Expressed in the Cerebellum

ADCYAP1R1
ADMR
ADORA1
ADORA2A
ADORA2B
ADORA3
ADRA1A
ADRA1D
ADRA2A
ADRA2B
ADRB1
ADRB2
AGR9
AGTR1
AGTR2
AGTRL1
AVPR2
BAI1
BAI2
BAI3
BDKRB1
BLR1
C3AR1
C5R1
CALCR
CALCRL
CCKBR

TABLE 9-continued

GPCRs Expressed in the Cerebellum

CCR1
CCR5
CCR6
CCR7
CCR8
CCR9
CCRL1
CD97
CELSR1
CELSR2
CELSR3
CHRM1
CHRM2
CHRM3
CHRM4
CHRM5
CMKLR1
CNR1
CNR2
CRHR1
CRHR2
CX3CR1
CXCR4
CXCR6
CYSLT1
CYSLT2
DJ287G14
DRD2
DRD3
DRD4
DRD5
EBI2
EDG1
EDG2
EDG3
EDG4
EDG5
EDG7
EDG8
EDNRA
EDNRB
EMR1
ETL
F2R
F2RL1
F2RL2
F2RL3
FPR1
FPR-RS2
FY
FZD1
FZD10
FZD2
FZD3
FZD4
FZD5
FZD6
FZD7
FZD8
G2A
GABBR1
GALR1
GALR2
GALR3
GCGR
GIPR
GLP1R
GLP2R
GPCR150
GPR1
GPR10
GPR105
GPR12
GPR14
GPR15
GPR17
GPR18
GPR19

TABLE 9-continued

GPCRs Expressed in the Cerebellum

| |
|---|
| GPR2 |
| GPR21 |
| GPR22 |
| GPR23 |
| GPR24 |
| GPR26 |
| GPR27 |
| GPR30 |
| GPR34 |
| GPR35 |
| GPR37 |
| GPR37L1 |
| GPR4 |
| GPR43 |
| GPR44 |
| GPR45 |
| GPR48 |
| GPR49 |
| GPR50 |
| GPR51 |
| GPR54 |
| GPR55 |
| GPR62 |
| GPR63 |
| GPR66 |
| GPR68 |
| GPR73L1 |
| GPR75 |
| GPR77 |
| GPR80 |
| GPR81 |
| GPR82 |
| GPR83 |
| GPR84 |
| GPR85 |
| GPR86 |
| GPR87 |
| GPR90 |
| GPR92 |
| GPRC5B |
| GPRC5C |
| GRCA |
| GRM1 |
| GRM2 |
| GRM3 |
| GRM4 |
| GRM5 |
| GRM7 |
| GRM8 |
| H963 |
| HCRTR1 |
| HCRTR2 |
| HGPCR11 |
| HGPCR19 |
| HM74 |
| HRH1 |
| HRH2 |
| HRH3 |
| HTR1A |
| HTR1B |
| HTR1F |
| HTR2A |
| HTR2B |
| HTR2C |
| HTR4 |
| HTR5A |
| HTR7 |
| HUMNPIIY20 |
| IL8RA |
| KIAA0758 |
| KIAA1828 |
| LEC1 |
| LEC2 |
| LEC3 |
| LGR6 |
| LGR7 |
| LHCGR |
| LTB4R |
| LTB4R2 |
| MAS1 |
| MC3R |
| MC4R |
| MC5R |
| MRG |
| MRGE |
| MRGF |
| MrgG |
| NMBR |
| NPY5R |
| NPY6R |
| NTSR1 |
| NTSR2 |
| OA1 |
| OPN3 |
| OPRD1 |
| OPRL1 |
| OPRM1 |
| OXTR |
| P2RY1 |
| P2RY12 |
| P2RY2 |
| P2RY4 |
| P2RY6 |
| P2Y10 |
| P2Y5 |
| PGR1 |
| PGR11 |
| PGR12 |
| PGR13 |
| PGR14 |
| PGR15 |
| PGR16 |
| PGR18 |
| PGR20 |
| PGR21 |
| PGR22 |
| PGR23 |
| PGR26 |
| PGR27 |
| PGR28 |
| PGR3 |
| PGR4 |
| PGR7 |
| PGR8 |
| PTAFR |
| PTGDR |
| PTGER1 |
| PTGER2 |
| PTGER3 |
| PTGER4 |
| PTGFR |
| PTGIR |
| PTHR1 |
| PTHR2 |
| RAI3 |
| RDC1 |
| RE2 |
| RHO |
| RRH |
| SCTR |
| SMOH |
| SREB3 |
| SSTR1 |
| SSTR2 |
| SSTR3 |
| SSTR4 |
| SSTR5 |
| TAR1 |
| TBXA2R |
| TEM5 |
| TM7SF1 |
| TM7SF1L1 |
| TM7SF1L2 |
| TM7SF3 |
| TPRA40 |
| TRHR2 |

TABLE 9-continued

GPCRs Expressed in the Cerebellum

TSHR
VIPR2

Cerebral cortex. GPCRs expressed in the regions of the cerebral cortex other than the frontal cortex are listed in Table 10. These receptors are thus potential targets for therapeutic compounds that may modulate GPCR activity, expression, or stability in the cerebral cortex. These polypeptides, or polymorphs of these polypeptides, may form the basis of a therapeutic regimen, or a diagnostic test to determine, e.g., the presence of a disease or disorder involving the cerebral cortex, the risk of developing a particular disease or disorder, or an appropriate therapeutic course.

TABLE 10

GPCRs Expressed in the Cortex

ADCYAP1R1
ADMR
ADORA1
ADORA2A
ADORA2B
ADORA3
ADRA1A
ADRA1D
ADRA2A
ADRA2B
ADRA2C
ADRB1
ADRB2
AGR9
AGTR1
AGTRL1
AVPR2
BAI1
BAI2
BAI3
BDKRB2
C3AR1
C5R1
CALCR
CALCRL
CASR
CCBP2
CCKBR
CCR1
CCR2
CCR5
CCR6
CCR7
CCR9
CCRL1
CCXCR1
CD97
CELSR1
CELSR2
CELSR3
CHRM1
CHRM2
CHRM3
CHRM4
CHRM5
CMKBR1L2
CMKLR1
CNR1
CNR2
CRHR1
CRHR2
CX3CR1
CXCR4
CXCR6
CYSLT1
CYSLT2

TABLE 10-continued

GPCRs Expressed in the Cortex

DJ287G14
DRD1
DRD2
DRD3
DRD5
EBI2
EDG1
EDG2
EDG3
EDG4
EDG5
EDG7
EDG8
EDNRA
EDNRB
EMR1
ETL
F2R
F2RL1
F2RL2
F2RL3
FPR1
FPR-RS2
FY
FZD1
FZD10
FZD2
FZD3
FZD4
FZD5
FZD6
FZD7
FZD8
G2A
GABBR1
GALR1
GALR2
GCGR
GHSR
GLP1R
GLP2R
GPCR150
GPR1
GPR10
GPR101
GPR103
GPR105
GPR12
GPR14
GPR17
GPR18
GPR19
GPR20
GPR21
GPR22
GPR23
GPR24
GPR26
GPR27
GPR3
GPR30
GPR31
GPR34
GPR35
GPR37
GPR37L1
GPR4
GPR41
GPR43
GPR44
GPR45
GPR48
GPR50
GPR51
GPR54
GPR55
GPR56
GPR6

TABLE 10-continued

GPCRs Expressed in the Cortex

GPR61
GPR62
GPR63
GPR66
GPR68
GPR7
GPR73
GPR73L1
GPR74
GPR75
GPR77
GPR80
GPR81
GPR82
GPR83
GPR84
GPR85
GPR86
GPR87
GPR88
GPR92
GPRC5B
GPRC5C
GPRC5D
GRCA
GRM1
GRM2
GRM3
GRM4
GRM5
GRM7
GRM8
GRPR
H963
HCRTR1
HCRTR2
HM74
HRH1
HRH2
HRH3
HTR1A
HTR1B
HTR1D
HTR1F
HTR2A
HTR2B
HTR2C
HTR4
HTR5A
HTR6
HTR7
HUMNPIIY20
IL8RA
KIAA0758
KIAA1828
LEC1
LEC2
LEC3
LGR6
LGR7
LGR8
LHCGR
LTB4R
MAS1
MC1R
MC3R
MC4R
MC5R
MRG
MRGE
MRGF
NMBR
NPY1R
NPY5R
NTSR1
NTSR2
OPN1MW
OPN3
OPRD1
OPRK1
OPRL1
OPRM1
OXTR
P2RY1
P2RY12
P2RY6
P2Y10
P2Y5
PGR1
PGR10
PGR11
PGR13
PGR14
PGR15
PGR16
PGR18
PGR20
PGR21
PGR22
PGR25
PGR26
PGR28
PGR3
PGR7
PGR8
PTAFR
PTGDR
PTGER1
PTGER3
PTGER4
PTGFR
PTHR1
PTHR2
RAI3
RDC1
RE2
SALPR
SCTR
SMOH
SREB3
SSTR1
SSTR2
SSTR3
SSTR4
SSTR5
TACR3
TBXA2R
TEM5
TM7SF1
TM7SF1L1
TM7SF1L2
TM7SF3
TPRA40
TRHR
TRHR2
TSHR
VIPR1
VIPR2
VLGR1

Frontal cortex. GPCRs expressed in the frontal cortex are listed in Table 11. These receptors are thus potential targets for therapeutic compounds that may modulate their activity, expression, or stability in the frontal cortex. These polypeptides, or polymorphs of these polypeptides, may form the basis of a therapeutic regimen, or a diagnostic test to determine, e.g., the presence of a disease or disorder involving the frontal cortex, the risk of developing a particular disease or disorder, or an appropriate therapeutic course.

TABLE 11

GPCRs Expressed in the Frontal Cortex

ADCYAP1R1
ADMR
ADORA1
ADORA2A
ADORA2B
ADORA3
ADRA1A
ADRA1D
ADRA2A
ADRA2B
ADRA2C
ADRB1
ADRB2
AGR9
AGTR1
AGTR2
AGTRL1
AVPR1A
BAI1
BAI2
BAI3
BDKRB1
BDKRB2
C3AR1
C5R1
CALCRL
CASR
CCBP2
CCKAR
CCKBR
CCR1
CCR2
CCR5
CCR6
CCR7
CCRL1
CD97
CELSR1
CELSR2
CELSR3
CHRM1
CHRM2
CHRM3
CHRM4
CHRM5
CMKLR1
CNR1
CNR2
CRHR1
CRHR2
CX3CR1
CXCR4
CXCR6
CYSLT1
DJ287G14
DRD1
DRD2
DRD3
DRD4
DRD5
EBI2
EDG1
EDG2
EDG3
EDG5
EDG7
EDG8
EDNRA
EDNRB
EMR1
ETL
F2R
F2RL1
F2RL2
F2RL3
FPR1
FPR-RS2
FSHR

TABLE 11-continued

GPCRs Expressed in the Frontal Cortex

FY
FZD1
FZD10
FZD2
FZD3
FZD4
FZD5
FZD6
FZD9
G2A
GABBR1
GALR1
GALR2
GALR3
GHRHR
GIPR
GLP1R
GLP2R
GPCR150
GPR1
GPR10
GPR101
GPR103
GPR105
GPR12
GPR14
GPR15
GPR17
GPR18
GPR19
GPR2
GPR21
GPR22
GPR23
GPR24
GPR26
GPR27
GPR3
GPR30
GPR34
GPR35
GPR37
GPR37L1
GPR4
GPR43
GPR45
GPR48
GPR49
GPR50
GPR54
GPR55
GPR56
GPR6
GPR62
GPR63
GPR65
GPR66
GPR68
GPR7
GPR73L1
GPR74
GPR75
GPR77
GPR80
GPR81
GPR82
GPR83
GPR84
GPR85
GPR86
GPR87
GPR88
GPR92
GPRC5B
GPRC5D
GRCA
GRM1
GRM2

TABLE 11-continued

GPCRs Expressed in the Frontal Cortex

GRM3
GRM4
GRM5
GRM7
GRM8
GRPR
H963
HCRTR1
HCRTR2
HM74
HRH1
HRH2
HRH3
HTR1A
HTR1B
HTR1D
HTR1F
HTR2A
HTR2B
HTR2C
HTR4
HTR5A
HTR6
HTR7
HUMNPIIY20
KIAA0758
KIAA1828
LEC1
LEC2
LEC3
LGR6
LGR7
LGR8
LHCGR
LTB4R
MAS1
MC2R
MC3R
MC4R
MC5R
MRG
MRGE
MRGF
NMBR
NMU2R
NPY1R
NPY2R
NPY5R
NTSR1
NTSR2
OA1
OPN1MW
OPN3
OPRD1
OPRK1
OPRL1
OPRM1
OXTR
P2RY1
P2RY12
P2RY2
P2RY6
P2Y10
P2Y5
PGR10
PGR11
PGR12
PGR13
PGR14
PGR15
PGR16
PGR18
PGR20
PGR21
PGR22
PGR25
PGR26
PGR28
PGR3
PGR4
PGR7
PPYR1
PTAFR
PTGDR
PTGER1
PTGER3
PTGER4
PTGFR
PTHR1
RAI3
RDC1
RE2
RHO
RRH
SCTR
SMOH
SREB3
SSTR1
SSTR2
SSTR3
SSTR4
SSTR5
TACR1
TACR3
TAR2
TAR3
TEM5
TM7SF1
TM7SF1L1
TM7SF1L2
TM7SF3
TPRA40
TRHR
TRHR2
TSHR
VIPR1
VIPR2
VLGR1

Hippocampus. GPCRs expressed in the hippocampus are listed in Table 12. These receptors are thus potential targets for therapeutic compounds that may modulate their activity, expression, or stability in the hippocampus. These polypeptides, or polymorphs of these polypeptides, may form the basis of a therapeutic regimen, or a diagnostic test to determine, e.g., the presence of a disease or disorder of the hippocampus, the risk of developing a particular disease or disorder, or an appropriate therapeutic course.

TABLE 12

GPCRs Expressed in the Hippocampus

ADCYAP1R1
ADMR
ADORA1
ADORA2A
ADORA2B
ADORA3
ADRA1A
ADRA1D
ADRA2A
ADRA2B
ADRB1
ADRB2
AGR9
AGTR1
AGTR2
AVPR2
BAI1
BAI2
BAI3

TABLE 12-continued

GPCRs Expressed in the Hippocampus

BDKRB1
C3AR1
CALCRL
CASR
CCKAR
CCKBR
CCR2
CCR5
CCR6
CCRL1
CCXCR1
CD97
CELSR1
CELSR2
CELSR3
CHRM1
CHRM2
CHRM3
CHRM4
CHRM5
CMKLR1
CNR1
CRHR1
CRHR2
CX3CR1
CXCR4
CXCR6
CYSLT1
DJ287G14
DRD1
DRD2
DRD5
EBI2
EDG1
EDG2
EDG3
EDG4
EDG5
EDG6
EDG7
EDG8
EDNRA
EDNRB
EMR1
ETL
F2R
F2RL1
F2RL2
F2RL3
FY
FZD1
FZD2
FZD3
FZD4
FZD5
FZD6
FZD8
G2A
GABBR1
GALR1
GALR2
GALR3
GHSR
GIPR
GLP1R
GLP2R
GPCR150
GPR1
GPR101
GPR103
GPR105
GPR12
GPR14
GPR15
GPR17
GPR18
GPR19
GPR2

TABLE 12-continued

GPCRs Expressed in the Hippocampus

GPR21
GPR22
GPR23
GPR24
GPR26
GPR27
GPR3
GPR30
GPR34
GPR37
GPR37L1
GPR4
GPR44
GPR45
GPR48
GPR49
GPR50
GPR51
GPR54
GPR55
GPR6
GPR62
GPR63
GPR65
GPR68
GPR7
GPR73L1
GPR75
GPR77
GPR80
GPR81
GPR82
GPR83
GPR84
GPR85
GPR86
GPR87
GPR88
GPR92
GPRC5B
GPRC5C
GRCA
GRM1
GRM2
GRM3
GRM4
GRM5
GRM7
GRM8
GRPR
H963
HCRTR1
HCRTR2
HGPCR2
HM74
HRH1
HRH2
HRH3
HTR1A
HTR1B
HTR1F
HTR2A
HTR2B
HTR2C
HTR4
HTR5A
HTR7
HUMNPIIY20
KIAA0758
KIAA1828
LEC1
LEC2
LEC3
LGR6
LGR7
MAS1
MC3R
MC4R

TABLE 12-continued

GPCRs Expressed in the Hippocampus

MC5R
MRG
MRGE
MRGF
NMBR
NMU2R
NPFF1R
NPY2R
NTSR1
NTSR2
OA1
OPN3
OPRD1
OPRK1
OPRL1
OPRM1
OXTR
P2RY1
P2RY12
P2RY6
P2Y5
PGR10
PGR13
PGR14
PGR15
PGR16
PGR18
PGR20
PGR21
PGR22
PGR25
PGR27
PGR28
PGR3
PGR7
PTAFR
PTGER1
PTGER3
PTHR1
RDC1
RE2
RRH
SALPR
SCTR
SMOH
SREB3
SSTR1
SSTR2
SSTR3
SSTR4
SSTR5
TBXA2R
TEM5
TM7SF1
TM7SF1L1
TM7SF1L2
TM7SF3
TPRA40
TRHR
TRHR2
VIPR2
VLGR1

Striatum. GPCRs expressed in the striatum are listed in Table 13. These receptors are thus potential targets for therapeutic compounds that may modulate their activity, expression, or stability in the striatum. These polypeptides, or polymorphs of these polypeptides, may form the basis of a therapeutic regimen, or a diagnostic test to determine, e.g., the presence of a disease or disorder of the striatum, the risk of developing a particular disease or disorder, or an appropriate therapeutic course.

TABLE 13

GPCRs Expressed in the Striatum

ADCYAP1R1
ADMR
ADORA1
ADORA2A
ADORA2B
ADORA3
ADRA1A
ADRA1D
ADRA2A
ADRA2C
ADRB1
ADRB2
ADRB3
AGR9
AGTR1
AGTR2
AGTRL1
AVPR1A
AVPR1B
AVPR2
BAI1
BAI2
BAI3
BDKRB1
BLR1
BRS3
C3AR1
C5R1
CALCR
CALCRL
CCBP2
CCKAR
CCKBR
CCR1
CCR2
CCR5
CCR6
CCR7
CCR9
CCRL1
CD97
CELSR1
CELSR2
CELSR3
CHRM1
CHRM2
CHRM3
CHRM4
CHRM5
CMKBR1L2
CMKLR1
CNR1
CNR2
CRHR1
CRHR2
CX3CR1
CXCR4
CXCR6
CYSLT1
CYSLT2
DJ287G14
DRD1
DRD2
DRD3
DRD4
DRD5
EBI2
EDG1
EDG2
EDG3
EDG4
EDG5
EDG6
EDG7
EDG8
EDNRA
EDNRB
EMR1

TABLE 13-continued

GPCRs Expressed in the Striatum

| |
|---|
| ETL |
| F2R |
| F2RL1 |
| F2RL2 |
| FKSG79 |
| FPR1 |
| FPR-RS2 |
| FY |
| FZD1 |
| FZD10 |
| FZD2 |
| FZD3 |
| FZD4 |
| FZD5 |
| FZD6 |
| FZD8 |
| FZD9 |
| G2A |
| GABBR1 |
| GALR1 |
| GALR2 |
| GALR3 |
| GHSR |
| GIPR |
| GLP1R |
| GLP2R |
| GPCR150 |
| GPR1 |
| GPR10 |
| GPR101 |
| GPR103 |
| GPR105 |
| GPR12 |
| GPR14 |
| GPR15 |
| GPR17 |
| GPR18 |
| GPR19 |
| GPR2 |
| GPR20 |
| GPR21 |
| GPR22 |
| GPR23 |
| GPR24 |
| GPR26 |
| GPR27 |
| GPR3 |
| GPR30 |
| GPR31 |
| GPR34 |
| GPR35 |
| GPR37 |
| GPR37L1 |
| GPR4 |
| GPR41 |
| GPR43 |
| GPR45 |
| GPR48 |
| GPR49 |
| GPR50 |
| GPR51 |
| GPR54 |
| GPR55 |
| GPR56 |
| GPR57 |
| GPR6 |
| GPR61 |
| GPR62 |
| GPR63 |
| GPR65 |
| GPR66 |
| GPR68 |
| GPR7 |
| GPR73 |
| GPR73L1 |
| GPR74 |
| GPR75 |
| GPR77 |
| GPR80 |
| GPR81 |
| GPR82 |
| GPR83 |
| GPR84 |
| GPR85 |
| GPR86 |
| GPR87 |
| GPR88 |
| GPR9 |
| GPR90 |
| GPR92 |
| GPRC5B |
| GPRC5C |
| GPRC5D |
| GRCA |
| GRM1 |
| GRM2 |
| GRM3 |
| GRM4 |
| GRM5 |
| GRM7 |
| GRM8 |
| GRPR |
| H963 |
| HCRTR1 |
| HCRTR2 |
| HGPCR11 |
| HGPCR2 |
| HM74 |
| HRH1 |
| HRH2 |
| HRH3 |
| HTR1A |
| HTR1B |
| HTR1D |
| HTR1F |
| HTR2A |
| HTR2B |
| HTR2C |
| HTR4 |
| HTR5A |
| HTR6 |
| HTR7 |
| HUMNPIIY20 |
| IL8RB |
| KIAA0758 |
| KIAA1828 |
| LEC1 |
| LEC2 |
| LEC3 |
| LGR6 |
| LGR7 |
| LGR8 |
| LHCGR |
| LTB4R |
| LTB4R2 |
| MAS1 |
| MC2R |
| MC3R |
| MC4R |
| MC5R |
| MRG |
| MrgA1 |
| MRGE |
| MRGF |
| MTNR1A |
| NMBR |
| NMU2R |
| NPFF1R |
| NPY1R |
| NPY2R |
| NPY5R |
| NTSR1 |
| NTSR2 |
| OA1 |
| OPN1MW |
| OPN3 |

TABLE 13-continued

GPCRs Expressed in the Striatum

OPRD1
OPRK1
OPRL1
OPRM1
OXTR
P2RY1
P2RY12
P2RY6
P2Y10
P2Y5
PGR1
PGR10
PGR11
PGR12
PGR13
PGR14
PGR15
PGR17
PGR2
PGR20
PGR21
PGR22
PGR25
PGR26
PGR27
PGR28
PGR3
PGR5
PGR7
PGR8
PTAFR
PTGDR
PTGER1
PTGER2
PTGER3
PTGER4
PTGFR
PTGIR
PTHR1
RDC1
RE2
RHO
RRH
SALPR
SCTR
SMOH
SREB3
SSTR1
SSTR2
SSTR3
SSTR4
SSTR5
TACR1
TACR3
TBXA2R
TEM5
TM7SF1
TM7SF1L1
TM7SF1L2
TM7SF3
TPRA40
TRHR
TRHR2
TSHR
VIPR1
VIPR2
VLGR1

Thalamus. GPCRs expressed in the thalamus are listed in Table 14. These receptors are thus potential targets for therapeutic compounds that may modulate their activity, expression, or stability in the thalamus. These polypeptides, or polymorphs of these polypeptides, may form the basis of a therapeutic regimen, or a diagnostic test to determine, e.g., the presence of a disease or disorder of the thalamus, the risk of developing a particular disease or disorder, or an appropriate therapeutic course.

TABLE 14

GPCRs Expressed in the Thalamus

ADCYAP1R1
ADMR
ADORA1
ADORA2A
ADORA2B
ADORA3
ADRA1A
ADRA1D
ADRA2A
ADRA2B
ADRA2C
ADRB1
ADRB2
ADRB3
AGR9
AGTR1
AGTR2
AGTRL1
AVPR1A
AVPR2
BAI1
BAI2
BAI3
BDKRB1
BDKRB2
BRS3
C3AR1
C5R1
CALCR
CALCRL
CASR
CCKAR
CCKBR
CCR4
CCR5
CCR6
CCR7
CCRL1
CD97
CELSR2
CELSR3
CHRM1
CHRM2
CHRM3
CHRM4
CHRM5
CMKBR1L2
CMKLR1
CNR1
CNR2
CRHR1
CRHR2
CX3CR1
CXCR4
CXCR6
CYSLT1
DJ287G14
DRD1
DRD2
DRD3
DRD4
DRD5
EBI2
EDG1
EDG2
EDG3
EDG4
EDG5
EDG6
EDG7
EDG8
EDNRA
EDNRB

TABLE 14-continued

GPCRs Expressed in the Thalamus

| |
|---|
| EMR1 |
| ETL |
| F2R |
| F2RL1 |
| F2RL2 |
| F2RL3 |
| FKSG79 |
| FPR1 |
| FPR-RS2 |
| FSHR |
| FY |
| FZD1 |
| FZD10 |
| FZD2 |
| FZD3 |
| FZD4 |
| FZD5 |
| FZD6 |
| FZD8 |
| FZD9 |
| G2A |
| GABBR1 |
| GALR1 |
| GALR2 |
| GALR3 |
| GHRHR |
| GHSR |
| GIPR |
| GLP1R |
| GLP2R |
| GPCR150 |
| GPR1 |
| GPR10 |
| GPR101 |
| GPR103 |
| GPR105 |
| GPR12 |
| GPR14 |
| GPR15 |
| GPR17 |
| GPR18 |
| GPR19 |
| GPR2 |
| GPR21 |
| GPR22 |
| GPR23 |
| GPR24 |
| GPR26 |
| GPR27 |
| GPR3 |
| GPR30 |
| GPR31 |
| GPR34 |
| GPR35 |
| GPR37 |
| GPR37L1 |
| GPR4 |
| GPR43 |
| GPR44 |
| GPR45 |
| GPR48 |
| GPR49 |
| GPR50 |
| GPR51 |
| GPR54 |
| GPR55 |
| GPR56 |
| GPR6 |
| GPR62 |
| GPR63 |
| GPR64 |
| GPR65 |
| GPR66 |
| GPR68 |
| GPR7 |
| GPR73L1 |
| GPR74 |
| GPR75 |
| GPR77 |
| GPR80 |
| GPR81 |
| GPR82 |
| GPR83 |
| GPR84 |
| GPR85 |
| GPR86 |
| GPR87 |
| GPR88 |
| GPR9 |
| GPR92 |
| GPRC5B |
| GPRC5C |
| GPRC5D |
| GRCA |
| GRM1 |
| GRM2 |
| GRM3 |
| GRM4 |
| GRM5 |
| GRM7 |
| GRM8 |
| GRPR |
| H963 |
| HCRTR1 |
| HCRTR2 |
| HGPCR2 |
| HM74 |
| HRH1 |
| HRH2 |
| HRH3 |
| HRH4 |
| HTR1A |
| HTR1B |
| HTR1D |
| HTR1F |
| HTR2A |
| HTR2B |
| HTR2C |
| HTR4 |
| HTR5A |
| HTR7 |
| HUMNPIIY20 |
| IL8RA |
| KIAA0758 |
| KIAA1828 |
| LEC1 |
| LEC2 |
| LEC3 |
| LGR6 |
| LGR7 |
| LGR8 |
| LHCGR |
| LTB4R |
| LTB4R2 |
| MAS1 |
| MC3R |
| MC4R |
| MC5R |
| MRG |
| MrgA1 |
| MRGE |
| MRGF |
| MrgG |
| MTNR1A |
| NMBR |
| NMU2R |
| NPFF1R |
| NPY1R |
| NPY2R |
| NPY5R |
| NTSR1 |
| NTSR2 |
| OA1 |
| OPN1MW |
| OPN3 |
| OPRD1 |

TABLE 14-continued

GPCRs Expressed in the Thalamus

OPRK1
OPRL1
OPRM1
OXTR
P2RY1
P2RY12
P2RY2
P2RY4
P2RY6
P2Y10
P2Y5
PGR1
PGR10
PGR11
PGR12
PGR13
PGR14
PGR15
PGR16
PGR17
PGR18
PGR2
PGR20
PGR21
PGR22
PGR25
PGR26
PGR27
PGR28
PGR3
PGR7
PTAFR
PTGDR
PTGER1
PTGER2
PTGER3
PTGER4
PTGFR
PTGIR
PTHR1
RAI3
RDC1
RE2
RRH
SCTR
SMOH
SREB3
SSTR1
SSTR2
SSTR3
SSTR4
SSTR5
TACR1
TACR3
TBXA2R
TEM5
TM7SF1
TM7SF1L1
TM7SF1L2
TM7SF3
TPRA40
TRHR
TRHR2
TSHR
VIPR1
VIPR2
VLGR1

Exemplary diseases and disorders of the nervous system include abetalipoproteinemia, abnormal social behaviors, absence (petit mal) epilepsy, absence seizures, abulia, acalculia, acidophilic adenoma, acoustic neuroma, acquired aphasia, acquired aphasia with epilepsy (Landau-Kleffner syndrome) specific reading disorder, acquired epileptic aphasia, acromegalic neuropathy, acromegaly, action myoclonus-renal insufficiency syndrome, acute autonomic neuropathy, acute cerebellar ataxia in children, acute depression, acute disseminated encephalomyelitis, acute idiopathic sensory neuronopathy, acute intermittent porphyria, acute mania, acute mixed episode, acute pandysautonomia, acute polymorphic disorder with symptoms of schizophrenia, acute polymorphic psychotic disorder without symptoms of schizophrenia, acute purulent meningitis, addiction, Addison syndrome, adenovirus serotypes, adjustment disorders, adrenal hyperfunction, adrenal hypofunction, adrenoleuknock outdystrophy, adrenomyeloneuropathy, advanced sleep-phase syndrome, affective disorder syndromes, agenesis of the corpus callosum, agnosia, agoraphobia, agraphia, agyria, agyria-pachygyria, ahylognosia, Aicardi syndrome, AIDS, akathisia, akinesia, akinetic mutism, akinetopsia, alcohol abuse, alcohol dependence syndrome, alcohol neuropathy, alcohol related disorders, alcoholic amblyopia, alcoholic blacknock oututs, alcoholic cerebellar degeneration, alcoholic dementia, alcoholic hallucinosis, alcoholic-polyneuropathy, alcohol-induced anxiety disorders, alcohol-induced dementia, alcohol-induced mood disorders, alcohol-induced psychosis, alcoholism, Alexander's syndrome, alexia, alexia with agrphia, alexia without agraphia, alien hand syndrome, Alper's disease, altered sexuality syndromes, alternating hemiplagia, Alzheimer's disease, Alzheimer-like senile dementia, Alzheimer-like juvenile dementia, amenorrea, aminoacidurias, amnesia, amnesia for offences, amok-type reactions, amorphognosia, amphetamine addiction, amphetamine or amphetamine-like related disorders, amphetamine withdrawal, amyloid neuropathy, amyotrophic lateral sclerosis, anencephaly, aneurysms, angioblastic meningiomas, Angleman's syndrome, anhidrosis, anisocoria, anomia, anomic aphasia, anorexia nervosa, anosmia, anosognosia, anterior cingulate syndrome, anterograde amnesia, antibiotic-induced neuromuscular blockade, antisocial personality disorder, Anton's syndrome, anxiety and obsessive-compulsive disorder syndromes, anxiety disorders, apathy syndromes, aphasia, aphemia, aplasia, apnea, apraxia, arachnoid cyst, archicerebellar syndrome, Arnold-Chiari malformation, arousal disorders, arrhinencephaly, arsenic poisoning, arteriosclerotic Parkinsonism, arteriovenous aneurysm, arteriovenous malformations, aseptic meningeal reaction, Asperger's syndrome, astereognosis, asthenia, astrocytomas, asymbolia, asynergia, ataque de nervios, ataxia, ataxia telangiectasia, ataxic cerebral palsy, ataxic dysarthria, athetosis, atonia, atonic seizures, attention deficit disorder, attention-deficit and disruptive behavior disorders, attention-deficit hyperkinetic disorders, atypical Alzheimer's disease, atypical autism, autism, autism spectrum disorder, avoidant personality disorder, axial dementias, bacterial endocarditis, bacterial infections, Balint's syndrome, ballism, balo disease, basophilic adenoma, Bassen-Knock outrnzweig syndrome, Batten disease, battered woman syndrome, Behcet syndrome, Bell' palsy, benign essential tremor, benign focal epilepsies of childhood, benign intracranial hypertension, benxodiazepine dependence, bilateral cortical dysfunction, Binswanger's disease, bipolar disorder, bipolar type 1 disorder, bipolar type 2 disorder, blepharospasm, body dysmorphic disorder, Bogaert-Bertrand disease, Bogarad syndrome, borderline personality disorder, botulism, Bouffee Delirante-type reactions, brachial neuropathy, bradycardia, bradykinesia, brain abscess, brain edema, brain fag, brain stem glioma, brainstem encephalitis, brief psychotic disorder, broca's aphasia, brucellosis, bulimia, bulimia nervosa, butterfly glioma, cachexia, caffeine related disorders, california encephalitis, callosal agenesis, Canavan's syndrome, cancer pain, cannabis dependence, cannabis flashbacks, cannabis psychosis, cannabis related disorders, carcinoma-associated retinopathy, cardiac arrest, cavernous malformations, cellular (cytotoxic) edema, central facial paresis, central herniation syndrome, central neurogenic hyperventilation, central pontine myelinolysis, central post-stroke syndrome (thalamic pain syndrome), cerebellar hemorrhage, cerebellar tonsillar herniation syndrome, cerebral amyloid (congophilic) angiopathy, cerebral hemorrhage, cerebral malaria, cerebral palsy, cerebral subdural empyema, cerebrotendinous xanthomatosis, cerebrovascular disorders, cervical tumors, cestodes, Charcot-Carie-tooth disease, Chediak-Cigashi disease, Cheiro-oral syndrome, chiari malformation with hydrocephalus, childhood disintegrative disorder, childhood feeding problems, childhood sleep problems, cholesteatomas, chordomas, chorea, chorea gravidarum, choreoathetosis, chromophobe adenoma, chromosomal disorders, chronic biplar major depression, chronic bipolar disorder, chronic demyelinating polyneuritis, chronic depression, chronic fatigue syndrome, chronic gm2 gangliosidosis, chronic idiopathic sensory neuropathy, chronic inflammatory demyelinating polyneuropathy, chronic inflammatory demyelinating polyradiculoneuropathy, chronic pain, chronic paroxysmal hemicrania, chronic sclerosing panencephalitis, chronic traumatic encphalopathy, chronobiological disorders, circadian rhythm disorder, circadian rhythm disorders, Claude's syndrome, clonic seizures, cluster headache, cocaine addiction, cocaine withdrawal, cocaine-related disorders, Cockayne's syndrome, colloid cysts of the third ventricle, colorado tick fever, coma, communicating hydrocephalus, communication disorders, complex partial seizures, compression neuropathy, compulsive buying disorder, conceptual apraxia, conduct disorders, conduction aphasia, conduction apraxia, congenital analgesia, congenital cytomegalovirus disease, congenital hydrocephalus, congenital hypothyroidism, congenital muscular dystrophy, congenital myasthenia, congenital myotonic dystrophy, congenital rubella syndrome, congophilic angiopathy, constipation, coprophilia, cornedlia de lange syndrome, cortical dementias, cortical heteropias, corticobasal degeneration, corticobasal ganglionic degeneration, coxsackievirus, cranial meningoceles, craniopharyngioma, craniorachischisis, craniosynostosis, cranium bifidum, cretinism, Creutzfeldt-Jaknock outb disease, Cri-du-Chat syndrome, cruciate hemiplegia, cryptococcal granulomas, cryptococcosis, culturally related syndromes, culturally stereotyped reactions to extreme environmental conditions (arctic hysteria), Cushing syndrome, cyclothymia, cysticercosis, cytomegalovirus, Dandy-Walker malformation, deafness, defects in the metabolism of amino acids, dehydration, Dejerine-Roussy syndrome, Dejerine-Sottas disease, delayed and advanced sleep phase syndromes, delayed ejaculation, delayed puberty, delayed-sleep-phase syndrome, delerium due to alcohol, delerium due to intoxication, delerium due to withdrawal, delirium, dementia, and amnestic and other cognitive disorders, delusional disorder, delusional disorder: erotomania subtype, delusional disorder: grandiose subtype, delusional disorder: jealousy subtype, delusional misidentification syndromes, dementia due to HIV disease, dementia pugilistica, dementias, dementias associated with extrapyramidal syndrome, dentatorubral-pallidoluysian atrophy, dependent personality disorder, depersonalization disorder, depression, depressive personality disorder, dermoids, developmental speech and language disorder, devic syndrome, devivo disease, diabetes, diabetes insipidus, diabetic neuropathy, dialysis demential, dialysis dysequilibrium syndrome, diencephalic dementias, diencephalic dysfunction, diencephalic syndrome of infancy, diencephalic vascular dementia, diffuse sclerosis, digestive disorders, diphtheria, diplopia, disarthria, disassociation apraxia, disorders of carbohydrate metabolism, disorders of excessive somnolence, disorders of metal metabolism, disorders of purine metabolism, disorders of sexual arousal, disorders of sexual aversion, disorders of sexual desire, disorders of the sleep-wake schedule, dissociative disorders, dorsolateral tegmental pontine syndrome, Down syndrome, Down syndrome with dementia, drug dependance, drug overdose, drug-induced myasthenia, Duchenne muscular dystrophy, dwarfism, dysarthria, dysdiadochokinesia, dysembryoplastic neuroepithelial tumor, dysexecutive syndrome, dysgraphia, dyskinesia, dyskinetic cerebral palsy, dyslexia, dysmetria, dysomnia, dysosmia, dyspareunia, dysphagia, dysphasia, dysphonia, dysplasia, dyspnea, dysprosody, dyssomnia, dyssynergia, dysthesia, dysthymia, dystonia, dystrophinopathies, early adolescent gender identity disorder, early infantile epileptic encephalopthy (Ohtahara syndrome, early myoclonic epileptic encephalopathy, Eaton-Lambert syndrome, echinococcus (hydatid cysts), echolalia, echovirus, eclampsia, Edward's syndrome, elimination disorders, embolism intracerebral hemorrhage, Emery-Dreifuss muscular dystrophy, encephalitis lethargica, encephaloceles, encephalotrigeminal angiomatosis, enophthalmos, enterovirus, enuresis, eosinophilic meningitis, ependymoma, epidural spinal cord compression, epilepsy, episodic ataxia, epstein-barr, equine encephalomyelitis, erectile dysfunction, essential thrombocythemia, essential tremor, esthesioneuroblastoma, excessive daytime somnolence, excessive secretion of antidiuretic hormone, excessive sleepiness, exhibitionism, expressive language disorder, extramedullary tumors, extrasylvian aphasias, extratemporal neocortical epilepsy, fabry's disease, facioscapulohumeral muscular dystrophy, factitious disorder, factitious disorders, false memories, familial dysautonomia, familial periodic paralysis, familial spastic paraparesis, familial spastic paraplegias, fear disorders, feeding and eating disorders of infancy or early childhood, female sexual arousal disorder, fetal alcohol syndrome, fetishism, flaccid dysarthria, floppy infant syndrome, focal inflammatory demyelinating lesions with mass effect, focal neonatal hypotonia, folie a deux, foramen magnum tumors, Foville's syndrome, fragile-x syndrome, Freidrich's ataxia, Frolich syndrome, frontal alexia, frontal convexity syndrome, frontotemporal dementia, frontotemporal dementias, frotteurism, fungal infection, galactocerebroside lipidosis, galactorrhea, ganglioneuroma, Gaucher disease, gaze palsy, gender identity disorder, generalized anxiety disorder, genital shrinking syndrome (Knock outro, Suo-Yang), germ cell tumors, Gerstmann's syndrome, Gerstmann-Straussler syndrome, Gerstmann-Straussler-Schenker disease, Gertmann's syndrome, gestational substance abuse syndromes, giant axonal neuropathy, gigantism, Gilles de la Tourette syndrome, glioblastoma multiforme, gliomas, gliomatosis cerebri, global aphasia, glossopharyngeal neuralgia, glycogen storage diseases, gm1-gangliosidosis, gm2-gangliosidoses, granular cell tumor, granulocytic brain edema, granulonias, granulomatous angiitis of the brain, Grave's disease, growild typeh hormone deficit, growild typeh-hormone secreting adenomas, guam-Parkinson complex dementia, Guillain-Barre syndrome, Hallervorden-Spatz disease, hallucinogen persisting perception disorder, hallucinogen related disorders, hartnup disease, headache, helminthic infections (trichinellosis), hemangioblastomas, hemangiopericytomas, hemiachromatopsia, hemianesthesia, hemianopsia, hemiballism, hemiballismus, hemihypacusis, hemihypesthesia, hemiparesis, hemispatial neglect, hemophilus influenza meningitis, hemorrhagic cerebrovascular disease, hepatic coma, hepatic encephalopathy, hepatolenticular degeneration (Wilson disease), hereditary amyloid neuropathy, hereditary ataxias, hereditary cerebellar ataxia, hereditary neuropathies, hereditary nonprogressive chorea, hereditary predisposition to pressure palsies, hereditary sensory autonomic neuropathy, hereditary sensory neuropathy, hereditary spastic paraplegia, hereditary tyrosinemia, hermichorea, hermifacial spasm, herniation syndromes, herpes encephalitis, herpes infections, herpes zoster, herpres simplex, heterotopia, hexacarbon neuropathy, histrionic personality disorder, HIV, Holmes-Adie syndrome, homonymous quadrantaposia, Homer's syndrome, human β-mannosidosis, Hunter's syndrome, Huntington's chorea, Huntington's disease, Hurler's syndrome, Hwa-Byung, hydraencephaly, hydrocephalus, hyper thyroidism, hyperacusis, hyperalgesia, hyperammonemia, hypereosinophilic syndrome, hyperglycemia, hyperkalemic periodic paralysis, hyperkinesia, hyperkinesis, hyperkinetic dysarthria, hyperosmia, hyperosmolar hyperglygemic nonketonic diabetic coma, hyperparathyroidism, hyperphagia, hyperpituitarism, hyperprolactinemia, hypersexuality, hypersomnia, hypersomnia secondary to drug intake, hypersomnia-sleep-apnea syndrome, hypersomnolence, hypertension, hypertensive encephalopathy, hyperthermia, hyperthyroidism (Graves disease), hypertonia, hypnagogic (predormital) hallucinations, hypnogenic paroxysmal dystonia, hypoadrenalism, hypoalgesia, hypochondriasis, hypoglycemia, hypoinsulinism, hypokalemic periodic paralysis, hypokinesia, hypokinetic dysarthria, hypomania, hypoparathyroidism, hypophagia, hypopituitarism, hypoplasia, hyposmia, hyposthenuria, hypotension, hypothermia, hypothyroid neuropathy, hypothyroidism, hypotonia, Hyrler syndrome, hysteria, ideational apraxia, ideomotor apraxia, idiopathic hypersomnia, idiopathic intracranial hypertension, idiopathic orthostatic hypotension, immune mediated neuropathies, impersistence, impotence, impulse control disorders, impulse dyscontrol and aggression syndromes, impulse-control disorders, incontinence, incontinentia pigmenti, infantile encephalopathy with cherry-red spots, infantile neuraxonal dystrophy, infantile spasms, infantilism, infarction, infertility, influenza, inhalant related disorders, insomnias, insufficient sleep syndrome, intention tremor, intermittent explosive disorder, internuclear ophthalmoplegia, interstitial (hydrocephalic) edema, intoxication, intracranial epidural abscess, intracranial hemorrhage, intracranial hypotension, intracranial tumors, intracranial venous-sinus thrombosis, intradural hematoma, intramedullary tumors, intravascular lymphoma, ischemia, ischemic brain edema, ischemic cerebrovascular disease, ischemic neuropathies, isolated inflammatory demyelinating CNS syndromes, Jackson-Collet syndrome, Jaknock outb-Creutzfeld disease, Japanese encephalitis, jet lag syndrome, Joseph disease, Joubert's syndrome, juvenile neuroaxonal dystrophy, Kayak-Svimmel, Kearns-Sayre syndrome, kinky hair disease (Menkes syndrome), Kleine-Levin syndrome, kleptomania, Klinefelter's syndrome, Kluver-Bucy syndrome, Knock outerber-Salus-Elschnig syndrome, Knock outrsaknock outff's syndrome, krabbe disease, krabbe leuknock outdystrophy, Kugelberg-Welander syndrome, kuru, Lafora's disease, language deficits, language related disorders, latah-type reactions, lateral mass herniation syndrome, lateropulsation, lathyrism, Laurence-Moon Biedl syndrome, Laurence-Moon syndrome, lead poisoning, learning disorders, leber hereditary optic atrophy, left ear extinction, legionella pneumophilia infection, Leigh's disease, Lennoc-Gastaut syndrome, Lennox-Gastaut's syndrome, leprosy, leptospirosis, Lesch-Nyhan syndrome, leukemia, leuknock outdystrophies, Levy-Roussy syndrome, lewy body dementia, lewy body disease, limb girdle muscular dystrophies, limbic encephalitis, limbic encephalopathy, lissencephaly, localized hypertrophic neuropathy, locked-in syndrome, logoclonia, low pressure headache, Lowe syndrome, lumbar tumors, lupus anticoagulants, lyme disease, lyme neuropathy, lymphocytic choriomeningitis, lymphomas, lysosomal and other storage diseases, macroglobinemia, major depression with melancholia, major depression with psychotic features, major depression without melancholia, major depressive (unipolar) disorder, male orgasmic disorder, malformations of septum pellucidum, malignant peripheral nerve sheath tumors, malingers, mania, mania with psychotic features, mania without psychotic features, maple syrup urine disease, Marchiafava-Bignami syndrome, Marcus Gunn syndrome, Marie-Foix syndrome, Marinesco-Sjogren syndrome, Maroteaux-Lamy syndrome, masochism, masturbatory pain, measles, medial frontal syndrome, medial medullary syndrome, medial tegmental syndrome, medication-induced movement disorders, medullary dysfunction, medulloblastomas, medulloepithelioma, megalencephaly, melanocytic neoplasms, memory disorders, memory disturbances, meniere syndrome, meningeal carcinomatosis, meningeal sarcoma, meningial gliomatosis, meningiomas, meningism, meningitis, meningococcal meningitis, mental neuropathy (the numb chin syndrome), mental retardation, mercury poisoning, metabolic neuropathies, metachromatic leuknock outdystrophy, metastatic neuropathy, metastatic tumors, metazoal infections, microcephaly, microencephaly, micropolygyria, midbrain dysfunction, midline syndrome, migraine, mild depression, Millard-Gubler syndrome, Miller-Dieker syndrome, minimal brain dysfunction syndrome, miosis, mitochondrial encephalopathy with lactic acidosis and stroke (melas), mixed disorders of scholastic skills, mixed dysarthrias, mixed transcortical aphasia, Mobius syndrome, Mollaret meningitis, monoclonal gammopathy, mononeuritis nultiplex, monosymptomatic hypochondriacal psychosis, mood disorders, Moritz Benedikt syndrome, Morquio syndrome, Morton's neuroma, motor neuron disease, motor neurone disease with dementia, motor neuropathy with multifocal conduction block, motor skills disorder, mucolipidoses, mucopolysaccharide disorders, mucopolysaccharidoses, multifocal eosinophilic granuloma, multiple endocrine adenomatosis, multiple myeloma, multiple sclerosis, multiple system atrophy, multiple systems atrophy, multisystemic degeneration with dementia, mumps, Munchausen syndrome, Munchausen syndrome by proxy, muscular hypertonia, mutism, myasthenia gravis, mycoplasma pneumoniae infection, myoclonic seizures, myoclonic-astatic epilepsy (doose syndrome), myoclonus, myotonia congenita, myotonic dystrophy, myotonic muscular dystrophy, nacolepsy, narcissistic personality disorder, narcolepsy, narcolepsy-cataplexy syndrome, necrophilia, nectrotizing encephalomyelopathy, Nelson's syndrome, neocerebellar syndrome, neonatal myasthenia, neonatal seizures, nervios, nerves, neurasthenia, neuroacanthocytosis, neuroaxonal dystrophy, neurocutaneous disorders, neurofibroma, neurofibromatosis neurogenic orthostatic hypotension, neuroleptic malignant syndrome, neurologic complications of renal transplantation, neuromyelitis optica, neuromyotonia (Isaacs syndrome), neuronal ceroid lipofuscinoses, neuro-ophthalamic disorders, neuropathic pain, neuropathies associated with infections, neuropathy associated with cryoglobulins, neuropathy associated with hepatic diseases, neuropathy induced by cold, neuropathy produced by chemicals, neuropathy produced by metals, neurosyphilis, new variant Creutzfeldt-Jaknock outb disease, nicotine dependence, nicotine related disorders, nicotine withdrawal niemann-pick disease, nocturnal dissociative disorders, nocturnal enuresis, nocturnal myoclonus, nocturnal sleep-related eating disorders, noecerebellar syndrome, non-alzherimer frontal-lobe degeneration, nonamyloid polyneuropathies associated with plasma cell dyscrasia, non-lethal suicial behavior, nonlocalizing aphasic syndromes, normal pressure hydrocephalus, Nothnagel's syndrome, nystagmus, obesity, obsessive-compulsive (anankastic) personality disorder, obsessive-compulsive disorder, obstetric factitious disorder, obstructive hyrocephalus, obstructive sleep apnea, obstructive sleep apnoea syndrome, obstructive sleep hypopnoea syndrome, occipital dementia, occlusive cerebrovascular disease, oculocerebrorenal syndrome of lowe, oculomotor nerve palsy, oculopharyngeal muscular dystrophy, oligodendrogliomas, olivopontocerebellar atrophy, ondine's curse, one and a half syndrome, onychophagia, opiate dependance, opiate overdose, opiate withdrawal, opioid related disorders, oppositional defiant disorder, opsoclonus, orbitofrontal syndrome, orgasmic anhedonia, orgasmic disorders, osteosclerotic myeloma, other disorders of infancy, childhood, or adolescence, other medication-induced movement disorders, pachygyria, paedophilia, pain, pain syndromes, painful legs-moving toes syndrome, paleocerebellar syndrome, palilalia, panhypopituitarism, panic disorder, panic disorders, papillomas of the choroid plexus, paraganglioma, paragonimiasis, paralysis, paralysis agitans (shaking palsy), paramyotonia congenita, paraneoplastic cerebellar degeneration, paraneoplastic cerebellar syndrome, paraneoplastic neuropathy, paraneoplastic syndromes, paranoia, paranoid personality disorder, paranoid psychosis, paraphasia, paraphilias, paraphrenia, parasitic infections, parasomnia, parasomnia overlab disorder, parenchymatous cerebellar degeneration, paresis, paresthesia, parinaud's syndrome, Parkinson's disease, Parkinson-dementia complex of guam, Parkinsonism, Parkinsonism-plus syndromes, Parkinson's disease, paroxysmal ataxia, paroxysmal dyskinesia, partial (focal) seizures, partialism, passive-aggressive (negativistic) personality disorder, Patau's syndrome, pathological gambling, peduncular hallucinosis, Pelizaeus-Merzbacher disease, perineurioma, peripheral neuropathy, perisylvian syndromes, periventricular leuknock outmalacia, periventricular white matter disorder, periventricular-intraventricular hemorrhage, pernicious anemia, peroneal muscular atrophy, peroxisomal diseases, perseveration, persistence of cavum septi pellucidi, persistent vegetative state, personality disorders, pervasive developmental disorders, phencyclidine (or phencyclidine-like) related disorders, phencyclidine delirium, phencyclidine psychosis, phencyclidine-induced psychotic disorder, phenylketonuria, phobic anxiety disorder, phonic tics, photorecepto degeneration, pibloktoq, Pick's disease, pineal cell tumors, pineoblastoma, pineocytoma, pituitary adenoma, pituitary apoplexy, pituitary carcinoma, pituitary dwarfism, placebo effect, Plummer's disease, pneumococcal meningitis, poikilolthermia, polio, polycythemia vera, polydipsia, polyglucosan storage diseases, polymicrogyria, polymyositis, polyneuropathy with dietary deficiency states, polysubstance related disorder, polyuria, pontine dysfunction, pontosubicular neuronal necrosis, porencephaly, porphyric neuropathy, portal-systemic encephalopathy, postcoital headaches, postconcussion syndrome, postencephalic Parkinson syndrome, posthemorrhagic hydrocephalus, postinflammatory hydrocephalus, postpartum depression, postpartum psychoses, postpolio syndrome, postpsychotic depression, post-stroke hypersomnia, post-traumatic amnesia, post-traumatic epilepsy, post-traumatic hypersomnia, post-traumatic movement disorders, post-traumatic stress disorder, post-traumatic syndromes, Prader-Willi syndrome, precocious puberty, prefrontal dorsolateral syndrome, prefrontal lobe syndrome, premenstrual stress disorder, premenstrual syndrome, primary amebic meningoencephalitis, primary CNS lymphoma, primary idiopathic thrombosis, primary lateral sclerosis, primitive neuroectodermal tumors, prion disease, problems related to abuse or neglect, progressive bulbar palsy, progressive frontal lobe dementias, progressive multifocal lueknock outencephalopathy, progressive muscular atrophy, progressive muscular dystrophies, progressive myoclonic epilepsies, progressive myoclonus epilepsies, progressive non-fluent aphasia, progressive partial epilepsies, progressive rubella encephalitis, progressive sclerosing poliodystrophy (Alpers disease), progressive subcortical gliosis, progressive supranuclear palsy, progressive supranuclear paralysis, progressive external ophthalmoplegia, prolactinemia, prolactin-sectreting adenomas, prosopagnosia, protozoan infection, pseudobulbar palsy, pseudocyesis, pseudodementia, psychic blindness, psychogenic excoriation, psychogenic fugue, psychogenic pain syndromes, psychological mutism, psychosis after brain injury, psychotic syndromes, ptosis, public masturbation, puerperal panic, pulmonary edema, pure word deafness, pyromania, quadrantanopsia, rabies, radiation neuropathy, Ramsay Hunt syndrome, rape traume syndrome, rapid cycling disorder, rapid ejaculation, Raymond-Cestan-Chenais syndrome, receptive language disorder, recovered memories, recurrent bipolar episodes, recurrent brief dpression, recurrent hypersomnia, recurrent major depression, refsum disease, reiterative speech disturbances, relational problems, rem sleep behavior disorder, rem sleep behavioral disorder, repetitive self-mutilation, repressed memories, respiratory dysrhythmia, restless legs syndrome, Rett's syndrome, Reye syndrome, rhythmic movement disorders, rocky mountain spotted fever, rostral basal pontine syndrome, rubella, Rubinstein-Taybi syndrome, sadistic personality disorder, salla disease, Sandhoff disease, Sanfilippo syndrome, sarcoid neuropathy, sarcoidosis, scapuloperoneal syndromes, schistosomiasis (bilharziasis), schizencephaly, schizoaffective disorder, schizoid personality disorder, schizophrenia, schizophrenia and other psychotic disorders, schizophrenia-like psychosis, schizophreniform disorder, schizotypal personality disorder, school-refusal anxiety disorder, schwannoma, scrub typhus, seasonal depression, secondary spinal muscular atrophy, secondary thrombosis, sedative hypnotic or anxiolytic-related disorders, seizure disorders, selective mutism, self-defeating (masochistic) personality disorder, semen-loss syndrome (shen-k'uei, dhat, jiryan, sukra prameha), senile chorea, senile dementia, sensory perineuritis, separation anxiety disorder, septal syndrome, septo-optic dysplasia, severe hypoxia, severe myoclonic epilepsy, sexual and gender identity disorders, sexual disorders, sexual dysfunctions, sexual pain disorders, sexual sadism, Shapiro syndrome, shift work sleep disorder, Shy-Drager syndrome, sialidosis, sialidosis type 1, sibling rivalry disorder, sickle cell anemia, Simmonds disease, simple partial seizures, simultanagnosia, sleep disorders, sleep paralysis, sleep terrors, sleep-related enuresis, sleep-related gastroesophageal reflux syndrome, sleep-related headaches, sleep-wake disorders, sleepwalking, Smith-Magenis syndrome, social anxiety disorder, social phobia, social relationship syndromes, somatoform disorders, somnambulism, Sotos syndrome, spasmodic dysphonia, spasmodic torticollis (wry neck), spastic cerebral palsy, spastic dysarthria, specific developmental disorder of motor function, specific developmental disorders of scholastic skills, specific developmental expressive language disorder, specific developmental receptive language disorder, specific disorders of arithmetical skills, specific phobia, specific speech articulation disorder, specific spelling disorder, speech impairment, spina bifida, spinal epidural abcess, spinal muscular atrophies, spinocerebellar ataxias, spirochete infections, spongiform encephalopathies, spongy degeneration of the nervous system, St. Louis encephalitis, stammer, staphylococcal meningitis, startle syndromes, status marmoratus, steele-richardson-olszewski syndrome, stereotypic movement disorder, stereotypies, stiff-man syndrome, stiff-person syndrome, stimulant psychosis, Strachan syndrome (nutritional neuropathy), streptococcal meningitis, striatonigral degeneration, stroke, strongyloidiasis, sturge-weber disease (Krabbe-Weber-Dimitri disease), stutter, subacute combined degeneration of the spinal cord, subacute motor neuronopathy, subacute necrotic myelopathy, subacute sclerosing panencephalitis, subacute sensory neuronopathy, subarachniod hemorrhage, subcortical aphasia, subfalcine herniation syndrome, substance abuse, substance related disorders, sudanophilic leuknock outdystrophis, sudden infant death syndrome, suicide, sulfatide lipidosis, susto, espanto, meido, sydenham chorea, symetric neuropathy associated with carcinoma, sympathotonic orthostatic hypotension, syncope, syndromes related to a cultural emphasis on learnt dissociation, syndromes related to a cultural emphasis on presenting a physical apprearance pleasing to others (taijin-kyofu reactions), syndromes related to acculturative stress, syringobulbia, syringomyelia, systemic lupus erythematosus, tachycardia, tachypnea, Tangier disease, tardive dyskinesia, Tay-sachs disease, telangiectasia, telencephalic leuknock outencephalopathy, telephone scatologia, temporal lobe epilepsy, temporoparietal dementia, tension-type headache, teratomas, tetanus, tetany, thalamic syndrome, thallium poisoning, thoracic tumors, thrombotic thrombocytopenic purpura, thyroid disorders, tic disorders, tick paralysis, tick-borne encephalitis, tinnitus, tomaculous neuropathy, tonic seizures, tonic-clonic seizures, torticollis, Tourette syndrome, toxic neuropathies, toxoplasmosis, transcortical motor aphasia, transcortical sensory aphasia, transient epileptic amnesia, transient global amnesia, transitional sclerosis, transvestic fetishism, traumatic brain injury, traumatic neuroma, traumiatic mutism, tremors, trichinosis, trichotillomania, trigeminal neuralgia, trochlear nerve palsy, tropical ataxic neuropathy, tropical spastic paraparesis, trypanosomiasis, tuberculomas, tuberculous meningitis, tuberous sclerosis, tumors, Turner's syndrome, typhus fever, ulegyria, uncinate fits, Unverricht-Lundborg's disease, upper airway resistance syndrome, upward transtentorial herniation syndrome uremic encephalopathy, uremic neuropathy, urophilia, vaccinia, varicella-zoster, vascular dementia, vascular malformations, vasculitic neuropathies, vasogenic edema, velocardiofacial syndrome, venous malformations, ventilatory arrest, vertigo, vincristine toxicity, viral infections, visuospatial impairment, Vogt-Knock outyanagi-Harada syndrome, Von Hippel-Lindau disease, Von Racklinghousen disease, voyeurism, Waldenstrom's macroglobulinemia, Walker-Warburg syndrome, Wallenburg's syndrome, Walleyed syndrome, Weber's syndrome, Wenicke's encephalopathy, Werdnig-Hoffmann disease, Wernicke's encephalopathy, Wernicke-Knock outrsaknock outff syndrome, Wernicke's aphasia, West's syndrome, whipple disease, Williams syndrome, Wilson disease, windigo, witiknock out, witigo, withdrawal with grand mal seizures, withdrawal with perceptual disturbances, withdrawal without complications, Wolman disease, xeroderma pigmentosum, xyy syndrome, Zellweger syndrome.

Behavioral Disorders

In humans, as in other animals, behaviors related to survival, avoidance of injury, maintenance of bodily function, and reproduction are in large part instinctive. These behaviors are caused by powerful drives, such as hunger, thirst, sleep, and sexual desire. Emotions, such as fear or joy, are also closely linked with the parts of our lives governed by instincts.

As behaviors begin to involve higher mental functions, they include a broader mixture of features related to both "nature" and "nurture." The impact of learning, experience, and environment then becomes layered upon such instinctive behaviors as curiosity, attention and pleasure.

The intensity of a particular drive or emotion is highly variable from one person to another. There is also variation in the extent to which different individuals experience particular drives and emotions. For instance, one person may experience hunger more frequently than another, or feel more anxious or stressed.

There also are differences in how one responds to drives and emotions. For example, anxiety in a stressful circumstance might motivate a person to gain control of the matter, while in another, the same feelings might cause a behavior directed at avoiding the situation altogether.

Basic drives and emotions are components of everyday life, and are important to one's physical and psychological well-being. Abnormalities in any of them may profoundly affect an individual's ability to think, feel and act. Behavioral problems are also very common. More individuals are afflicted every year by these conditions than by cancer and heart diseases combined.

Eating Disorders

Nearly one-quarter of the U.S. Population (60 million people) is now classified as obese. Despite the fact that Americans spend about $40 billion per year on weight-loss treatments, only a small percentage of people can lose weight and keep it off. Since obesity is a direct contributor to cardiovascular disease and diabetes, there is need to address the extreme forms of these behaviors as life-threatening conditions.

Eating disorders such as anorexia nervosa and bulimia nervosa affect over a million Americans. These disorders are characterized by a constant preoccupation with food and a fear of fatness. Current treatments for anorexia nervosa include hospitalization, high caloric diet, and psychological counseling. In the case of bulimia nervosa, psychiatric treatment and antidepressant medications are being prescribed. The success rate in both cases is low.

Sleep Disorders

The most common sleeping problems are insomnia and narcolepsy. Insomnia is the continued inability to fall asleep or stay asleep. Almost everyone occasionally suffers from short-term insomnia. However, for people who suffer chronically from the insomnia, the disease can severely disrupt their ability to function. Narcolepsy, on the other hand, is the sudden, irresistible daytime episodes of sleepiness. People with narcolepsy have frequent "sleep attacks" at various times of the day, even if they have had a normal amount of night-time sleep.

The main anti-insomniac drugs in use today are benzodiazepine products (sleeping pills). Benzodiazepines, although somewhat effective for short-term insomnia, are not indicated for mild or severe insomnia, as they have several side effects and can cause physical dependence. For narcolepsy, there is presently no cure. Stimulants, like amphetamines, can help reduce the symptoms, but do not alleviate them entirely.

Sexual Disorders

Tens of millions of men have some form of erectile dysfunction (impotence)—mild, moderate, severe, acute, or chronic. An even larger number of women are estimated to suffer from sexual arousal (inability to attain or maintain sexual excitement) and orgasmic (lack of orgasm during sex) disorders. Several million American men and women have symptoms of compulsive sexual disorder (sex addiction).

Sexual disorders can be caused by either physical or psychological factors. There are effective medicines today (such as VIAGRA™) to treat certain disorders associated with physical factors. This is not the case, however, for individuals suffering from sexual disorders involving libido. There are no drugs available to help another 5-6 million men with impotency, who do not benefit from VIAGRA™, or millions of other with sexual arousal, orgasmic, or compulsive sexual disorders.

Anxiety Disorders

Personal anxieties and fears are part of everyday life. For millions of individuals, however, anxieties and fears are overwhelming and persistent, often drastically interfering with daily life. These people suffer from anxiety disorders, a widespread group of illnesses that can be terrifying and crippling. These conditions include panic disorder, phobias, obsessive-compulsive disorder, post-traumatic stress disorder, and generalized anxiety disorder.

Current pharmacologic treatments for anxiety include tranquilizers or anxiolytic drug (e.g., valium, and tranxene) and antidepressants. While these medications can be effective at relieving anxiety symptoms, they also carry undesirable side effects such as sedation, fatigue, weight gain, sexual difficulties, and withdrawal reactions.

Mood Disorders

Depression is the most commonly diagnosed emotional problem. Each year, millions of people will suffer from a depressive illness, such as major depression, or bipolar disorder. As many as one in five Americans will have at least one episode of depression during their lifetime. Many of them will be incapacitated for weeks or months.

The treatment of depression today is not much different than it was many years ago. The current antidepressants are no more efficacious than the older ones. They are improved in terms of certain side effects, but they still cause sexual dysfunction, require an extended period to become effective, and cannot be mixed with several other commonly used medications.

Memory Impairments

Over a million Americans suffer from memory deficits beyond that expected for their age. These people are suffering from mild cognitive impairment or from dementia.

Memory loss, particularly of recent events, is the prevailing symptom of mild cognitive impairment. Dementia is a more severe condition. People with dementia suffer from short-term memory loss, inability to think through or complete complex tasks without step-by-step instructions, confusion, difficulty concentrating, and paranoid, inappropriate, or bizarre behavior. Currently, there are no medications available to treat or prevent memory impairments.

Attention Disorders

As many as a million school-age children in the U.S. are claimed to suffer from attention-deficit hyperactivity disorder (ADHD). The disease has its onset in childhood and is characterized by lack of attention, impulsiveness, and hyperactivity. ADHD often continues into adolescence and adulthood. The disease has long-term adverse affects on success at school, work, and in social relationships. Stimulants are used to treat the symptoms of ADHD. Children with the disorder seldom outgrow it, and long-term therapy is not advised.

Pain

Pain arises in response to a noxious stimulus or tissue injury. In some instances, pain may continue after the tissue damage has healed or in the absence of evident tissue damage. This is chronic pain. Millions of Americans have some form of persisting or recurring pain. They usually suffer from tension or migraine headaches, low back pain, or arthritis. Chronic pain is also a byproduct of heart diseases and cancer. Chronic pain is often unresponsive to conventional therapies. People with chronic pain are treated with a wide variety of medications, usually with limited success.

Substance Abuse/Addiction

Substance abuse and addiction are considered to be one of the serious social issues in modern times. Despite growing efforts to address them, there are no effective medications available to treat most people with substance abuse and addiction problems. People who abuse substances, but are not yet addicted to them, are usually treated with behavioral therapies. Treatment of addicted people often involves a combination of behavior therapy and medication. In either case, the results are poor. Only a minority is helped by these treatments.

GPCR Expression in Non-Neural Tissues

Adrenal gland. GPCRs expressed in the adrenal gland are listed in Table 15. These receptors are thus potential targets for therapeutic compounds that may modulate the activity, expression, or stability of a GPCR in the adrenal gland. These polypeptides, or polymorphs of these polypeptides, may form the basis of a therapeutic regimen, or a diagnostic test to determine, e.g., the presence of a disease or disorder of the adrenal gland, the risk of developing a particular disease or disorder, or an appropriate therapeutic course.

TABLE 15

| GPCRs Expressed in the Adrenal Gland |
| --- |
| ADCYAP1R1 |
| ADMR |
| ADORA1 |
| ADORA2A |
| ADORA2B |
| ADORA3 |
| ADRA1A |
| ADRA1D |
| ADRA2B |
| ADRB1 |
| ADRB2 |
| ADRB3 |
| AGR9 |
| AGTR1 |
| AGTR2 |
| AGTRL1 |
| AVPR1A |
| AVPR2 |
| BAI2 |
| BDKRB1 |
| BDKRB2 |
| C3AR1 |
| C5R1 |
| CALCRL |
| CASR |
| CCBP2 |
| CCKAR |
| CCR1 |
| CCR2 |
| CCR4 |
| CCR5 |
| CCR6 |
| CCR7 |
| CCR8 |
| CCR9 |
| CGRL1 |
| CCXCR1 |
| CD97 |
| CELSR1 |
| CELSR2 |
| CHRM1 |
| CHRM3 |
| CHRM4 |
| CMKBR1L2 |
| CMKLR1 |

TABLE 15-continued

GPCRs Expressed in the Adrenal Gland

| |
|---|
| CNR1 |
| CNR2 |
| CX3CR1 |
| CXCR4 |
| CXCR6 |
| CYSLT1 |
| CYSLT2 |
| DJ287G14 |
| DRD2 |
| DRD4 |
| EBI2 |
| EDG1 |
| EDG2 |
| EDG3 |
| EDG4 |
| EDG5 |
| EDG6 |
| EDG7 |
| EDNRA |
| EDNRB |
| EMR1 |
| ETL |
| F2R |
| F2RL2 |
| F2RL3 |
| FKSG79 |
| FY |
| FZD1 |
| FZD10 |
| FZD2 |
| FZD3 |
| FZD4 |
| FZD5 |
| FZD6 |
| FZD8 |
| FZD9 |
| G2A |
| GABBR1 |
| GCGR |
| GIPR |
| GPCR150 |
| GPR1 |
| GPR10 |
| GPR105 |
| GPR17 |
| GPR18 |
| GPR19 |
| GPR21 |
| GPR22 |
| GPR23 |
| GPR24 |
| GPR27 |
| GPR30 |
| GPR31 |
| GPR34 |
| GPR35 |
| GPR37 |
| GPR37L1 |
| GPR39 |
| GPR4 |
| GPR43 |
| GPR44 |
| GPR48 |
| GPR49 |
| GPR54 |
| GPR55 |
| GPR63 |
| GPR64 |
| GPR65 |
| GPR75 |
| GPR77 |
| GPR80 |
| GPR81 |
| GPR82 |
| GPR83 |
| GPR84 |
| GPR85 |
| GPR86 |
| GPR9 |
| GPR91 |
| GPR92 |
| GPRC5B |
| GPRC5C |
| GPRC5D |
| GRM4 |
| GRM5 |
| GRPR |
| H963 |
| HCRTR1 |
| HCRTR2 |
| HGPCR11 |
| HM74 |
| HRH1 |
| HRH2 |
| HRH3 |
| HTR1B |
| HTR1D |
| HTR2A |
| HTR2B |
| HUMNPIIY20 |
| IL8RA |
| KIAA0758 |
| KIAA1828 |
| LEC1 |
| LEC2 |
| LEC3 |
| MC2R |
| MC5R |
| MRG |
| MRGE |
| MRGF |
| MrgG |
| NPY2R |
| NTSR2 |
| OA1 |
| OPN1MW |
| OPN3 |
| OXTR |
| P2RY1 |
| P2RY12 |
| P2RY4 |
| P2RY6 |
| P2Y10 |
| P2Y5 |
| PGR13 |
| PGR15 |
| PGR16 |
| PGR17 |
| PGR20 |
| PGR21 |
| PGR22 |
| PGR25 |
| PGR26 |
| PGR27 |
| PGR28 |
| PGR4 |
| PGR7 |
| PGR8 |
| PTAFR |
| PTGER1 |
| PTGER2 |
| PTGER3 |
| PTGER4 |
| PTGFR |
| PTGIR |
| PTHR1 |
| PTHR2 |
| RAI3 |
| RDC1 |
| RE2 |
| SCTR |
| SMOH |
| SSTR2 |
| SSTR4 |
| SSTR5 |
| TACR2 |

TABLE 15-continued

GPCRs Expressed in the Adrenal Gland

TBXA2R
TEM5
TM7SF1
TM7SF1L1
TM7SF1L2
TM7SF3
TPRA40
TRHR2
TSHR
VLGR1

Exemplary diseases and disorders of the adrenal gland include 11-hydroxylase deficiency, 17-hydroxylase deficiency, 3β-dehydrogenase deficiency, acquired immune deficiency syndrome, ACTH-dependent adrenal hyperfunction (Cushing disease), ACTH-independent adrenal hyperfunction, acute adrenal insufficiency, adrenal abscess, adrenal adenoma, adrenal calcification, adrenal cysts, adrenal cytomegaly, adrenal dysfunction in glycerol kinase deficiency, adrenal hematoma, adrenal hemorrhage, adrenal histoplasmosis, adrenal hyperfunction, adrenal hyperplasia, adrenal medullary hyperplasia, adrenal myelolipoma, adrenal tuberculosis, adrenocortical adenoma, adrenocortical adenoma with primary hyperaldosteronism (Conn's syndrome), adrenocortical carcinoma, adrenocortical carcinoma with Cushing's syndrome, adrenocortical hyperfunction, adrenocortical insufficiency, adrenocortical neoplasms, adrenoleuknock outdystrophy, amyloidosis, anencephaly, autoimmune Addison's disease, Beckwith-Wiedemann syndrome, bilateral adrenal hyperplasia, chronic insufficiency of adrenocortical hormone synthesis, complete 21-hydroxylase deficiency, congenital adrenal hyperplasia, congenital adrenal hypoplasia, cortical hyperplasia, desmolase deficiency, ectopic ACTH syndrome, excess aldosterone secretion, excess cortisol secretion (Cushing's syndrome), excess secretion of adrenocortical hormones, excess sex hormone secretion, familial glucocorticoid deficiency, functional "black" adenomas, ganglioneuroblastoma, ganglioneuroma, glucocorticoid remediable hyperaldosteronism, herpetic adrenalitis, hyperaldosteronism, idiopathic Addison's disease, idiopathic hyperaldosteronism with bilateral hyperplasia of zona glomerulosa, Iatrogenic hypercortisolism, lysosomal storage diseases, macronodular hyperplasia, macronodular hyperplasia with marked adrenal enlargement, malignant lymphoma, malignant melanoma, metastatic carcinoma, metastatic tumors, micronocular hyperplasia, multiple endocrine neoplasia syndromes, multiple endocrine neoplasia type 1 (Wermer syndrome), multiple endocrine neoplasia type 2a (Sipple syndrome), multiple endocrine neoplasia type 2b, neuroblastoma, Niemann-Pick disease, ovarian thecal metaplasia, paraganglioma, partial 21-hydroxylase deficiency, pheochromocytoma, primary aldosteronism (Conn's syndrome), primary chronic adrenal insufficiency (Addison's disease), primary hyperaldosteronism, primary mesenchymal tumors, primary pigmented nodular adrenocortical disease, salt-wasting congenital adrenal hyperplasia, secondary Addison's disease, secondary hyperaldosteronsim, selective hypoaldosteronism, simple virilizing congenital adrenal hyperplasia, Waterhouse-Friderichsen syndrome, and Wolman's disease.

Colon. GPCRs expressed in the colon are listed in Table 16. These receptors are thus potential targets for therapeutic compounds that may modulate the activity, expression, or stability of these GPCRs in the colon. These polypeptides, or polymorphs of these polypeptides, may form the basis of therapeutic regimen or a diagnostic test to determine, e.g., the presence of disease or disorder involving the colon, the risk of developing a particular disease or disorder, or an appropriate therapeutic course.

TABLE 16

GPCRs Expressed in the Colon

ADORA2A
ADORA2B
ADORA3
ADRA2A
ADRA2B
AGR9
AGTRL1
BDKRB2
BLR1
C5R1
CALCRL
CCBP2
CCKAR
CCR1
CCR2
CCR3
CCR5
CCR6
CCR7
CCR9
CCRL1
CD97
CELSR1
CHRM1
CHRM2
CHRM3
CHRM4
CMKBR1L2
CMKLR1
CNR2
CX3CR1
CXCR4
CXCR6
CYSLT1
CYSLT2
DJ287G14
EBI2
EDG1
EDG2
EDG3
EDG4
EDG5
EDG7
EDNRA
EDNRB
EMR1
ETL
F2R
F2RL1
F2RL2
F2RL3
FLJ14454
FY
FZD1
FZD4
FZD5
FZD6
FZD8
G2A
GABBR1
GLP1R
GLP2R
GPCR150
GPR105
GPR18
GPR20
GPR21
GPR22
GPR24
GPR30
GPR31
GPR34

TABLE 16-continued

GPCRs Expressed in the Colon

GPR35
GPR37L1
GPR39
GPR4
GPR43
GPR48
GPR49
GPR54
GPR57
GPR66
GPR73
GPR77
GPR81
GPR82
GPR85
GPR86
GPR9
GPR92
GPRC5B
GPRC5C
GRCA
H963
HCRTR1
HRH1
HTR1F
HTR2B
HTR4
KIAA0758
LEC1
LEC3
MRG
MRGE
MRGF
NTSR1
OPN3
P2RY1
P2RY12
P2RY2
P2RY6
P2Y10
P2Y5
PGR16
PGR19
PGR21
PGR22
PGR25
PGR27
PGR4
PTAFR
PTGER1
PTGER2
PTGER3
PTGER4
PTHR2
RAI3
RDC1
RE2
SSTR1
SSTR3
SSTR4
SSTR5
TACR2
TEM5
TM7SF1
TM7SF3
TPRA40
TRHR2
VIPR1
VIPR2
VLGR1

Exemplary diseases and disorders involving the colon include acute self-limited infectious colitis, adenocarcinoma, adenoma, adenoma-carcinoma sequence, adenomatous polyposis coli, adenosquamous carcinomas, allergic (eosinophilic) proctitis and colitis, amebiasis, amyloidosis, angiodysplasia, anorectal malformations, blue rubber bleb nevus syndrome, brown bowel syndrome, Campylobacter fetus infection, carcinoid tumors, carcinoma of the anal canal, carcinoma of the colon and rectum, chlamidial proctitis, Crohn's disease, clear cell carcinomas, *Clostridium difficile* pseudomembranous enterocolitis, collagenous colitis, colonic adenoma, colonic diverticulosis, colonic inertia, colonic ischemia, congenital atresia, congenital megacolon (Hirschsprung's disease), congenital stenosis, constipation, Cowden's syndrome, cystic fibrosis, cytomegalovirus colitis, diarrhea, dieulafor lesion, diversion colitis, diverticulitis, diverticulosis, drug-induced diseases, dysplasia and malignancy in inflammatory bowel disease, Ehlers-Danlos syndromes, enterobiasis, familial adenomatous polyposis, familial polyposis syndromes, Gardner's syndrome, gastrointestinal stromal neoplasms, hemangiomas and vascular anomalies, hemorrhoids, hereditary hemorrhagic telangiectasia, herpes colitis, hyperplastic polyps, idiopathic inflammatory bowel disease, incontinence, inflammatory bowel syndrome, inflammatory polyps, inherited adenomatous polyposis syndromes, intestinal hamartomas, intestinal pseudo-obstruction, irritable bowel syndrome, ischemic colitis, juvenile polyposis, juvenile polyps, Klippel-Trenaunay-Weber syndrome, leiomyomas, lipomas, lymphocytic (microscopic) colitis, lymphoid hyperplasia and lymphoma, malaknock outplakia, malignant lymphoma, malignant neoplasms, malrotation, metastatic neoplasms, mixed hyperplastic and adenomatous polyps, mucosal prolapse syndrome, neonatal necrotizing enterocolitis, neuroendocrine cell tumors, neurogenic tumors, neutropenic enterocolitis, non-neoplastic polyps, Peutz-Jeghers syndrome, pneumatosis cystoides intestinalis, polyposis coli, pseudomembranous colitis, pseudoxanthoma elasticum, pure squamous carcinomas, radiation colitis, schistosomiasis, Shigella colitis (bacilliary dysentery), spindle cell carcinomas, spirochetosis, stercolar ulcers, stromal tumors, systemic sclerosis and CREST syndrome, trichuriasis, tubular adenoma (adenomatous polyp, polypoid adenoma), Turcot's syndrome, Turner's syndrome, ulcerative colitis, villous adenoma, and volvulus.

Heart. GPCRs expressed in the heart are listed in Table 17. These receptors are thus potential targets for therapeutic compounds that may modulate the activity, expression, or stability of any of these GPCRs in the heart. These polypeptides, or polymorphs of these polypeptides, may also form the basis of a therapeutic regimen, or a diagnostic test to determine, e.g., the presence of disease, the risk of developing a particular cardiovascular disease or disorder, or an appropriate therapeutic course.

TABLE 17

GPCRs Expressed in the Heart

ADCYAP1R1
ADMR
ADORA1
ADORA2A
ADORA2B
ADORA3
ADRA1A
ADRA1D
ADRA2B
ADRB1
ADRB2
AGTR1
AGTR2
AGTRL1
AVPR1A
AVPR2
BAI2
BDKRB2

TABLE 17-continued

GPCRs Expressed in the Heart

BLR1
C3AR1
C5R1
CALCRL
CASR
CCKAR
CCR1
CCR2
CCR4
CCR5
CCR6
CCR7
CCR8
CCRL1
CCXCR1
CD97
CHRM2
CHRM3
CHRM4
CMKLR1
CNR1
CNR2
CRHR2
CX3CR1
CXCR4
CXCR6
CYSLT1
DJ287G14
DRD2
EBI2
EDG1
EDG2
EDG3
EDG5
EDG6
EDG7
EDNRA
EDNRB
EMR1
ETL
F2R
F2RL1
F2RL2
FKSG79
FPR1
FPR-RS2
FY
FZD1
FZD2
FZD3
FZD4
FZD5
FZD6
G2A
GABBR1
GLP1R
GPCR150
GPR1
GPR105
GPR12
GPR14
GPR15
GPR18
GPR2
GPR21
GPR22
GPR23
GPR27
GPR30
GPR31
GPR33
GPR34
GPR35
GPR4
GPR43
GPR48
GPR49
GPR54

TABLE 17-continued

GPCRs Expressed in the Heart

GPR63
GPR65
GPR73L1
GPR75
GPR77
GPR81
GPR82
GPR83
GPR86
GPR90
GPRC5B
GPRC5C
GPRC6A
GRCA
GRPR
H963
HM74
HRH1
HRH2
HRH4
HTR2B
KIAA0758
LEC1
LGR6
LGR7
LHCGR
LTB4R
MAS1
MC2R
MRGE
MRGF
MrgG
NTSR2
OPN1MW
OPN3
OPN4
P2RY1
P2RY12
P2RY2
P2RY6
P2Y5
PGR1
PGR11
PGR20
PGR21
PGR22
PGR27
PTAFR
PTGER1
PTGER2
PTGER3
PTGER4
PTGFR
PTGIR
PTHR2
RAI3
RDC1
RRH
SMOH
SREB3
SSTR2
SSTR4
TEM5
TM7SF1
TM7SF1L1
TM7SF1L2
TM7SF3
TPRA40
TRHR2
TSHR

Cardiovascular diseases and disorders include, for example, acute coronary syndrome, acute idiopathic pericarditis, acute rheumatic fever, American trypanosomiasis (Chagas' disease), angina pectoris, ankylosing spondylitis, anomalous pulmonary venous connection, anomalous pulmonary venous drainage, aortic atresia, aortic regurgitation, aortic stenosis, aortic valve insufficiency, aortopulmonary septal defect, asymmetric septal hypertrophy, asystole, atrial fibrillation, atrial flutter, atrial septal defect, atrioventricular septal defect, autoimmune myocarditis, bacterial endocarditis, calcific aortic stenosis, calcification of the cental valve, calcification of the valve ring, carcinoid heart disease, cardiac amyloidosis, cardiac arrhythmia, cardiac failure, cardiac myxoma, cardiac rejection, cardiac tamponade, cardiogenic shock, cardiomyopathy of pregnancy, chronic adhesive pericarditis, chronic constrictive pericarditis, chronic left ventricular failure, coarctation of the aorta, complete heart block, complete transposition of the great vessels, congenital bicuspid aortic valves, congenital narrowing of the left ventricular outflow tract, congenital pulmonary valve stenosis, congenitally corrected transposition of the great arteries, congestive heart failure, constrictive pericarditis, cor pulmonale, coronary artery origin from pulmonary artery, coronary atherosclerosis, dilated (congestive) cardiomyopathy, diphtheria, double inlet left ventricle, double outlet right ventricle, Ebstein's malformation, endocardial fibroelastosis, endocarditis, endomyocardial fibrosis, eosinophilic endomyocardial disease (Loffler endocarditis), fibroma, glycogen storage diseases, hemochromatosis, hypertensive heart disease, hyperthyroid heart disease, hypertrophic cardiomyopathy, hypothyroid heart disease, idiopathic dilated cardiomyopathy, idiopathic myocarditis, infectious myocarditis, infective endocarditis, ischemic heart disease, left ventricular failure, Libman-Sachs endocarditis, lupus erythematosus, lyme disease, marantic endocarditis, metastatic tumors, mitral insufficiency, mitral regurgitation, mitral stenosis, mitral valve prolapse, mucopolysaccharidoses, multifocal atrial tachycardia, myocardial infarction, myocardial ischemia, myocardial rupture, myocarditis, myxomatuos degeneration, nonatheromatous coronary artery disease, nonbacterial thrombotic endocarditis, noninfectious acute pericarditis, nonviral infectious pericarditis, oblitaerative cardiomyopathy, patent ductus arteriosus, pericardial effusion, pericardial tumors, pericarditis, persistent truncus arteriosis, premature ventricular contraction, progressive infarction, pulmonary atresia with intact ventricular septum, pulmonary atresia with vertricular septal defect, pulmonary insufficiency, pulmonary regurgitation, pulmonary stenosis, pulmonary valve lesions, pulmonary valve stenosis, pyogenic pericarditis, Q fever, radiations myocarditis, restrictive cardiomyopathy, rhabdomyoma, rheumatic aortic stenosis, rheumatic heart disease, rocky mountain spotted fever, rupture of the aortic valve, sarcoid myocarditis, scleroderma, shingolipidoses, sinus brachycardia, sudden death, syphilis, systemic embolism from mural thrombi, systemic lupus erythematosus, tetralogy of fallot, thiamine deficiency (Beriberi) heart disease, thoracic outlet syndrome, Torsade de Pointes, toxic cardiomyopathy, toxic myocarditis, toxoplasmosis, trichinosis, tricuspid atresia, tricuspid insufficiency, tricuspid regurgitation, tricuspid stenosis, tricuspid valve lesions, tuberculuos pericarditis, typhus, ventricular aneurysm, ventricular fibrillation, ventricular septal defect, ventricular tachycardia, ventriculoarterial septal defect, viral pericarditis, and Wolff-Parkinson-White syndrome.

Intestine. GPCRs expressed in the intestine are listed in Table 18. These receptors are thus potential targets for therapeutic compounds that may modulate the activity, expression, or stability of the GPCR in the intestine. These polypeptides, or polymorphs of these polypeptides, may form the basis of a therapeutic regimen, or a diagnostic test to determine, e.g., the presence of disease or disorder involving the intestine, the risk of developing a particular disease or disorder involving the intestine, or an appropriate therapeutic course.

TABLE 18

GPCRs Expressed in the Intestine

ADORA1
ADORA2A
ADORA2B
ADORA3
ADRA2A
ADRA2B
ADRB1
ADRB2
AGTRL1
AVPR2
BDKRB2
BLR1
C3AR1
C5R1
CALCRL
CCBP2
CCKAR
CCR1
CCR3
CCR5
CCR6
CCR7
CCR9
CCRL1
CCXCR1
CD97
CELSR1
CELSR3
CHRM1
CHRM2
CHRM3
CHRM4
CMKBR1L2
CMKLR1
CX3CR1
CXCR4
CXCR6
CYSLT1
CYSLT2
DJ287G14
EBI2
EDG1
EDG2
EDG3
EDG4
EDG5
EDG7
EDNRB
EMR1
ETL
F2R
F2RL2
F2RL3
FKSG79
FLJ14454
FPR-RS2
FY
FZD1
FZD2
FZD3
FZD4
FZD5
FZD6
FZD8
G2A
GABBR1
GALR1
GALR3
GIPR
GLP1R
GPCR150
GPR105
GPR18
GPR19
GPR2
GPR20
GPR22
GPR24

TABLE 18-continued

GPCRs Expressed in the Intestine

GPR27
GPR30
GPR31
GPR34
GPR35
GPR37L1
GPR39
GPR4
GPR43
GPR48
GPR49
GPR54
GPR55
GPR56
GPR57
GPR65
GPR66
GPR73
GPR77
GPR81
GPR82
GPR86
GPR9
GPR92
GPRC5B
GPRC5C
GRM4
GRPR
H963
HCRTR1
HRH1
HRH2
HTR2B
IL8RA
KIAA0758
LEC1
LEC2
LEC3
LTB4R
LTB4R2
MRG
MRGE
MRGF
MTNR1A
NMU2R
NTSR1
OPRM1
P2RY1
P2RY12
P2RY2
P2RY6
P2Y10
P2Y5
PGR1
PGR13
PGR15
PGR16
PGR21
PGR22
PGR25
PGR26
PGR27
PGR7
PTAFR
PTGER1
PTGER2
PTGER3
PTGER4
PTGIR
PTHR2
RAI3
RDC1
RE2
SMOH
SSTR2
TACR1
TEM5
TM7SF1

TABLE 18-continued

GPCRs Expressed in the Intestine

TM7SF1L1
TM7SF3
TPRA40
TRHR2
VIPR1
VIPR2

Diseases and disorders involving the intestine include abdominal hernia, abetalipoproteinemia, abnormal rotation, acute hypotensive hypoperfusion, acute intestinal ischemia, acute small intestinal infarction, adenocarcinoma, adenoma, adhesions, amebiasis, anemia, arterial occlusion, atypical mycobacteriosis, bacterial diarrhea, bacterial overgrowild typeh syndromes, botulism, Campylobacter fetus infection, Campylobacter jejuni infection, carbohydrate absorption defects, carcinoid tumors, celiac disease (nontropical sprue, gluten-induced enteropathy), cholera, Chrohn's disease, chronic intestinal ischemia, *Clostridium difficile* pseudomembranous enterocolitis, *Clostridium perfringens* infection, congenital umbilical hernia, Cronkhite-Canada syndrome, cytomegalovirus enterocolitis, diarrhea, diarrhea caused by invasive bacteria, diverticulitits, diverticulosis, dysentery, enteroinvasive and enterohemorrhagic *Escherichia coli* infection, eosinophilic gastroenteritis, failure of peristalsis, familial polyposis syndromes, food poisoning, fungal enteritis, gangliocytic paragangliomas, Gardner's syndrome, gastrointestinal stromal neoplasms, giardiasis, hemorrhoids, hernia, hyperplastic polyps, idiopathic inflammatory bowel disease, ileus, imperforate anus, intestinal (abdominal ischemia), intestinal atresia, intestinal cryptosporidiosis, microsporidiosis & isosporiasis in AIDS, intestinal hamartomas, intestinal helminthiasis, intestinal hemorrhage, intestinal infiltrative disorders, intestinal lymphangiectasia, intestinal obstruction, intestinal perforation, intestinal reduplication, intestinal stenosis, intestinal tuberculosis, intussusception, jejunal diverticulosis, juvenile polyposis, juvenile retention polyps, lactase deficiency, lymphomas, malabsorption syndrome, malignant lymphoma, malignant neoplasms, malrotations, mechanical obstruction, Meckel's diverticulum, meconium ileus, mediterranean lymphoma, mesenchymal tumors, mesenteric vasculitis, mesenteric vein thrombosis, metastatic neoplasms, microvillus inclusion disease, mixed hyperplastic and adenomatous polyps, neonatal necrotizing enterocolitis, nodular duodenum, nonocclusive intestinal ischemia, nonspecific duodenitis, nontyphoidal salmonellosis, omphalocele, parasitic infections, peptic ulcer disease, Peutz-Jeghers syndrome, pneumatosis cystoides intestinalis, poorly differentiated neuroendocrine carcinomas, primary lymphoma, protein-losing enteropathy, *Salmonella gastroenteritis*, sarcoidosis, sarcomas, shigellosis, staphlococcal food poisoning, steatorrhea, sugar intolerance, thrombosis of the mesenteric veins, toxigenic diarrhea, toxigenic *Escherichia coli* infection, tropical sprue, tubular adenoma (adenomatous polyp, polypoid adenoma), typhoid fever, ulcers, vascular malformations, villous adenoma, viral enteritis, viral gastroenteritis, visceral myopathy, visceral neuropathy, vitelline duct remnants, volvulus, Western-type intestinal lymphoma, Whipple's disease (intestinal lipopystrophy), *Yersinia enterocolitica* & *Yersinia pseudotuberculosis* infection, and Zollinger-Ellison syndrome.

Kidney. GPCRs expressed in the kidney are listed in Table 19. These receptors are thus potential targets for therapeutic compounds that may modulate the activity, expression, or stability of the GPCR in the kidney. These polypeptides, or polymorphs of these polypeptides, may form the basis of a therapeutic regimen, or a diagnostic test to determine, e.g., the presence of disease, the risk of developing a particular kidney disease or disorder, or an appropriate therapeutic course.

TABLE 19

GPCRs Expressed in the Kidney

ADCYAP1R1
ADMR
ADORA1
ADORA2A
ADORA2B
ADRA1A
ADRA1B
ADRA1D
ADRA2B
ADRB1
ADRB2
AGTR1
AGTR2
AGTRL1
AVPR2
BDKRB1
BLR1
C3AR1
CALCR
CALCRL
CASR
CCKAR
CCR1
CCR2
CCR5
CCR6
CCR7
CD97
CELSR1
CELSR2
CHRM1
CHRM3
CMKLR1
CNR1
CNR2
CX3CR1
CXCR4
CXCR6
CYSLT1
DJ287G14
EBI2
EDG1
EDG2
EDG3
EDG4
EDG5
EDG6
EDG7
EDNRA
EDNRB
EMR1
ETL
F2R
F2RL1
F2RL2
F2RL3
FKSG79
FPR-RS2
FZD1
FZD2
FZD4
FZD5
FZD6
FZD7
FZD8
G2A
GABBR1
GALR3
GCGR
GHRHR

TABLE 19-continued

GPCRs Expressed in the Kidney

GLP1R
GPCR150
GPR105
GPR18
GPR19
GPR2
GPR21
GPR23
GPR24
GPR30
GPR31
GPR34
GPR35
GPR39
GPR4
GPR41
GPR48
GPR49
GPR54
GPR63
GPR65
GPR80
GPR81
GPR84
GPR85
GPR91
GPR92
GPRC5B
GPRC5C
GRCA
HM74
HTR1B
HTR2B
HUMNPIIY20
KIAA0758
LEC1
LTB4R
LTB4R2
MAS1
MC2R
MC4R
MRG
MRGE
MRGF
NPY6R
OPN3
OPRL1
P2RY1
P2RY2
P2RY6
P2Y10
P2Y5
PGR1
PGR16
PGR19
PGR20
PGR21
PGR22
PGR25
PGR7
PGR8
PTAFR
PTGDR
PTGER1
PTGER3
PTGER4
PTGFR
PTGIR
PTHR1
RAI3
RDC1
SMOH
SREB3
TBXA2R
TEM5
TM7SF1
TM7SF1L1
TM7SF3

TABLE 19-continued

GPCRs Expressed in the Kidney

TPRA40
TRHR2
TSHR
VIPR2

Exemplary diseases and disorders of the kidney include acquired cystic disease, acute (postinfectious) glomerulonephritis, acute infectious interstitial nephritis, acute interstitial nephritis, acute pyelonephritis, acute renal failure, acute transplant failure, acute tubular necrosis, adult polycystic kidney disease, AL amyloid, analgesic nephropathy, antiglomerular basement membrane disease (Goodpasture's Syndrome), asymptomatic hematuria, asymptomatic proteinuria, autosomal dominant polycystic kidney disease, autosomal recessive polycystic kidney disease, Bence Jones cast nephropathy, benign familial hematuria, benign nephrosclerosis and atheromatous embolization, bilateral cortical necrosis, chronic glomerulonephritis, chronic interstitial nephritis, chronic pyelonephritis, chronic renal failure, chronic transplant failure, circulating immune complex nephritis, crescentic glomerulonephritis, cryoglobulinemia, cystic renal dysplasia, diabetic glomerulosclerosis, diabetic nephropathy, dialysis cystic disease, drug induced (allergic) acute interstitial nephritis, ectopic kidney, Fabry's disease, familial juvenile nephronophthisis-medullary cystic disease complex, focal glomerulosclerosis (segmental hyalinosis), glomerulocystic disease, glomerulonephritis, glomerulonephritis associated with bacterial endocarditis, glomerulosclerosis, hemolytic-uremic syndrome, Henoch-Schonlein purpura, hepatitis-associated glomerulonephritis, hereditary nephritis (Alport syndrome), horseshoe kidney, hydronephrosis, IgA nephropathy, infantile polycystic kidney disease, ischemic acute tubular necrosis, light-cahin deposit disease, malignant nephrosclerosis, medullary cystic disease, membranoproliferative (mesangiocapillary) glomerulonephritis, membranous glomerulonephritis, membranous nephropathy, mesangial proliferative glomerulonephritis (includes Berger's Disease), minimal change glomerular disease, minimal change nephrotic syndrome, nephritic syndrome, nephroblastoma (Wilms tumor), nephronophthisis (medullary cystic disease complex), nephrotic syndrome, plasma cell dyscrasias (monoclonal immunoglobulin-induced renal damage), polyarteritis nodosa, proteinuria, pyelonephritis, rapidly progressive (crescentic) glomerulonephritis, renal agenesis, renal amyloidosis, renal cell carcinoma, renal dysgenesis, renal dysplasia, renal hypoplasia, renal infection, renal osteodystrophy, renal stones (urolithiasis), renal tubular acidosis, renal vasculitis, renovascular hypertension, scleroderma (progressive systemic sclerosis), secondary acquired glomerulonephritis, simple renal cysts, systemic lupus erythematosus, thin basement membrane nephropathy, thrombotic microangiopathy, thrombotic thrombocytopenic purpura, toxic acute tubular necrosis, tubular defects, tubulointerstitial disease in multiple myeloma, urate nephropathy, urinary obstruction, and vasculitis.

Liver. GPCRs expressed in the liver are listed in Table 20. These receptors are thus potential targets for therapeutic compounds that may modulate the activity, expression, or stability of the GPCR in the liver. These polypeptides, or polymorphs of these polypeptides, may form the basis of a therapeutic regimen, or a diagnostic test to determine, e.g., the presence of disease, the risk of developing a particular liver disease or disorder, or an appropriate therapeutic course.

TABLE 20

GPCRs Expressed in the Liver

ADMR
ADORA1
ADORA2A
ADRA1A
ADRA1B
ADRA2B
ADRB1
ADRB2
AGTR1
AVPR1A
AVPR2
BLR1
C5R1
CALCRL
CCBP2
CCKAR
CCR2
CCR5
CCRL1
CD97
CELSR1
CHRM1
CMKBR1L2
CMKLR1
CNR1
CNR2
CXCR4
CYSLT1
DJ287G14
EBI2
EDG1
EDG2
EDG3
EDG5
EDNRA
EDNRB
EMR1
ETL
F2R
F2RL2
FLJ14454
FPR1
FY
FZD4
FZD6
FZD7
FZD8
G2A
GABBR1
GCGR
GLP1R
GPR19
GPR21
GPR39
GPR48
GPR51
GPR54
GPR56
GPR57
GPR66
GPR73
GPR86
GPR9
GPR91
GPRC5C
GRCA
H963
HTR1D
HTR1F
HTR7
IL8RA
KIAA0758
LTB4R2
MRG
MRGE
MTNR1A
OPN3
OPRM1

TABLE 20-continued

GPCRs Expressed in the Liver

P2RY1
P2RY12
P2RY2
P2RY4
P2RY6
P2Y5
PGR16
PGR18
PGR21
PGR22
PGR26
PGR7
PGR8
PTAFR
PTGDR
PTGER2
SMOH
SSTR4
TEM5
TM7SF1
TM7SF1L1
TM7SF3
TPRA40
VIPR1
VLGR1

Exemplary liver diseases and disorders include acute alcoholic hepatitis (acute sclerosing hyaline necrosis of the liver), acute graft-versus-host disease, acute hepatitis, acute hepatocellular injury associated with infectious diseases other than viral hepatitis, acute liver failure, acute viral hepatitis, adenovirus hepatitis, Alagille syndrome, alcoholic cirrhosis, alcoholic hepatitis, alcoholic liver disease, alpha 1-antitrypsin deficiency, amebic abscess, angiolmyolipoma, angiosarcoma, ascending cholangitis, autoimmune chronic active hepatitis (lupoid hepatitis), bile duct adenoma, bile duct cystadenocarcinoma, bile duct cystadenoma, biliary atresia, biliary cirrhosis, biliary papillomatosis, bridging necrosis, Budd-Chiari syndrome, Byler disease, cardiac fibrosis of the liver, Caroli disease, cavernous hemangioma, cholangiocarcinoma, cholangitic abcess, choleostasis, cholestatic viral hepatitis, chronic active hepatitis, chronic alcoholic liver disease, chronic graft-versus-host disease, chronic hepatic venous congestion, chronic hepatitis, chronic liver failure, chronic passive congestion, chronic viral hepatitis, cirrhosis, combined hepatocellular and cholangiocarcinoma, confluent hepatic necrosis, congenital hepatic fibrosis, Crigler-Najjar syndrome, cryptogenic cirrhosis, cystic fibrosis, defects of coagulation, delta hepatitis, Dubin-Johnson syndrome, epithelioid hemangioendothelioma, erythrohepatic protoporphyria, extrahepatic biliary obstruction (primary biliary cirrhosis), fatty change, fatty liver, focal necrosis, focal nodular hypeplasia, fulminant viral hepatitis, galactosemia, Gilbert's syndrome, glycogen storage diseases, graft-versus-host disease, granulomatous hepatitis, hemangioma, hemangiosarcoma, hemochromatosis, hepatic adenoma, hepatic amebiasis, hepatic encephalopathy, hepatic failure, hepatic schistosomiasis, hepatic veno-occlusive disease, hepatitis A, hepatitis B, hepatitis C, hepatitis D, hepatitis E, hepatoblastoma, hepatocellular adenoma, hepatocellular carcinoma, hepatocellular necrosis, hepatorenal syndrome, hereditary fructose intolerance, hereditary hemochromatosis, herpesvirus hepatitis, hydatid cust, hyperplastic lesions, hypoalbuminenia, infantile hemangioendothelioma, infarction of the liver, infectious mononucleosis hepatitis, inflammatory pseudotumor of the liver, intrahepatic cholangiocarcinoma, intrahepatic cholestasis, intrahepatic protal hypertension, ischemic necrosis (ischemic hepatitis), isoniazid-induced necrosis, jaundice, leptospirosis, liver cell adenoma, liver manifestations of Rocky Mountain spotted fever, macronodular cirrhosis, macrovesicular steatosis, malignant vascular neoplasts, mass lesions, massive hepatocellular necrosis, massive necrosis, mesenchymal hamartoma, metastatic tumors, micronodular cirrhosis, microvesicular steatosis, neonatal (physiologic) jaundice, neonatal hepatitis, neoplastic lesions, nodular transformation (nodular regenerative hyperplasia, nonsuppurative infections, nutritional cirrhosis, nutritional liver disease, oriental cholangiohepatitis, parasitic infestation of the liver, peliosis hepatis, porphyria cutaneo tarda, portal hypertension, portal vein thrombosis, posthepatic portal hypertension, predictable (dose-related) toxicity, prehepatic portal hypertension, primary biliary cirrhosis, primary sclerosing cholangitis, pyogenic liver abcess, Q-fever hepatitis, Rotor's syndrome, sclerosing bile duct adenoma, sclerosing cholangitis, secondary hemochromatosis, submassive necrosis, syphilis, toxic liver injury, tyrosinemia, undifferentiated sarcoma, unpredictable (idiosyncratic) toxicity, vascular lesions, virus-induced cirrhosis, Wilson's disease, and zonal necrosis.

Lung. GPCRs expressed in the lung are listed in Table 21. These receptors are thus potential targets for therapeutic compounds that may modulate the activity, expression, or stability of the GPCR in the lung. These polypeptides, or polymorphs of these polypeptides, may form the basis of a therapeutic regimen, or a diagnostic test to determine, e.g., the presence of a lung disease or disorder, the risk of developing such a disease or disorder, or an appropriate therapeutic course.

TABLE 21

GPCRs Expressed in the Lung

ADCYAP1R1
ADMR
ADORA1
ADORA2A
ADORA2B
ADORA3
ADRA1A
ADRA1D
ADRA2A
ADRA2B
ADRB1
ADRB2
ADRB3
AGTR1
AGTRL1
AVPR2
BAI2
BDKRB1
BDKRB2
BLR1
C3AR1
C5R1
CALCR
CALCRL
CCBP2
CCKAR
CCR1
CCR2
CCR3
CCR4
CCR5
CCR6
CCR7
CCR8
CCR9
CCRL1
CCXCR1
CD97
CELSR1
CELSR2

TABLE 21-continued

GPCRs Expressed in the Lung

| |
|---|
| CELSR3 |
| CHRM1 |
| CHRM2 |
| CHRM3 |
| CMKBR1L2 |
| CMKLR1 |
| CNR1 |
| CNR2 |
| CRHR2 |
| CX3CR1 |
| CXCR4 |
| CXCR6 |
| CYSLT1 |
| CYSLT2 |
| DJ287G14 |
| DRD2 |
| EBI2 |
| EDG1 |
| EDG2 |
| EDG3 |
| EDG4 |
| EDG5 |
| EDG6 |
| EDG7 |
| EDG8 |
| EDNRA |
| EDNRB |
| EMR1 |
| ETL |
| F2R |
| F2RL1 |
| F2RL2 |
| F2RL3 |
| FKSG79 |
| FPR1 |
| FY |
| FZD1 |
| FZD10 |
| FZD2 |
| FZD3 |
| FZD4 |
| FZD5 |
| FZD6 |
| FZD7 |
| G2A |
| GABBR1 |
| GALR3 |
| GLP1R |
| GPCR150 |
| GPR1 |
| GPR105 |
| GPR15 |
| GPR17 |
| GPR18 |
| GPR19 |
| GPR2 |
| GPR21 |
| GPR23 |
| GPR24 |
| GPR27 |
| GPR30 |
| GPR31 |
| GPR33 |
| GPR34 |
| GPR35 |
| GPR37 |
| GPR39 |
| GPR4 |
| GPR40 |
| GPR43 |
| GPR44 |
| GPR48 |
| GPR54 |
| GPR55 |
| GPR57 |
| GPR63 |
| GPR65 |
| GPR66 |
| GPR68 |
| GPR7 |
| GPR73 |
| GPR75 |
| GPR77 |
| GPR80 |
| GPR81 |
| GPR82 |
| GPR83 |
| GPR84 |
| GPR86 |
| GPR9 |
| GPR92 |
| GPRC5B |
| GPRC5C |
| GPRC6A |
| GRM4 |
| GRM6 |
| H963 |
| HCRTR1 |
| HGPCR11 |
| HGPCR19 |
| HM74 |
| HRH2 |
| HRH4 |
| HTR1B |
| HTR1F |
| HTR2A |
| HTR2B |
| HTR4 |
| HTR6 |
| HTR7 |
| HUMNPIIY20 |
| IL8RA |
| IL8RB |
| KIAA0758 |
| LEC1 |
| LEC2 |
| LEC3 |
| LGR6 |
| LGR7 |
| LTB4R |
| LTB4R2 |
| MAS1 |
| MC5R |
| MRG |
| MRGE |
| MRGF |
| MrgG |
| NPY1R |
| OPN1MW |
| OPN3 |
| OPRD1 |
| P2RY1 |
| P2RY12 |
| P2RY2 |
| P2RY4 |
| P2RY6 |
| P2Y10 |
| P2Y5 |
| PGR1 |
| PGR13 |
| PGR15 |
| PGR16 |
| PGR20 |
| PGR21 |
| PGR22 |
| PGR23 |
| PGR25 |
| PGR26 |
| PGR27 |
| PGR4 |
| PGR5 |
| PGR7 |
| PGR8 |
| PTAFR |
| PTGER1 |
| PTGER2 |

TABLE 21-continued

GPCRs Expressed in the Lung

PTGER3
PTGER4
PTGFR
PTGIR
PTHR1
RAI3
RDC1
RE2
SMOH
SREB3
SSTR1
SSTR2
SSTR4
TACR1
TBXA2R
TEM5
TM7SF1
TM7SF1L1
TM7SF1L2
TM7SF3
TPRA40
TRHR2
TSHR
VIPR2

Exemplary lung diseases and disorders (including those of the trachea) include abnormal diffusion, abnormal perfusion, abnormal ventilation, accelerated silicosis, actinomycosis, acute air space pneumonia (acute bacterial pneumonia), acute bronchiolitis, acute congestion, acute infections of the lung, acute interstitial pneumonia, acute necrotizing viral pneumonia, acute organic dust toxic syndrome, acute pneumonia, acute radiation pneumonitis, acute rheumatic fever, acute silicosis, acute tracheobronchitis, adenocarcinoma, adenoid cystic carcinoma, adenosquamous carcinoma, adenovirus, adult respiratory distress syndrome (shock lung), agenesis, AIDS, air embolism, allergic bronchopulmonary mycosis, allergic granulomatosis and angiitis (Churg-Strauss), allograft rejection, aluminum pneumoconiosis, alveolar microlithiasis, alveolar proteinosis, amebic lung abscess, amniotic fluid embolism, amyloidosis of the lung, anomalies of pulmonary vasculature, anomalous pulmonary venous return, apiration pneumonia, aplasia, asbestosis, asbestos-related diseases, aspergillosis, asthma, atelectasis, atriovenous fistulas, atypical mycobacterial infection, bacteremia, bacterial pneumonia, benign clear cell tumor, benign epitbelial tumors, benign fibrous mesothelioma, berylliosis, blastomycosis, bromchial atresia, bronchial asthma, bronchial carcinoid tumor, bronchial isomerism, bronchial obstruction, bronchial stenosis, bronchiectasis, bronchiolalveolar carcinoma, bronchiolitis, bronchiolitis obliterans-organizing pneumonia, bronchocentric granulomatosis, bronchogenic cyst, bronchopneumonia, bronchopulmonary dysplasia, bronchopulmonary sequestration, bullae, bullous emphysema, cancer, carcinoid tumors, carcinoma of the lung (bronchogenic carcinoma), central (bronchogenic) carcinoma, central cyanosis, centriacinar emphysema, cetrilobular emphysema, chest pain, Chlamydial pneumonia, chondroid hamartoma, chronic airflow obstruction, chronic bronchitis, chronic diffuse interstitial lung disease, chronic idiopathic pulmonary fibrosis, chronic lung abscess, chronic obstructive pulmonary diseases, chronic radiation pneumonitis, chronic silicosis, chylothorax, ciliary dyskinesia, coal worker's pneumoconiosis (anthracosis), coccidioidomycosis, collagen-vascular diseases, common cold, compensatory emphysema, congenital acinar dysplasia, congenital alveolar capillary dysplasia, congenital bronchobiliary fistula, congenital bronchoesophageal fistula, congenital cystic adenomatoid malformation, congenital pulmonary lymphangiectasis, congenital pulmonary overinflation (congenital emphysema), congestion, cough, cryptococcosis, cyanosis, cystic fibrosis, cysticercosis, cytomegalovirus, desquamative interstitial pneumonitis, destructive lung disease, diatomaceous earth pneumoconiosis, diffuse alveolar damage, diffuse pulmonary hemorrhage, diffuse septal amyloidosis, difuse panbronchiolitis, Dirofilaria immitis, diseases of the pleura, distal acinar (paraceptal) emphysema, drug-induced asthma, drug-induced diffuse alveolar damage, dyspnea, ectopic hormone syndromes, emphysema, empyemma, eosinophilic pneumonias, exercise-induced asthma, extralobar sequestration, extrinsic allergic asthma, fat emboli, focal dust emphysema, follicular bronchiolitis, follicular bronchitis, foreign-body embolism, Fuller's earth pneumoconiosis, functional resistance to arterial flow (vasoconstriction), fungal granulomas of the lung, fungal infections, Goodpasture's syndrome, graphite pneumoconiosis, gray hepatization, hamartomas, hard metal disease, hemoptysis, hemothorax, herniation of lung tissue, herpes simplex, heterotopic tissues, high-altitude pulmonary edema, histoplasmosis, horseshoe lung, humidifier fever, hyaline membrane disease, hydatid cysts, hydrothorax, hypersensitivity pneumonitis (extrinsic allergic alveolitis), hypoxic vascular remodeling, iatrogenic drug-, chemical-, or radiation-induced interstitial fibrosis, idiopathic interstitial pneumonia, idiopathic organizing pneumonia, idiopathic pulmonary fibrosis (fibrosing alveolitis, Hamman-Rich syndrome, acute interstitial pneumonia), idiopathic pulmonary hemosiderosis, immunologic interstitial fibrosis, immunologic interstitial pneumonitis, immunologic lung disease, infections causing chronic granulomatous inflammation, infections causing chronic suppurative inflammation, infections of the air passages, infiltrative lung disease, inflammatory lesions, inflammatory pseudotumors, influenza, interstitial diseases of uncertain etiology, interstitial lung disease, interstitial pneumonitis in connective tissue diseases, intralobar sequestration of the lung (congenital), intrinsic (nonallergic) asthma, invasive pulmonary aspergillosis, kaolin pneumoconiosis, Kartagner's syndrome, *Klebsiella* pneumonia, Langerhans' cell histiocytosis (histiocytosis X), large cell undifferentiated carcinoma, larval migration of *Ascaris* lumbricoides, larval migration of Strongyloides stercoralis, left pulmonary artery "sling", Legionella pneumonia, lipid pneumonia, lobar pneumonia, localized emphysema, long-standing bronchial obstruction, lung abscess, lung collapse, lung fluke, lung transplantation implantation response, lymphangiomyomatosis, lymphocytic interstitial pneumonitis (pseudolymphoma, lymphoma, lymphomatoid granulomatosis, malignant mesothelioma, massive pulmonary hemorrhage in the newborn, measles, meconium aspiration syndrome, mesenchymal cystic hamartomas, mesenchymal tumors, mesothelioma, metal-induced lung diseases, metastatic calcification, metastatic neoplasms, metastatic ossification, mica pneumoconiosis, mixed dust fibrosis, mixed epithelial-mesenchymal tumors, mixed type neoplasms, mucoepidermoid tumor, mucoviscidosis (fibrocystic disease of the pancreas, mycoplasma pneumoniae, necrotizing bacterial pneumonia, necrotizing sarcoid granulomatosis, neonatal respiratory distress syndrome, neoplasms of the pleura, neuromuscular syndromes, nocardiosis, nondestructive lung disease, North American blastomycosis, occupational asthma, organic dust disease, panacinar emphysema, Pancoast's syndrome, paracoccidioidomycosis, parainfluenza, paraneoplastic syndromes, paraseptal emphysema (paracicatricial), parasilicosis syndromes, parasitic infections of the lung, peripheral cyanosis, peripheral lung carcinoma, persistent pulmonary hypertension of the newborn, pleural diseases, pleural effusion, pleural plaques, pneumococcal pneumonia, pneumoconioses (inorganic dust diseases), *Pneumocystis carinii* pneumonia, pneumocystosis, pneumonitis, pneumothorax, precapillary pulmonary hypertension, primary (childhood) tuberculosis, primary (idiopathic) pulmonary hypertension, primary mesothelial neoplasms, primary pulmonary hypertensions, progressive massive fibrosis, psittacosis, pulmonary actinomycosis, pulmonary air-leak syndromes, pulmonary alveolar proteinosis, pulmonary arteriovenous malformation, pulmonary blastoma, pulmonary capillary hemangiomatosis, pulmonary carcinosarcoma, pulmonary edema, pulmonary embolism, pulmonary eosinophilia, pulmonary fibrosis, pulmonary hypertension, pulmonary hypoplasia, pulmonary infarction, pulmonary infiltration and eosinophilia, pulmonary interstitial air (pulmonary interstitial emphysema), pulmonary lesions, pulmonary nocardiosis, pulmonary parenchymal anomalies, pulmonary thromboembolism, pulmonary tuberculosis, pulmonary vascular disorders, pulmonary vasculitides, pulmonary veno-occlusive disease, pyothorax, radiation pneumonitis, recurrent pulmonary emboli, red hepatization, respiration failure, respiratory syncytial virus, Reye's syndrome, rheumatoid lung disease, Rickettsial pneumonia, rupture of pulmonary arteries, sarcoidosis, scar cancer, scimitar syndrome, scleroderma, sclerosing hemangioma, secondary (adult) tuberculosis, secondary bacterial pneumonia, secondary pleural neoplasms, secondary pulmonary hypertension, senile emphysema, siderosis, silicate pneumoconiosis asbestosis, silicatosis, silicosis, simple nodular silicosis, Sjogren's syndrome, small airway lesions, small cell carcinoma, small cell undifferentiated (oat cell) carcinoma, spontaneous pneumothorax, sporotrichosis, sputum production, squamous (epidermoid) carcinoma, stannosis, staphlococcal pneumonia, suppuration (abscess formation), systemic lupus erythematosus, talcosis, tension pneumothorax, tracheal agenesis, tracheal stenosis, tracheobronchial amyloidosis, tracheobronchomegaly, tracheoesophageal fistula, transient tachypnea of the newborn (neonatal wet lung), tungsten carbide pneumoconiosis, usual interstitial pneumonia, usual interstitial pneumonitis, varicella, viral pneumonia, visceral pleural thickening, Wegener's granulomatosis, and whooping cough (pertussis).

Muscle. GPCRs expressed in the muscle are listed in Table 22. These receptors are thus potential targets for therapeutic compounds that may modulate the activity, expression, or stability of the GPCR in the muscle. These polypeptides, or polymorphs of these polypeptides, may form the basis of a therapeutic regimen, or a diagnostic test to determine, e.g., the presence of a muscular disease or disorder, the risk of developing a particular disease or disorder, or an appropriate therapeutic course.

TABLE 22

| GPCRs Expressed in the Muscle |
|---|
| ADMR |
| ADORA2B |
| ADRA2B |
| ADRB2 |
| AGR9 |
| AGTRL1 |
| CCR1 |
| CCR3 |
| CCR9 |
| CCRL1 |
| CD97 |
| CELSR1 |

TABLE 22-continued

| GPCRs Expressed in the Muscle |
|---|
| CMKLR1 |
| CNR2 |
| CRHR2 |
| CXCR4 |
| CXCR6 |
| EDG1 |
| EDG2 |
| EDG7 |
| EDNRA |
| EMR1 |
| FKSG79 |
| FY |
| FZD4 |
| FZD7 |
| FZD8 |
| GABBR1 |
| GPR19 |
| GPR2 |
| GPR21 |
| GPR24 |
| GPR37L1 |
| GPR39 |
| GPR4 |
| GPR43 |
| GPR48 |
| GPR55 |
| GPR66 |
| GPR77 |
| GPR80 |
| GPR81 |
| GPR82 |
| GPR9 |
| GPRC5C |
| GRCA |
| GRPR |
| HGPCR19 |
| HM74 |
| HRH3 |
| HTR4 |
| IL8RA |
| KIAA0758 |
| LEC1 |
| LEC2 |
| MRG |
| MRGD |
| NMU2R |
| NTSR1 |
| P2RY12 |
| P2RY6 |
| P2Y10 |
| P2Y5 |
| PGR13 |
| PGR15 |
| PGR16 |
| PGR21 |
| PGR25 |
| PGR26 |
| PGR27 |
| PGR4 |
| PGR5 |
| PGR7 |
| PNR |
| RE2 |
| TEM5 |
| TM7SF1 |
| TM7SF1L1 |
| TM7SF1L2 |
| TM7SF3 |
| TPRA40 |
| TSHR |
| VIPR2 |

Exemplary diseases and disorders involving the muscles include abnormalities of ion channel closure, acetylcholine receptor deficiency, acetylcholinesterase deficiency, acid maltase deficiencies (type 2 glycogenosis), acquired myopathies, acquired myotonia, adult myotonic dystrophy, alveolar rhabdomyosarcoma, aminoglycoside drugs, amyloidosis, amyotrophic lateral sclerosis, antimyelin antibodies, bacteremic myositis, Batten's disease (neuronal ceroid lipofuscinoses), Becker's muscular dystrophy, benign neoplasms, Bornholm disease, botulism, branching enzyme deficiency (type 4 glycogenosis), carbohydrate storage diseases, carnitine deficiencies, carnitine palmitoyltransferase deficiency, central core disease, centronuclear (myotubular) myopathy, Chagas' disease, chondrodystrophic myotonia, chronic renal disease, congenital fiber type disproportion, congenital muscular dystrophy, congenital myopathies, congenital myotonic dystrophy, congenital paucity of synaptic clefts, cysticercosis, cytoplasmic body myopathy, debranching enzyme deficiency (type 3 glycogenosis), defect in acetylcholine synthesis, denervation, dermatomyositis, diabetes mellitus, diphtheria, disorders of glycolysis, disorders of neuromuscular junction, distal muscular dystrophy, drug induced inflammatory myopathy, Duchenne muscular dystrophy, embryonal rhabdomyosarcoma, Emery-Dreifuss muscular dystrophy, exotoxic bacterial infections, facioscapulohumeral muscular dystrophy, failure of neuromuscular transmission, fiber necrosis, fibromyalgia, fingerprint body myopathy, Forbe's disease, gas gangrene, Guillain-Barre syndrome, inclusion body myositis, infantile spinal muscular atrophies, infectious myositis, inflammatory myopathies, influenza, Isaac's syndrome, ischemia, Kearns-Sayre syndrome, lactase dehydrogenase deficiency, Lambert-Eaton syndrome, Leigh's disease, leuknock outdystrophies, limb girdle muscular dystrophy, lipid storage myopathies, Luft's disease, lysosomal glycogen storage disease with normal acid maltase activity, maignant neoplasms, malignant hyperthermia, McArdle's disease, MELAS syndrome (mitochondrial myopathy, encephalopathy,lacticacidosis, and strokes), MERRF syndrome (myoclonus epilepsy with ragged-red fibers), metabolic myopathies, microfiber myopathy, mitochondrial myopathies, multicore disease (minicore disease), multisystem triglyceride storage disease, muscle wasting from diabetes, muscular dystrophies, myasthenia gravis, myasthenic syndrome (Eaton-Lambert syndrome), myoadenylate deaminase deficiency, myoglobinuria, myopathies, myophosphorylase deficiency (type 5 glycogenosis), myositis, myositis ossificans, myotonia congenita, myotonic muscular dystrophy, nemaline myopathy, ocular muscular dystrophy, oculopharyngeal muscular dystrophy, paramyotonia, parasytic myopathies, periodic paralysis, peripheral neuropathies, phosphofructokinase deficiency (type 7 glycogenosis), phosphoglycerate kinase deficiency, phosphoglycerate mutase deficiency, pleomorphic rhabdomyosarcoma, polymyositis, Pompe's disease, progressive muscular atrophy, progressive systemic sclerosis, reducing body myopathy, Refsum's disease, rhabdomyolysis, rhabdomyoma, rhabdomyosarcoma, sarcoidosis, sarcoma botryoides, sarcotubular myopathy, secondary congenital myopathies, slow channel syndrome, spasmodic torticollis, spheroid body myopathy, spinal muscular atrophy, steroid myopathy, stiff-person syndrome, systemic lupus erythematosus, Tauri's disease, tick paralysis, toxic myopathies, toxoplasmosis, trichinosis, trilaminar fiber myopathy, type 2 myofiber atrophy, typhoid fever, vasculitis, viral myositis, and zebra body myopathy.

Ovary. GPCRs expressed in the ovary are listed in Table 23. These receptors are thus potential targets for therapeutic compounds that may modulate the activity, expression, or stability of the GPCR in the ovary. These polypeptides, or polymorphs of these polypeptides, may form the basis of a therapeutic regimen, or a diagnostic test to determine, e.g., the presence of disease, the risk of developing a particular ovarian disease or disorder, or an appropriate therapeutic course.

TABLE 23

| GPCRs Expressed in the Ovary |
| --- |
| ADCYAP1R1 |
| ADMR |
| ADORA1 |
| ADORA2A |
| ADORA2B |
| ADORA3 |
| ADRA1D |
| ADRA2A |
| ADRA2B |
| ADRA2C |
| ADRB1 |
| ADRB2 |
| ADRB3 |
| AGTR1 |
| AGTR2 |
| AGTRL1 |
| AVPR1A |
| AVPR1B |
| AVPR2 |
| BAI2 |
| BAI3 |
| BDKRB1 |
| BDKRB2 |
| BLR1 |
| C3AR1 |
| C5R1 |
| CALCRL |
| CASR |
| CCBP2 |
| CCKAR |
| CCKBR |
| CCR1 |
| CCR2 |
| CCR3 |
| CCR4 |
| CCR5 |
| CCR6 |
| CCR7 |
| CCR8 |
| CCR9 |
| CCRL1 |
| CCXCR1 |
| CD97 |
| CELSR1 |
| CELSR2 |
| CHRM1 |
| CHRM3 |
| CHRM4 |
| CMKBR1L2 |
| CMKLR1 |
| CNR1 |
| CNR2 |
| CRHR1 |
| CX3CR1 |
| CXCR4 |
| CXCR6 |
| CYSLT1 |
| CYSLT2 |
| DJ287G14 |
| DRD5 |
| EBI2 |
| EDG1 |
| EDG2 |
| EDG3 |
| EDG4 |
| EDG5 |
| EDG6 |
| EDG7 |
| EDG8 |
| EDNRA |
| EDNRB |
| EMR1 |
| ETL |
| F2R |

TABLE 23-continued

GPCRs Expressed in the Ovary

| |
|---|
| F2RL1 |
| F2RL2 |
| F2RL3 |
| FKSG79 |
| FLJ14454 |
| FPR1 |
| FPR-RS2 |
| FSHR |
| FY |
| FZD1 |
| FZD10 |
| FZD2 |
| FZD3 |
| FZD4 |
| FZD5 |
| FZD6 |
| FZD7 |
| G2A |
| GABBR1 |
| GALR1 |
| GALR2 |
| GALR3 |
| GCGR |
| GLP1R |
| GPCR150 |
| GPR1 |
| GPR10 |
| GPR102 |
| GPR103 |
| GPR105 |
| GPR12 |
| GPR14 |
| GPR17 |
| GPR18 |
| GPR19 |
| GPR2 |
| GPR20 |
| GPR21 |
| GPR22 |
| GPR23 |
| GPR24 |
| GPR27 |
| GPR30 |
| GPR31 |
| GPR33 |
| GPR34 |
| GPR35 |
| GPR37L1 |
| GPR39 |
| GPR4 |
| GPR43 |
| GPR44 |
| GPR45 |
| GPR48 |
| GPR49 |
| GPR50 |
| GPR51 |
| GPR54 |
| GPR55 |
| GPR62 |
| GPR63 |
| GPR64 |
| GPR65 |
| GPR66 |
| GPR7 |
| GPR73 |
| GPR73L1 |
| GPR74 |
| GPR75 |
| GPR81 |
| GPR82 |
| GPR84 |
| GPR85 |
| GPR86 |
| GPR87 |
| GPR88 |
| GPR9 |
| GPR91 |

TABLE 23-continued

GPCRs Expressed in the Ovary

| |
|---|
| GPR92 |
| GPRC5B |
| GPRC5C |
| GPRC6A |
| GRCA |
| GRM4 |
| GRM6 |
| GRM7 |
| GRM8 |
| H963 |
| HCRTR2 |
| HGPCR11 |
| HGPCR19 |
| HGPCR2 |
| HM74 |
| HRH1 |
| HRH2 |
| HTR1B |
| HTR1D |
| HTR2A |
| HTR2B |
| HTR5A |
| HTR6 |
| HTR7 |
| HUMNPIIY20 |
| IL8RA |
| IL8RB |
| KIAA0758 |
| KIAA1828 |
| LEC1 |
| LEC2 |
| LEC3 |
| LGR6 |
| LGR7 |
| LHCGR |
| LTB4R |
| LTB4R2 |
| MAS1 |
| MC2R |
| MC5R |
| MRG |
| MrgA1 |
| MRGE |
| MRGF |
| MrgG |
| NMU2R |
| NTSR1 |
| OA1 |
| OPN3 |
| OPN4 |
| OPRD1 |
| OPRL1 |
| OXTR |
| P2RY1 |
| P2RY12 |
| P2RY2 |
| P2Y10 |
| P2Y5 |
| PGR1 |
| PGR10 |
| PGR13 |
| PGR14 |
| PGR15 |
| PGR16 |
| PGR18 |
| PGR2 |
| PGR20 |
| PGR21 |
| PGR22 |
| PGR23 |
| PGR25 |
| PGR26 |
| PGR27 |
| PGR28 |
| PGR4 |
| PGR5 |
| PGR7 |
| PGR8 |

TABLE 23-continued

GPCRs Expressed in the Ovary

PTAFR
PTGDR
PTGER1
PTGER2
PTGER3
PTGER4
PTGFR
PTHR1
RAI3
RDC1
RE2
RHO
RRH
SALPR
SCTR
SMOH
SREB3
SSTR1
SSTR2
SSTR3
SSTR4
SSTR5
TAR3
TBXA2R
TEM5
TM7SF1
TM7SF1L1
TM7SF1L2
TM7SF3
TPRA40
TRHR2
TSHR
VIPR2
VLGR1

Exemplary ovarian diseases and disorders include autoimmune oophoritis, brenner tumors, choriocarcinoma, clear cell adenocarcinoma, clear cell carcinoma, corpus luteal cysts, decidual reaction, dysgerminoma, embryonal carcinoma, endometrioid tumors, endometriosis, endometriotic cysts, epithelial inclusion cysts, fibrothecoma, follicular cysts, gonadoblastoma, granulosa-stroma cell tumors, granulosa-theca cell tumor, gynandroblastoma, hilum cell hyperplasia, luteal cysts, luteal hematomas, luteoma of pregnancy, massive ovarian edema, metastatic neoplasm, mixed germ cell tumors, monodermal tumors, mucinous tumors, neoplastic cysts, ovarian changes secondary to cytotoxic drugs and radiation, ovarian fibroma, polycystic ovary syndrome, pregnancy luteoma, premature follicle depletion, pseudomyxoma peritonei, resistant ovary, serous tumors, Sertoli-Leydig cell tumor, sex-cord tumor with annular tubules, steroid (lipid) cell tumor, stromal hyperplasia, stromal hyperthecosis, teratoma, theca lutein cysts, thecomas, transitional cell carcinoma, undifferentiated carcinoma, and yolk sac carcinoma (endodermal sinus tumor).

Peripheral Blood Lymphocytes. GPCRs expressed in the lymphocytes are listed in Table 24. These receptors are thus potential targets for therapeutic compounds that may modulate their activity, expression, or stability in lymphocytes. These polypeptides, or polymorphs of these polypeptides, may form the basis of a therapeutic regimen, or a diagnostic test to determine, e.g., the presence of a disease or disorder, the risk of developing a particular disease or disorder, or an appropriate therapeutic course.

TABLE 24

GPCRs Expressed in Peripheral Blood Lymphocytes

ADMR
ADORA2A
ADORA2B
ADORA3
ADRB1
ADRB2
AGR9
AGTRL1
AVPR2
BAI2
BLR1
C3AR1
C5R1
CCBP2
CCR1
CCR2
CCR3
CCR4
CCR5
CCR6
CCR7
CCR8
CCR9
CCXCR1
CD97
CELSR1
CELSR2
CELSR3
CHRM3
CHRM4
CMKBR1L2
CMKLR1
CNR2
CX3CR1
CXCR4
CXCR6
CYSLT1
CYSLT2
DJ287G14
EBI2
EDG1
EDG2
EDG3
EDG4
EDG5
EDG6
EDG7
EDG8
EDNRA
EDNRB
EMR1
ETL
F2R
F2RL1
F2RL2
F2RL3
FKSG79
FLJ14454
FPR1
FPR-RS2
FZD1
FZD10
FZD4
FZD5
FZD6
FZD7
G2A
GABBR1
GALR2
GALR3
GLP1R
GPCR150
GPR105
GPR18
GPR19
GPR2
GPR22
GPR27

TABLE 24-continued

GPCRs Expressed in Peripheral Blood Lymphocytes

GPR31
GPR35
GPR4
GPR40
GPR43
GPR44
GPR48
GPR55
GPR65
GPR66
GPR68
GPR73
GPR82
GPR83
GPR84
GPR85
GPR86
GPR9
GPR92
GPRC5B
GPRC5C
GRCA
GRM4
GRM6
GRPR
H963
HGPCR19
HM74
HRH2
HTR2B
HTR7
IL8RA
IL8RB
KIAA0758
LEC1
LEC2
LTB4R
MC5R
MRG
MRGE
OPN3
P2RY1
P2RY12
P2RY2
P2RY6
P2Y10
P2Y5
PGR13
PGR16
PGR22
PGR23
PGR26
PGR27
PGR4
PGR7
PGR8
PTAFR
PTGER1
PTGER2
PTGER3
PTGER4
PTGIR
RAI3
RDC1
SMOH
SSTR2
SSTR4
TBXA2R
TEM5
TM7SF1
TM7SF1L1
TM7SF3
TPRA40

Exemplary blood diseases and disorders include abnormal hemoglobins, abnormalities in granulocyte count, abnormalities in lymphocyte count, abnormalities in monocyte count, abnormalities of blood platelets, abnormalities of platelet function, acanthocytosis, acquired neutropenia, acute granulocytic leukemia, acute idiopathic thrombocytopenic purpura, acute infections, acute lymphoblastic leukemia, acute lymphocytic leukemia, acute myeloblastic leukemia, acute myelocytic leukemia, acute myeloid leukemia, acute pyogenic bacterial infections, acute red cell aplasia, acute response to endotoxin, adult T-cell leukemial/lymphoma, afibrinogenemia, alpha thalassemia, altered affinity of hemoglobin for oxygen, amyloidosis, anemia, anemia due to acute blood loss, anemia due to chronic blood loss, anemia of chronic disease, anemia of chronic renal failure, anemias associated with enzyme deficiencies, anemias associated with erythrocyte cytoskeletal defects, anemias caused by inherited disorders of hemoglobin synthesis, angiogenic myeloid metaplasia, aplastic anemia, ataxia-telangiectasia, Auer rods, autoimmune hemolytic anemias, B-cell chronic lymphocytic leukemia, B-cell chronic lymphoproliferative disorders, Bernard-Soulier disease, beta thalassemia, Blackfan-Diamond disease, brucellosis, Burkitt's lymphoma, Chediak-Higashi syndrome, cholera, chronic acquired pure red cell aplasia, chronic granulocytic leukemia, chronic granulomatous disease, chronic idiopathic myelofibrosis, chronic idiopathic thrombocytopenic purpura, chronic lymphocytic leukemia, chronic lymphoproliferative disorders, chronic myelocytic leukemia, chronic myelogenous leukemia, chronic myeloid leukemia, chronic myeloproliferative disorders, congenital dyserythropoietic anemias, congenital dysfibrinogenemia, congenital neutropenia, corticosteriods, cyclic neutropenia, cytoplasmic maturation defect, deficiency of coagulation factors, delta-beta thalassemia, diphtheria, disorders of blood coagulation, disseminated intravascular coagulation & fibrinolysis, Dohle bodies, drug & chemical-induced hemolysis, drug-induced thrombocytopenia, drugs that suppress granulopoiesis, E. coli, early preleukemic myeloid leukemia, eosinophilia, eosinophilic granuloma, erythrocute enzyme deficiency, erythrocyte membrane defects, essential thrombocythemia, factor 7 deficiency, familial cyclic neutropenia, Felty's syndrome, fibrinolytic activity, folate antagonists, folic acid deficiency, Gaucher disease, Glanzmann's thrombasthenia, glucose-6-phosphate dehydrogenase deficiency, granulated T-cell lymphocyte leukemia, granulocytic sarcoma, granulocytosis, Hageman trait, hairy cell leukemia (leukemic reticuloendotheliosis), Hand-Schuller-Christian disease, heavy-chain disease, hemoglobin C disease, hemoglobin constant spring, hemoglobin S, hemoglobinopathies, hemolysis caused by infectious agents, hemolytic anemia, hemolytic anemia secondary to mechanical erythrocyte destruction, hemolytic blood transfusion reactions, hemolytic disease of the newborn, hemophagocytic disorders, hemophilia A, hemophilia B (Christmas disease, factor 9 deficiency, hepatitis, hereditary elliptocytosis, hereditary spherocytosis, heterozygous beta thalassemia (Cooley's trait), homozygous beta thalassemia (Cooley's anemia), hypereosinophilic syndrome, hypoxia, idiopathic cold hemagglutinin disease, idiopathic thrombocytopenic purpura, idiopathic warm autoimmune hemolytic anemia, immune drug induced hemolysis, immune-mediated hemolytic anemias, immunodeficiency disease, infantile neutropenia (Knock outstmann), instability of the hemoglobin molecule, iron deficiency anemia, isoimmune hemolytic anemia, juvenile chronic myeloid leukemia, Langerhans cell histiocytosis, large granular lymphocyte leukemia, lazy leuknock outcyte syndrome, Letterer-Siwe disease, leukemias, leukemoid reaction, leuknock outerythroblastic anemia, lipid storage diseases, lymphoblastosis, lymphocytopenia, lymphocytosis, lymphoma, lymphopenia, macroangiopathic hemolytic anemia, malaria, marrow aplasia, May-Hegglin anomaly, measles, megaloblastic anemia, metabolic diseases, microangiopathic hemolytic anemia, microcytic anemia, miliary tuberculosis, mixed phenotupe acute leukemia, monoclonal gammopathy of undetermined significance, monocytic leukemia, monocytosis, mucopolysaccharidosis, multiple myeloma, myeloblastic luekemia, myelodysplastic syndromes, myelofibrosis (agnogenic myeloid metaplasia), myeloproliferative diseases, myelosclerosis, neonatal thrombocytopenic purpura, neoplasms of hematopoietic cells, neutropenia, neutrophil dysfunction syndromes, neutrophil leuknock outcytosis, neutrophilia, Niemann-Pick disease, nonimmune drug-induced hemolysis, normocytic anemia, nuclear maturation defects, parahemophilia, paroxysmal cold hemoglominuria, paroxysmal nocturnal hemoglobinuria, Pelger-Huet anomaly, pernicious (Addisonian) anemia, plasma cell leukemia, plasma cell neoplasia, polycythemia, polycythemia rubra vera, presence of circulating anticoagulants, primary (idiopathic) thrombocythemia, primary neoplasms, prolymphocytic leukemia, *Proteus, Pseudomonas*, pure red cell aplasia, pyogenic bacterial infection, pyruvate kinase deficiency, radiation, red cell aplasia, refractory anemias, ricketsial infections, Rosenthal's syndrome, secondary absolute polycythemia, septicemia, severe combined immunodeficiency disease, Sezary syndrome, sickle cell disease, sickle cell-beta thalassemia, sideroblastic anemia, solitary plasmacytoma, storage pool disease, stress, structural hemoglobin variants, systemic lupus erythematosus, systemic mastocytosis, tart cell, T-cell chronic lymphoproliferative disorders, T-cell prolymphocytic leukemia, thalassemias, thrombocytopenia, thrombotic thrombocytopenic purpura, toxic granulation, toxic granules in severe infection, typhus, vitamin B12 deficiency, vitamin K deficiency, Von Willebrand's disease, Waldenstrom macroglobulinemia, and Wisknock outtt-aldrich syndrome.

Prostate. GPCRs expressed in the prostate are listed in Table 25. These receptors are thus potential targets for therapeutic compounds that may modulate their activity, expression, or stability in the prostate. These polypeptides, or polymorphs of these polypeptides, may form the basis of a therapeutic regimen, or a diagnostic test to determine, e.g., the presence of a disease or disorder involving the prostate, the risk of developing a particular disease or disorder, or an appropriate therapeutic course.

TABLE 25

| GPCRs Expressed in the Prostate |
| --- |
| ADCYAP1R1 |
| ADMR |
| ADORA1 |
| ADORA2A |
| ADRA1A |
| ADRA1D |
| ADRA2A |
| ADRA2B |
| ADRB1 |
| ADRB2 |
| AGR9 |
| AGTR1 |
| AGTR2 |
| AGTRL1 |
| AVPR1B |
| AVPR2 |
| BDKRB1 |
| BDKRB2 |
| C3AR1 |
| C5R1 |
| CALCRL |
| CCKAR |

TABLE 25-continued

| GPCRs Expressed in the Prostate |
| --- |
| CCR1 |
| CCR2 |
| CCR3 |
| CCR4 |
| CCR5 |
| CCR6 |
| CCR7 |
| CCR8 |
| CCR9 |
| CCRL1 |
| CCXCR1 |
| CD97 |
| CELSR1 |
| CELSR2 |
| CELSR3 |
| CHRM1 |
| CHRM2 |
| CHRM3 |
| CHRM4 |
| CMKBR1L2 |
| CMKLR1 |
| CNR1 |
| CNR2 |
| CRHR2 |
| CX3CR1 |
| CXCR4 |
| CXCR6 |
| CYSLT1 |
| CYSLT2 |
| DJ287G14 |
| EBI2 |
| EDG1 |
| EDG2 |
| EDG3 |
| EDG5 |
| EDG6 |
| EDG7 |
| EDG8 |
| EDNRA |
| EDNRB |
| EMR1 |
| ETL |
| F2R |
| F2RL1 |
| F2RL2 |
| F2RL3 |
| FKSG79 |
| FLJ14454 |
| FPR1 |
| FPR-RS2 |
| FY |
| FZD1 |
| FZD10 |
| FZD2 |
| FZD3 |
| FZD4 |
| FZD5 |
| FZD6 |
| FZD7 |
| G2A |
| GABBR1 |
| GHSR |
| GLP1R |
| GPCR150 |
| GPR1 |
| GPR10 |
| GPR102 |
| GPR105 |
| GPR12 |
| GPR14 |
| GPR18 |
| GPR2 |
| GPR21 |
| GPR22 |
| GPR23 |
| GPR24 |
| GPR27 |
| GPR30 |

TABLE 25-continued
GPCRs Expressed in the Prostate

GPR31
GPR34
GPR35
GPR37L1
GPR39
GPR4
GPR41
GPR43
GPR48
GPR49
GPR54
GPR58
GPR62
GPR63
GPR65
GPR73
GPR73L1
GPR80
GPR81
GPR82
GPR84
GPR86
GPR9
GPR92
GPRC5B
GPRC5C
GPRC6A
GRCA
GRM6
H963
HCRTR1
HM74
HRH2
HRH3
HTR1F
HTR2A
HTR2B
HTR4
HTR5A
HTR7
HUMNPIIY20
KIAA0758
KIAA1828
LEC1
LEC2
LEC3
LTB4R2
MC2R
MC3R
MC4R
MRG
MRGE
MRGF
MTNR1A
MTNR1B
NMU2R
NPY6R
OPN1SW
OPN3
OPRL1
OPRM1
P2RY2
P2RY6
P2Y10
P2Y5
PGR10
PGR11
PGR12
PGR13
PGR15
PGR18
PGR19
PGR20
PGR21
PGR22
PGR25
PGR26
PGR27
PGR4
PGR5
PTAFR
PTGDR
PTGER1
PTGER3
PTGER4
PTGFR
RAI3
RDC1
RE2
SMOH
SSTR3
SSTR4
TAR2
TAR4
TEM5
TM7SF1
TM7SF1L1
TM7SF3
TPRA40
TRHR2
TSHR
VIPR1
VIPR2

Exemplary diseases and disorders involving the prostate include acute bacterial prostatitis, acute prostatitis, adenoid basal cell tumor (adenoid cystic-like tumor), allergic (eosinophilic) granulomatous prostatitis, atrophy, atypical adenomatous hyperplasia, atypical basal cell hyperplasia, basal cell adenoma, basal cell hyperplasia, BCG-induced granulomatous prostatitis, benign prostatic hyperplasia, benign prostatic hypertrophy, blue nevus, carcinosarcoma, chronic abacterial prostatitis, chronic bacterial prostatitis, cribriform hyperplasia, ductal (endometrioid) adenocarcinoma, granulomatous prostatitis, hematuria, iatrogenic granulomatous prostatitis, idiopathic (nonspecific) granulous prostatitis, impotence, infectious granulomatous prostatitis, inflammatory pseudotumor, leiomyosarcoma, leukemia, lymphoepithelioma-like carcinoma, malaknock outplakia, malignant lymphoma, mucinous (colloid) carcinoma, nodular hyperplasia (benign prostatic hyperplasia), nonbacterial prostatitis, obstruction of urinary outflow, phyllodes tumor, postatrophic hyperplasia, postirradiation granulomatous prostatitis, postoperative spindle cell nodules, postsurgical granulomatous prostatitis, prostatic adenocarcinoma, prostatic carcinoma, prostatic intraepithelial neoplasia, prostatic melanosis, prostatic neoplasm, prostatitis, rhabdomyosarcoma, sarcomatoid carcinoma of the prostate, sclerosing adenosis, signet ring cell carcinoma, small-cell, undifferentiated carcinoma (high-grade neuroendocrine carcinoma), squamous cell carcinoma of the prostate, stromal hyperplasia with atypia, transitional cell carcinoma of the prostate, xanthogranulomatous prostatitis, and xanthoma.

Skin. GPCRs expressed in the skin are listed in Table 26. These receptors are thus potential targets for therapeutic compounds that may modulate their activity, expression, or stability in the skin. These polypeptides, or polymorphs of these polypeptides, may form the basis of a therapeutic regimen, or a diagnostic test to determine, e.g., the presence of skin disease or disorder, the risk of developing a particular disease or disorder, or an appropriate therapeutic course.

TABLE 26

GPCRs Expressed in the Skin

ADCYAP1R1
ADMR
ADORA1
ADORA2A
ADORA2B
ADORA3
ADRA1A
ADRA1D
ADRA2A
ADRA2B
ADRB1
ADRB2
ADRB3
AGR9
AGTR1
AGTR2
AGTRL1
AVPR2
BAI2
BAI3
BDKRB1
BLR1
C3AR1
C5R1
CALCRL
CASR
CCBP2
CCKBR
CCR1
CCR2
CCR4
CCR5
CCR6
CCR7
CCR8
CCR9
CCRL1
CCXCR1
CD97
CELSR1
CELSR2
CELSR3
CHRM1
CHRM3
CHRM4
CHRM5
CMKLR1
CNR1
CNR2
CRHR1
CRHR2
CX3CR1
CXCR4
CXCR6
CYSLT1
DJ287G14
EBI2
EDG1
EDG2
EDG3
EDG4
EDG5
EDG6
EDG7
EDG8
EDNRA
EDNRB
EMR1
ETL
F2R
F2RL1
F2RL2
FKSG79
FLJ14454
FPR1
FSHR
FY
FZD1

TABLE 26-continued

GPCRs Expressed in the Skin

FZD10
FZD2
FZD3
FZD4
FZD5
FZD6
FZD7
FZD9
G2A
GABBR1
GALR2
GALR3
GLP1R
GPCR150
GPR1
GPR105
GPR14
GPR18
GPR19
GPR2
GPR21
GPR22
GPR23
GPR27
GPR30
GPR31
GPR33
GPR34
GPR35
GPR4
GPR40
GPR41
GPR43
GPR44
GPR48
GPR49
GPR50
GPR54
GPR64
GPR65
GPR68
GPR7
GPR73
GPR73L1
GPR77
GPR81
GPR82
GPR83
GPR84
GPR85
GPR86
GPR87
GPR9
GPR91
GPR92
GPRC5B
GPRC5C
GPRC5D
GRCA
GRM4
GRM8
H963
HCRTR2
HM74
HRH1
HRH2
HRH4
HTR1D
HTR2B
HUMNPIIY20
IL8RA
KIAA0758
LEC1
LEC2
LEC3
LGR6
LTB4R
LTB4R2

TABLE 26-continued

GPCRs Expressed in the Skin

MAS1
MC1R
MC2R
MC5R
MRG
MRGE
MRGF
MrgG
MTNR1B
NPY1R
NTSR2
OA1
OPN3
OPN4
OPRD1
OXTR
P2RY1
P2RY12
P2RY2
P2RY4
P2RY6
P2Y10
P2Y5
PGR1
PGR13
PGR15
PGR16
PGR18
PGR19
PGR20
PGR21
PGR22
PGR25
PGR26
PGR27
PGR4
PTAFR
PTGDR
PTGER1
PTGER2
PTGER3
PTGER4
PTGFR
PTHR1
RDC1
RE2
RRH
SCTR
SMOH
SREB3
SSTR2
SSTR4
TACR1
TBXA2R
TEM5
TM7SF1
TM7SF1L1
TM7SF1L2
TM7SF3
TPRA40
TRHR2
TSHR
VIPR1
VLGR1

Exemplary skin diseases and disorders include acanthosis nigricans, acne vulgaris, acquired epidermolysis bullosa, acrochordons, acrodermatitis enteropathica, acropustulosis, actinic keratosis, acute cutaneous lupus erythematosus, age spots, allergic dermatitis, alopecia areata, angloedema, angiokeratoma, angioma, anthrax, apocrine tumors, arthropid-bite reactions, atopic dermatitis, atypical fibroxanthoma, Bart's syndrome, basal cell carcinoma (basal cell epithelioma), Bateman's purpura, benign familial pemphigus (Hailey-Hailey disease), benign keratoses, Berloque dermatitis, blue nevus, borderline leprosy, *Borrelia* infection (lyme disease), Bowen's disease (carcinoma in situ), bullous pemphigoid, Cafe-au-lait spot, calcification, cellular blue nevus, cellulitis, Chagas' disease, chickenpox (varicella), chloasma, chondrodermatitis nodularis helicis, chondroid syringoma, chronic actinic dermatitis, chronic cutaneous lupus erythematosus, chronic discoid lesions, cicatricial pemphigoid, collagen abnormalities, compount melanocytic nevus, congenital melanocytic nevus, connective tissue nevus, contact dermatitis, cutaneous leishmaniasis, cutis laxa, cysts of the skin, dandruff, Darier's disease (keratosis follicularis), deep fungal infections, delayed-hypersensitivity reaction, dermal Spitz's nevus, dermatitis, dermatitis herpetiformis, dermatofibroma (cutaneous fibrous histiocytoma), dermatofibrosarcoma protuberans, dermatomyositis, dermatophyte infections, dermatophytid reactions, dermoid cyst, dermotropic ricketsial infections, dermotropic viral infections, desmoplastic melanoma, discoid lupus erythematosus, dominant dystrophic epidermolysis bullosa, Dowling-Meara epidermolysis bullosa, dyshidrotic dermatitis, dysplastic nevi, eccrine tumors, ecthyma, eczema, elastic tissue abnormalities, elastosis perforans serpiginosa, eosinophilic fasciitis, eosinophilic folliculitis, ephelides (freckles), epidermal cysts, epidermolysis bullosa, epidermolysis bullosa simplex, epidermotropic T-cell lymphoma, epidermotropic viruses, erysipelas, erythema multiforme, erythema nodosum, erythema nodosum leprosum, fibrotic disorders, fibrous tumors, follicular mucinosis, Fordyce's condition, fungal infections, genodermatoses, graft-versus-host disease, granuloma annulare, granulomatous vasculitis, Grover's disease, hair follicle infections, hair follicle tumors, hair loss, halo nevus, herpes simplex, herpes zoster (shingles), hidradenitis suppurativa, histiocytic lesions, HIV infections, hives, human papilloma virus, hyperhydrosis, ichthyosis, idiopathic skin diseases, impetigo, incontinentia pigmenti, intraepidermal spongiotic vesicles and bullae, invasive malignant melanoma, invasive squamous cell carcinoma, junctional epidermolysis bullosa, junctional melanocytic nevus, juvenile xanthogranuloma, Kaposi's sarcoma, keloids, keratinocytic lesions, keratinocytic tumors, keratoacanthoma, keratoderma blennorrhagicum, keratosis pilaris, leiomyoma, lentigo, lentigo maligna (Hutchinson's freckle), lepromatous leprosy, leprosy (Hansen's disease), leuknock outcytoclastic vasculitis, lichen planus, lichen sclerosus et atrophicus, lichen simplex chronicus, lichen striatus, lichenoid disorders, lichenoid drug reactions, light eruptions, linear bullous IgA dermatitis, lipoma, Lucio's phenomenon, lupus erythematosus, lymphatic filariasis, lymphocytic vasculitis, lymphocytoma cutis, lymphoid lesions, lymphomatoid papulosis, malignant blue nevus, malignant lymphomas, malignant melanoma, malignant melanoma in situ (noninvasive malignant melanoma), mast cell neoplasms, mastocytosis, measles, melanocyte disorders, melanocytic lesions, melanocytic neoplasms, melanocytic nevus, melanocytic nevus with dysplasia, melanotic macule, reactive type, melasma, merkel cell (neuroendocrine) carcinoma, metastatic melanoma, miliara, mixed connective tissue disease, molluscum contagiosum, morphea, mucin deposition, mucocutaneous leishmaniasis, mycetoma, mycobacterial infection, *Mycobacterium* marinum, *Mycobacterium* ulcerans, mycosis fungoides (cutaneous T cell lymphoma), myxoid cyst, necrobiosis lipoidica, necrobiosis lipoidica diabeticorum, necrolytic migratory erythema, necrotizing fasciitis, neoplasms of dermal mesenchymal cells, neoplasms of keratinocytes, neoplasms of skin appendages, neoplasms of the epidermis, neural tumors, neuroendocrine carcinoma of the skin, neurothekeoma, nevocellular nevus (melanocytic nevus), nummular dermatitis, obliterative vasculitis, onchocerciasis, Paget's disease, pale cell acanthoma of Degos, palisaded encapsulated neuroma, papillomavirus infections, paraneoplastic pemphigus, parasitic infections, pemphigoid gestationis, pemphigus, pemphigus foliaceus, pemphigus vulgaris, perivascular infiltrates, pilar cysts, pinta, pityriasis alba, pityriasis lichenoides chronica (of Juliusberg), pityriasis lichenoides et varioliformis acuta, pityriasis rosea, pityriasis rubra pilaris, plantar warts, porokeratosis, pressure necrosis, progressive systemic sclerosis, protozoal infections, pruritic urticarial papules and plasques of pregnancy, pruritis ani, pseudofolliculitis barbae, pseudoxanthoma elasticum, psoriasis vulgaris, pyogenic granuloma, radial growild typeh phase melanoma, recessive dystrophic epidermolysis bullosa, Reiter's syndrome, ringworm, Rochalimaea henselae infection, rosacea, rubella, sarcoidosis, scabies, Schamberg's disease, scleroderma, sebaceous hyperplasia, sebaceous tumors, seborrheic dermatitis, seborrheic keratosis, Sezary syndrome, skin manifestations of systemic diseases, small plaque parapsoriasis, smallpox (variola), solitary mastocytoma, spirochetal infections, Spitz's nevus, Spitz's nevus junctional type, squamous cell carcinoma, stasis dermatitis, Stevens-Johnson syndrome, subacute cutaneous lupus erythematosus, subcorneal pustular dermatosis, superficial fungal infections, superficial spreading melanoma in situ, syphilis, syringoma, systemic lupus erythematosus, systemic mastocytosis, tinea (dermatophytosis, tinea versicolor, toxic epidermal necrolysis, transient acantholytic dermatosis, tuberculoid leprosy, tuberculosis, urticaria, urticaria pigmentosa, urticarial vasculitis, vascular tumors, verruca vulgaris (common wart), vertical growild typeh phase melanoma, visceral leishmaniasis, vitiligo, warty dyskeratoma, Weber-Cockayne epidermolysis bullosa, Woringer-Knock outlopp disease, xanthomas, xeroderma pigmentosum, xerosis, and yaws.

Spleen. GPCRs expressed in the spleen are listed in Table 27. These receptors are thus potential targets for therapeutic compounds that may modulate their activity, expression, or stability in the spleen. These polypeptides, or polymorphs of these polypeptides, may form the basis of a therapeutic regimen, or a diagnostic test to determine, e.g., the presence of a disease or disorder of the spleen, the risk of developing a particular disease or disorder, or an appropriate therapeutic course.

TABLE 27

GPCRs Expressed in the Spleen

ADMR
ADORA2A
ADRB1
ADRB2
AGTR1
BAI2
BLR1
C5R1
CALCRL
CCBP2
CCKAR
CCR1
CCR2
CCR3
CCR5
CCR6
CCR7
CCR8
CCR9
CCRL1
CD97
CELSR1
CMKBR1L2
CMKLR1

TABLE 27-continued

GPCRs Expressed in the Spleen

CNR1
CNR2
CX3CR1
CXCR4
CXCR6
DJ287G14
EBI2
EDG1
EDG2
EDG3
EDG5
EDG6
EDG7
EDG8
EMR1
ETL
F2R
F2RL2
F2RL3
FKSG79
FPR1
FPR-RS2
FY
G2A
GABBR1
GLP1R
GPR10
GPR105
GPR15
GPR18
GPR19
GPR21
GPR31
GPR34
GPR35
GPR4
GPR43
GPR65
GPR82
GPR83
GPR84
GPR85
GPR86
GPR9
GPR91
GPR92
GPRC5B
GRCA
GRPR
H963
HM74
HRH1
HRH2
HTR2B
HTR7
IL8RA
KIAA0758
LTB4R
MRG
MRGE
OPN3
P2RY1
P2RY12
P2RY2
P2RY6
P2Y10
P2Y5
PGR13
PGR16
PGR18
PGR22
PGR26
PGR27
PGR7
PTAFR
PTGER3
PTGER4
PTGIR

TABLE 27-continued

GPCRs Expressed in the Spleen

RDC1
SMOH
SSTR2
SSTR4
TBXA2R
TM7SF1
TM7SF1L1
TM7SF3
TPRA40

Exemplary diseases and disorders of the spleen include abnormal immunoblastic proliferations of unknown origin, acute infections, acute parasitemias, agnogenic myeloid metaplasia, amyloidosis, angioimmunoblastic lymphadenopathy, antibody-coated cells, asplenia, autoimmune diseases, autoimmune hemolytic anemias, B-cell chronic lymphocytic leukemia and prolymphocytic leukemia, babesiosis, bone marrow involvement by carcinoma, brucellosis, carcinoma, ceroid histiocytosis, chronic alcoholism, chronic granulomatous disease, chronic hemolytic anemias, chronic hemolytic disorders, chronic immunologic inflammatory disorders, chronic infections, chronic lymphocytic leukemia, chronic myelogenous leukemia, chronic parasitemias, chronic uremia, cirrhosis, cold agglutinin disease, congestive splenomegaly, cryoglobulinemia, disseminated tuberculosis, dysproteinemias, endocrine disorders, erythroblastic leukemia, erythropoiesis, essential thrombocythemia, extramedullary hematopoiesis, Felty syndrome, fibrocongestive splenomegaly, fungal infections, gamm heavy-chain disease, Gaucher's disease, graft rejection, granulomatous infiltration, hairy cell leukemia, hamartomas, Hand-Schuller-Christian disease, hemangiomas, hemangiosarcomas, hematologic disorders, hemoglobinopathies, hemolytic anemias, hereditary elliptocytosis, hereditary spherocytosis, histiocytic medullary reticulosis, histiocytosis X, Hodgkin's disease, hypersensitivity reactions, hypersplenism, hyposplenism, idiopathic thrombocytopenic purpura, IgA deficiency, immune granulomas, immune thrombocytopenia, immune thrombocytopenic purpura, immunodeficiency disorders, infection associated hemophagocytic syndrome, infectious granulomas, infectious mononucleosis, infective endocarditis, infiltrative splenomegaly, inflammatory pseudotumors, leishmaniasis, Leterer-Siwe disease, leukemia, lipogranulomas, lymphocytic leukemias, lymphoma, malabsorption syndromes, malaria, malignant lymphoma, megakaryoblastic leukemia, metastatic tumor, monocytic leukemias, mucopolysaccharidoses, multicentric Castleman's disease, multiple myeloma, myelocytic leukemias, myelofibrosis, myeloproliferative syndromes, neoplasms, Niemann-Pick disease, non-Hodgkin's lymphoma, parasitic disorders, parasitized red blood cells, peliosis, polycythemia rubra vera, portal vein congestion, portal vein stenosis, portal vein thrombosis, portal venous hypertension, rheumatoid arthritis, right-sided cardiac failure, sarcoidosis, sarcoma, secondary amyloidosis, secondary myeloid metaplasia, serum sickness, sickle-cell disease, splenic cysts, splenic infarction, splenic vein hypertension, splenic vein stenosis, splenic vein thrombosis, splenomegaly, storage diseases, systemic lupus erythematosus, systemic vasculitides, T-cell chronic lymphocytic leukemia, thalasemia, thrombocytopenic purpura, thyrotoxicosis, trapping of immature hematologic cells, tuberculosis, tumorlike conditions, typhoid fever, vascular tumors, vasculitis, and viral infections.

Stomach. GPCRs expressed in the stomach are listed in Table 28. These receptors are thus potential targets for therapeutic compounds that may modulate the activity, expression, or stability in the stomach. These polypeptides, or polymorphs of these polypeptides, may form the basis of a therapeutic regimen, or a diagnostic test to determine, e.g., the presence of a disease or disorder of the stomach, the risk of developing a particular disease or disorder, or an appropriate therapeutic course.

TABLE 28

GPCRs Expressed in the Stomach

ADORA1
ADORA2A
ADRA1B
ADRA2A
ADRA2B
ADRB1
ADRB2
AGTR2
AGTRL1
AVPR1A
BDKRB1
BDKRB2
BLR1
C3AR1
C5R1
CALCRL
CASR
CCBP2
CCKAR
CCKBR
CCR1
CCR2
CCR5
CCR6
CCR8
CCR9
CCRL1
CCXCR1
CD97
CELSR1
CELSR2
CELSR3
CHRM2
CHRM3
CHRM4
CMKBR1L2
CMKLR1
CNR2
CX3CR1
CXCR4
CXCR6
CYSLT1
CYSLT2
DJ287G14
DRD3
EBI2
EDG1
EDG2
EDG3
EDG4
EDG5
EDG6
EDG7
EDG8
EDNRA
EDNRB
EMR1
ETL
F2R
F2RL1
F2RL2
FLJ14454
FPR1
FPR-RS2
FY

TABLE 28-continued

GPCRs Expressed in the Stomach

FZD1
FZD10
FZD2
FZD3
FZD4
FZD5
FZD6
FZD7
FZD8
G2A
GABBR1
GALR1
GALR3
GLP1R
GLP2R
GPCR150
GPR105
GPR12
GPR14
GPR18
GPR19
GPR20
GPR21
GPR22
GPR23
GPR24
GPR27
GPR30
GPR35
GPR37
GPR37L1
GPR39
GPR4
GPR43
GPR45
GPR48
GPR49
GPR54
GPR55
GPR63
GPR64
GPR66
GPR68
GPR75
GPR81
GPR82
GPR84
GPR85
GPR86
GPR87
GPR91
GPR92
GPRC5B
GPRC5C
GRCA
GRM4
H963
HCRTR1
HGPCR11
HGPCR19
HM74
HRH1
HRH2
HRH4
HTR1B
HTR1D
HTR1F
HTR2A
HTR2B
IL8RA
IL8RB
KIAA0758
LEC1
LEC2
LEC3
LGR6
LTB4R
LTB4R2
MC2R
MC5R
MRG
MRGE
MRGF
MrgG
NTSR1
OPN3
OPRM1
P2RY1
P2RY12
P2RY2
P2RY4
P2RY6
P2Y10
P2Y5
PGR13
PGR15
PGR17
PGR18
PGR20
PGR21
PGR22
PGR23
PGR25
PGR26
PGR27
PGR4
PGR5
PGR7
PGR8
PTAFR
PTGDR
PTGER1
PTGER2
PTGER3
PTGER4
PTGFR
PTGIR
PTHR2
RAI3
RDC1
RE2
SALPR
SCTR
SMOH
SSTR1
SSTR2
SSTR3
SSTR4
TACR1
TACR2
TAR1
TBXA2R
TEM5
TM7SF1
TM7SF1L1
TM7SF3
TPRA40
TRHR2
TSHR
VIPR1
VIPR2
VLGR1

Exemplary diseases and disorders of the stomach include acute erosive gastropathy, acute gastric ulcers, adenocarcinomas, adenomas, adenomatous polyps, advanced gastric cancer, ampullary carcinoma, atrophic gastritis, bacterial gastritis, carcinoid turmors, carcinoma of the stomach, chemical gastritis, chronic (nonerosive) gastritis, chronic idiopathic gastritis, chronic nonatrophic gastritis, Chronkhite-Canada syndrome, congenital cysts, congenital diaphragmatic hernias, congenital diverticula, congenital duplications, congenital pyloric stenosis, congestive gastropathy, cyclic vomiting syndrome, decreased mucosal resistance to acid, diffuse or infiltrating adenocarcinoma, early gastric cancer, emphysematous gastritis, endocrine cell hyperplasia, environmental gastritis, eosinophilic gastritis, eosinophilic gastroenteritis, epithelial polyps, erosive (acute) gastritis, fundic gland polyps, fungal gastritis, gangliocytic paragangliomas, gastral antral vascular ectasia, gastric adenocarcinoma, gastric outlet obstruction (pyloric stenosis), gastric ulcers, gastritis, gastroesophageal reflux, gastroparesis, granulomatous gastritis, *H. pylon* infection, hamartomatous polyps, heterotopias, heterotopic pancreatic tissue, heterotopic polyps, hyperplastic gastropathy, hyperplastic polyps, hypersecretion of acid, infectious gastritis, inflammatory lesions of the stomach, inflammatory polyps, intestinal metaplasia, invasive carcinoma, ischemia, leiomyoma, linitis plastica, luminally acting toxic chemicals, lymphocytic gastritis, lymphomas, malignant gastric stromal neoplasms, malignant lymphoma, malignant transformation of a benign gastric ulcer, Menentrier's disease (hypertrophic gastritis, rugal hypertrophy), mesenchymal neoplasms, metastatic tumors, mucosal polyps, myoepithelial adenomas, myoepithelial hamartomas, neoplasms, neuroendocrine hyperplasias, neuroendocrine tumors, nonerosive gastritis and stomach cancer, nonneoplastic polyps, parasitic gastritis, peptic ulcer disease, phlegmonous gastritis, plasma cell gastritis, polypoid (fungating) adenocarcinoma, poorly differentiated neuroendocrine carcinomas, precancerous lesions, Puetz-Jeghers syndrome, pyloric atresia, rapid gastric emptying, reflux of bile, stress ulcers, stromal tumors, superficial gastritis, type A chronic gastritis (autoimmune gastritis and pernicious anemia), type B chronic gastritis (chronic antral gastritis, *H. pylori* gastritis), ulcerating adenocarcinoma, vasculitis, viral gastritis, xanthomatous gastritis, and Zollinger-Ellison syndrome.

Testes. GPCRs expressed in the testes are listed in Table 29. These receptors are thus potential targets for therapeutic compounds that may modulate their activity, expression, or stability of the GPCR in the testes. These polypeptides, or polymorphs of these polypeptides, may form the basis of a therapeutic regimen, or a diagnostic test to determine, e.g., the presence of a disease or disorder involving the testes, the risk of developing a particular disease or disorder, or an appropriate therapeutic course.

TABLE 29

| GPCRs Expressed in the Testes |
| --- |
| ADCYAP1R1 |
| ADMR |
| ADORA1 |
| ADORA2A |
| ADORA2B |
| ADORA3 |
| ADRA1A |
| ADRA1D |
| ADRA2A |
| ADRB1 |
| ADRB2 |
| AGR9 |
| AGTR1 |
| AGTR2 |
| AGTRL1 |
| AVPR1A |
| BAI2 |
| BDKRB1 |
| BDKRB2 |
| BLR1 |
| BRS3 |
| C3AR1 |
| C5R1 |
| CALCRL |
| CASR |

TABLE 29-continued

| GPCRs Expressed in the Testes |
| --- |
| CCBP2 |
| CCKAR |
| CCKBR |
| CCR1 |
| CCR2 |
| CCR4 |
| CCR5 |
| CCR6 |
| CCR7 |
| CCRL1 |
| CCXCR1 |
| CD97 |
| CELSR1 |
| CELSR2 |
| CELSR3 |
| CHRM1 |
| CHRM2 |
| CHRM3 |
| CHRM4 |
| CHRM5 |
| CMKLR1 |
| CNR1 |
| CNR2 |
| CRHR1 |
| CRHR2 |
| CX3CR1 |
| CXCR4 |
| CXCR6 |
| CYSLT1 |
| DJ287G14 |
| DRD2 |
| DRD4 |
| EBI2 |
| EDG1 |
| EDG2 |
| EDG3 |
| EDG4 |
| EDG5 |
| EDG7 |
| EDNRA |
| EDNRB |
| EMR1 |
| ETL |
| F2R |
| F2RL1 |
| F2RL2 |
| FKSG79 |
| FLJ14454 |
| FPR1 |
| FSHR |
| FY |
| FZD1 |
| FZD10 |
| FZD2 |
| FZD3 |
| FZD4 |
| FZD5 |
| FZD6 |
| FZD7 |
| FZD8 |
| FZD9 |
| G2A |
| GABBR1 |
| GALR1 |
| GALR3 |
| GCGR |
| GHRHR |
| GIPR |
| GLP1R |
| GLP2R |
| GPCR150 |
| GPR1 |
| GPR10 |
| GPR105 |
| GPR12 |
| GPR15 |
| GPR18 |
| GPR19 |

TABLE 29-continued

GPCRs Expressed in the Testes

| |
|---|
| GPR2 |
| GPR20 |
| GPR21 |
| GPR22 |
| GPR23 |
| GPR24 |
| GPR25 |
| GPR3 |
| GPR30 |
| GPR31 |
| GPR34 |
| GPR35 |
| GPR37 |
| GPR37L1 |
| GPR39 |
| GPR4 |
| GPR43 |
| GPR45 |
| GPR48 |
| GPR49 |
| GPR50 |
| GPR51 |
| GPR54 |
| GPR55 |
| GPR57 |
| GPR6 |
| GPR61 |
| GPR62 |
| GPR63 |
| GPR65 |
| GPR66 |
| GPR68 |
| GPR7 |
| GPR73 |
| GPR73L1 |
| GPR74 |
| GPR75 |
| GPR77 |
| GPR80 |
| GPR81 |
| GPR82 |
| GPR83 |
| GPR84 |
| GPR85 |
| GPR86 |
| GPR87 |
| GPR91 |
| GPR92 |
| GPRC5B |
| GPRC5C |
| GPRC5D |
| GPRC6A |
| GRCA |
| GRM2 |
| GRM4 |
| GRM5 |
| GRM6 |
| GRM7 |
| GRM8 |
| H963 |
| HCRTR1 |
| HCRTR2 |
| HGPCR2 |
| HM74 |
| HRH1 |
| HRH2 |
| HRH3 |
| HRH4 |
| HTR1A |
| HTR1B |
| HTR1D |
| HTR1F |
| HTR2A |
| HTR2B |
| HTR4 |
| HTR5A |
| HTR7 |
| HUMNPIIY20 |

TABLE 29-continued

GPCRs Expressed in the Testes

| |
|---|
| IL8RA |
| KIAA0758 |
| KIAA1828 |
| LEC1 |
| LEC2 |
| LEC3 |
| LGR6 |
| LGR8 |
| LHCGR |
| LTB4R2 |
| MAS1 |
| MC2R |
| MC3R |
| MC5R |
| MRG |
| MRGE |
| MRGF |
| MTNR1A |
| NMBR |
| NPFF1R |
| NPY1R |
| NPY6R |
| NTSR1 |
| NTSR2 |
| OPN1MW |
| OPN3 |
| OPRL1 |
| OPRM1 |
| OXTR |
| P2RY1 |
| P2RY12 |
| P2RY2 |
| P2Y5 |
| PGR1 |
| PGR11 |
| PGR13 |
| PGR14 |
| PGR15 |
| PGR17 |
| PGR19 |
| PGR2 |
| PGR20 |
| PGR21 |
| PGR22 |
| PGR23 |
| PGR25 |
| PGR27 |
| PGR3 |
| PGR4 |
| PGR7 |
| PPYR1 |
| PTAFR |
| PTGDR |
| PTGER2 |
| PTGER3 |
| PTGER4 |
| PTGFR |
| PTGIR |
| RAI3 |
| RDC1 |
| RE2 |
| RHO |
| RRH |
| SCTR |
| SMOH |
| SSTR2 |
| SSTR3 |
| SSTR5 |
| TACR2 |
| TAR3 |
| TEM5 |
| TM7SF1 |
| TM7SF1L1 |
| TM7SF1L2 |
| TM7SF3 |
| TPRA40 |
| TRHR2 |
| TSHR |

TABLE 29-continued

GPCRs Expressed in the Testes

VIPR2
VLGR1

Exemplary diseases and disorders involving the testes include aberrant ducts of Haller, abnormal productions of hormones, abnormalities of testicular descent, acute epididymoorhcitis, adenomatoid tumor, adenomatous hyperplasia of the rete testis, adenovirus, administration of estrogens, adrenal rests, alcoholic cirrhosis, amyloidosis, anorchism, appendix testes, bacterial infections, *Brucella*, cachexia, carcinoma in situ, carcinoma of the rete testis, chlamydia, choriocarcinoma, choristomas, chronic fibrosing epididymoorchitis, coxsackie virus B, cryptorchidism, cystic dysplasia of the rete testis, cytomegalovirus, dystopia, *E. coli* infection, *Echinococcus granulosus*, ectopic testes, embryonal carcinoma, epididymoorchitis, Fournier's scrotal gangrene, fungal infection, germ cell aplasia, germ cell neoplasms, gonadal dysgenesis, gonadal stromal neoplasms, granulomatous orchitis, granulosa cell tumors, *Haemophilus influenzae*, HIV, hypergonadism, hypogonadotropic hypogonadism, hypopituitarism, hypospermatogenesis, hyrocele, idiopathic granulomatous orchitis, incomplete maturation arrest, infarction, infertility, inflammatory diseases, inflammatory lesions, interstitial (Leydig) cell tumors, Klinfelter's syndrome, latrogenic lesions, Leydig cell tumors, malaknock outplakia, malignant lymphoma, malnutrition, maturation arrest of spermatogenesis, metastatic tumors, mixed germ cell tumors, monorchism, mumps orchitis, mycobacteria, *Neisseria gonorrhoeae* infection, neoplasms, obstruction to outflow of semen, orchitis, parasitic infection, polyorchidism, radiation, *Salmonella*, sarcoidosis, *Schistosoma haematobium* infection, seminoma, Sertoli cell tumors, sex cord stromal tumors, sperm granuloma, spermatocytic seminoma, syphilis, teratocarcinoma, teratoma, testicular atrophy, testicular neoplasms, testicular torsion, *Treponema pallidum* infection, tuberculous epididymoorchitis, tumors of nonspecific stroma, undescended testes, uropathogens, varicocele, vascular disturbances, vasculitis, viral infection, Wuchereria bancrofti infection, and yolk sac carcinoma.

Thymus. GPCRs expressed in the thymus are listed in Table 30. These receptors are thus potential targets for therapeutic compounds that may modulate their activity, expression, or stability in the thymus. These polypeptides, or polymorphs of these polypeptides, may form the basis of a therapeutic regimen, or a diagnostic test to determine, e.g., the presence of a disease or disorder of the thymus, the risk of developing a particular disease or disorder, or an appropriate therapeutic course.

TABLE 30

GPCRs Expressed in the Thymus

ADCYAP1R1
ADMR
ADORA1
ADORA2A
ADORA2B
ADORA3
ADRA1A
ADRA1D
ADRB1
ADRB2
AGTR1
AGTRL1

TABLE 30-continued

GPCRs Expressed in the Thymus

AVPR2
BAI2
BDKRB1
BLR1
C3AR1
C5R1
CALCRL
CCBP2
CCKAR
CCKBR
CCR1
CCR2
CCR4
CCR5
CCR6
CCR7
CCR8
CCR9
CCRL1
CCXCR1
CD97
CELSR1
CELSR2
CHRM1
CHRM2
CHRM3
CMKBR1L2
CMKLR1
CNR2
CRHR2
CX3CR1
CXCR4
CXCR6
CYSLT1
DJ287G14
DRD3
EBI2
EDG1
EDG2
EDG3
EDG5
EDG6
EDNRA
EDNRB
EMR1
ETL
F2R
F2RL1
F2RL2
F2RL3
FKSG79
FPR1
FY
FZD1
FZD10
FZD2
FZD3
FZD4
FZD5
FZD6
FZD7
FZD8
FZD9
G2A
GABBR1
GALR1
GHRHR
GLP1R
GPCR150
GPR1
GPR105
GPR18
GPR19
GPR2
GPR21
GPR22
GPR23
GPR24

TABLE 30-continued

GPCRs Expressed in the Thymus

GPR27
GPR30
GPR31
GPR35
GPR37
GPR37L1
GPR4
GPR43
GPR48
GPR57
GPR63
GPR65
GPR66
GPR73
GPR75
GPR81
GPR83
GPR84
GPR85
GPR86
GPR9
GPR91
GPR92
GPRC5B
GPRC5C
GPRC5D
GPRC6A
GRCA
GRM2
GRM4
GRPR
H963
HM74
HRH2
HRH3
HTR2B
HTR7
IL8RA
KIAA0758
LEC1
LEC2
LEC3
LTB4R2
MC2R
MC4R
MC5R
MRG
MRGE
MRGF
MrgG
MTNR1A
NTSR2
OPN3
P2RY1
P2RY12
P2RY4
P2RY6
P2Y10
P2Y5
PGR13
PGR15
PGR16
PGR20
PGR21
PGR22
PGR25
PGR26
PGR27
PGR4
PGR7
PTAFR
PTGER1
PTGER2
PTGER3
PTGER4
PTGFR
PTGIR
PTHR1
RAI3
RDC1
RE2
SCTR
SMOH
SSTR2
TBXA2R
TEM5
TM7SF1
TM7SF1L1
TM7SF1L2
TM7SF3
TPRA40
TRHR2
TSHR
VIPR2

Exemplary diseases and disorders of the thymus include accidental involution, acute accidental involution, acute lymphoblastic leukemia of T cell type, agenesis, age-related involution, anaplastic carcinoma, ataxia telangiectasia, atrophy, bacterial infections, bacterial mediastinitis, basaloid carcinoma, bone marrow transplantation, Bruton's agammaglobulinemia, carcinosarcoma, chronic accidental involution, clear cell carcinoma, cortical thymoma, cytomegalovirus, DiGeorge syndrome, dysgenesis, dysplasia with pattern similar to severe atrophy, dysplasia with pseudoglandular appearance, dysplasia with stromal conticomedullary differentiation, ectopia, germ cell tumors, Grave's disease, histiocytosis X, HIV, Hodgkin's disease, hyperplasia, infectious mononucleosis, involution, lymphoblastic lymphoma of T-cell type, lymphoepithelioma-like carcinoma, lymphofollicular thymitis, maldescent, malignant lymphomas, malignant thymoma, measles giant cell pneumonia, medullary thymoma, mixed (composite) thymoma, mucoepidermoid carcinoma, myasthenia gravis, neonatal syphilis, neoplasms, Omenn's syndrome, predominantly cortical (organoid) thymoma, primary mediastinal B-cell lymphoma of high-grade malignancy, sarcomatoid carcinoma, seminoma, severe combined immunodeficiency, short limb dwarfism, simple dysplasia, small cell carcinoma, small-cell B-cell lymphoma of MALT type, squamous cell carcinoma, systemic lupus erythematosus, teratoma, thymic carcinoid, thymic carcinoma, thymic cysts, thymic epithelial cysts, thymic epithelial tumorw, thymic neoplasms, thymitis with diffuse B-cell infiltrations, thymolipoma, thymoma, true thymic hyperplasia, varicella-zoster, viral infections, well differentiated thymic carcinoma, and Wiscott-Aldrich syndrome.

Thyroid. GPCRs expressed in the thyroid are listed in Table 31. These receptors are thus potential targets for therapeutic compounds that may modulate their activity, expression, or stability in the thyroid. These polypeptides, or polymorphs of these polypeptides, may form the basis of a therapeutic regimen, or a diagnostic test to determine, e.g., the presence of a disease or disorder of the thyroid, the risk of developing a particular disease or disorder, or an appropriate therapeutic course.

TABLE 31

GPCRs Expressed in the Thyroid

ADCYAP1R1
ADMR
ADORA1
ADORA2A

TABLE 31-continued

GPCRs Expressed in the Thyroid

| |
|---|
| ADORA2B |
| ADORA3 |
| ADRA1A |
| ADRA1D |
| ADRA2A |
| ADRA2B |
| ADRB1 |
| ADRB2 |
| AGR9 |
| AGTR1 |
| AGTR2 |
| AGTRL1 |
| AVPR1A |
| AVPR2 |
| BDKRB1 |
| BDKRB2 |
| BLR1 |
| C3AR1 |
| C5R1 |
| CALCRL |
| CASR |
| CCBP2 |
| CCKAR |
| CCR1 |
| CCR2 |
| CCR3 |
| CCR4 |
| CCR5 |
| CCR6 |
| CCR7 |
| CCR8 |
| CCR9 |
| CCRL1 |
| CCXCR1 |
| CD97 |
| CELSR1 |
| CELSR2 |
| CELSR3 |
| CHRM1 |
| CHRM2 |
| CHRM3 |
| CHRM4 |
| CMKBR1L2 |
| CMKLR1 |
| CNR1 |
| CNR2 |
| CRHR2 |
| CX3CR1 |
| CXCR4 |
| CXCR6 |
| CYSLT1 |
| CYSLT2 |
| DJ287G14 |
| DRD2 |
| DRD3 |
| DRD4 |
| EBI2 |
| EDG1 |
| EDG2 |
| EDG3 |
| EDG4 |
| EDG5 |
| EDG6 |
| EDG7 |
| EDG8 |
| EDNRA |
| EDNRB |
| EMR1 |
| ETL |
| F2R |
| F2RL1 |
| F2RL2 |
| F2RL3 |
| FKSG79 |
| FPR1 |
| FPR-RS2 |
| FY |
| FZD1 |

TABLE 31-continued

GPCRs Expressed in the Thyroid

| |
|---|
| FZD10 |
| FZD2 |
| FZD3 |
| FZD4 |
| FZD5 |
| FZD6 |
| FZD7 |
| FZD9 |
| G2A |
| GABBR1 |
| GALR3 |
| GIPR |
| GLP1R |
| GPCR150 |
| GPR1 |
| GPR105 |
| GPR12 |
| GPR14 |
| GPR18 |
| GPR19 |
| GPR2 |
| GPR20 |
| GPR21 |
| GPR22 |
| GPR23 |
| GPR24 |
| GPR27 |
| GPR30 |
| GPR31 |
| GPR33 |
| GPR34 |
| GPR35 |
| GPR37 |
| GPR37L1 |
| GPR39 |
| GPR4 |
| GPR41 |
| GPR43 |
| GPR44 |
| GPR48 |
| GPR49 |
| GPR54 |
| GPR62 |
| GPR63 |
| GPR64 |
| GPR65 |
| GPR66 |
| GPR73 |
| GPR73L1 |
| GPR74 |
| GPR75 |
| GPR77 |
| GPR81 |
| GPR82 |
| GPR83 |
| GPR84 |
| GPR85 |
| GPR86 |
| GPR87 |
| GPR88 |
| GPR9 |
| GPR90 |
| GPR91 |
| GPR92 |
| GPRC5B |
| GPRC5C |
| GRCA |
| GRM4 |
| GRM6 |
| GRM7 |
| H963 |
| HCRTR2 |
| HGPCR11 |
| HM74 |
| HRH1 |
| HRH2 |
| HRH3 |
| HTR1B |

TABLE 31-continued

GPCRs Expressed in the Thyroid

HTR1D
HTR2A
HTR2B
HTR4
HTR5A
HTR7
IL8RA
IL8RB
KIAA0758
KIAA1828
LEC1
LEC2
LEC3
LGR6
LTB4R
LTB4R2
MAS1
MC2R
MC4R
MC5R
MRG
MRGE
MRGF
MrgG
MTNR1A
NPY1R
NTSR2
OPN1MW
OPN3
OPN4
OPRM1
OXTR
P2RY1
P2RY12
P2RY2
P2RY4
P2RY6
P2Y10
P2Y5
PGR1
PGR11
PGR12
PGR13
PGR14
PGR15
PGR16
PGR18
PGR19
PGR2
PGR20
PGR21
PGR22
PGR23
PGR25
PGR26
PGR27
PGR4
PGR7
PTAFR
PTGDR
PTGER1
PTGER2
PTGER3
PTGER4
PTGFR
PTGIR
PTHR1
PTHR2
RAI3
RDC1
RE2
RRH
SALPR
SCTR
SMOH
SSTR1
SSTR2
SSTR4
TACR1
TBXA2R
TEM5
TM7SF1
TM7SF1L1
TM7SF1L2
TM7SF3
TPRA40
TRHR2
TSHR
VIPR2

Exemplary diseases and disorders of the thyroid include aberrant thyroid glands, accessory thyroid glands, adenoma with bizarre nuclei, agenesis, amphicrine variant of medullary carcinoma, anaplastic (undifferentiated) carcinoma, aplasia, atrophic thyroiditis, atypical adenoma, autoimmune thyroiditis, carcinoma, C-cell hyperplasia, clear cell tumors, clear cell variant of medullary carcinoma, colloid adenoma, columnar variant of papillary carcinoma, congenital hypothyroidism (cretinism), diffuse nontoxic goiter, diffuse sclerosing variant of papillary carcinoma, dyshormonogenic goiter, embryonal adenoma, encapsulated variant of papillary carcinome, endemic cretinism, endemic goiter, enzyme deficiency, fetal adenoma, follicular adenoma, follicular carcinoma, follicular variant of medullary carcinoma, follicular variant of papillary carcinoma, fungal infection, giant cell variant of medullary carcinoma, goiter induced by antithyroid agents, goitrous hypothyroidism, Graves' disease, Hashimoto's autoimmune thyroiditis, Hurthle cell (oncocytic) adenoma, hyalinized trabecular adenoma, hyperthyroidism, hypothyroid cretinism, hypothyroidism, iodine deficiency, juvenile thyroiditis, Iatrogenic hypothyroidism, lingual thyroid glands, malignant lymphoma, medullary carcinoma, melanocytic variant of medullary carcinoma, mesenchymal tumors, metastatic tumors, minimally invasive follicular carcinoma, mixed medullary and follicular carcinoma, mixed medullary and papillary carcinoma, mucinous carcinoma, mucoepidermoid carcinoma, multinodular goiter, myxedema, neoplasms, neurologic cretinism, nonspecific lymphocytic (simple chronic) thyroiditis, oncocytic variant of medullary carcinoma, palpation thyroiditis, papillary carcinoma, papillary microcarcinoma, papillary variant of medullary carcinoma, partial agenesis, pituitary thyrotropic adenoma, poorly differentiated carcinoma, primary hypothyroidism, pseudopapillary variant of medullary carcinoma, Riedel's thyroiditis, sclerosing mucoepidermoid carcinoma with eosinophilia, silent thyroiditis, simple adenoma, small cell variant of medullary carcinoma, solitary thyroid nodule, sporadic goiter, squamous cell carcinoma, squamous variant of medullary carcinoma, subacute throiditis (DeQuervain, granulomatous, giant cell thyroiditis), tall cell variant of papillary carcinoma, tertiary syphilis, thyroglossal duct cyst, thyroid agenesis, thyroid nodules, thyroiditis, thyrotoxicosis, toxic adenoma, toxic multinodular goiter, toxic nodular goiter (Plummer's disease), tuberculosis, tubular variant of medullary carcinoma, and widely invasive follicular carcinoma.

Uterus. GPCRs expressed in the uterus are listed in Table 32. These receptors are thus potential targets for therapeutic compounds that may modulate their activity, expression, or stability in the uterus. These polypeptides, or polymorphs of these polypeptides, may form the basis of a therapeutic regimen, or a diagnostic test to determine, e.g., the presence of a disease or disorder of the uterus, the risk of developing a particular disease or disorder, or an appropriate therapeutic course.

TABLE 32

GPCRs Expressed in the Uterus

ADCYAP1R1
ADMR
ADORA1
ADORA2A
ADORA2B
ADORA3
ADRA1A
ADRA1D
ADRA2A
ADRB1
ADRB2
AGTR1
AGTR2
AGTRL1
AVPR1A
AVPR2
BAI2
BDKRB1
BDKRB2
C3AR1
C5R1
CALCRL
CASR
CCBP2
CCR1
CCR2
CCR3
CCR4
CCR5
CCR6
CCR7
CCR8
CCRL1
CCXCR1
CD97
CELSR1
CELSR2
CHRM1
CHRM2
CHRM3
CHRM4
CMKBR1L2
CMKLR1
CNR1
CNR2
CRHR2
CX3CR1
CXCR4
CXCR6
CYSLT1
DJ287G14
DRD3
EBI2
EDG1
EDG2
EDG3
EDG5
EDG6
EDG7
EDG8
EDNRA
EDNRB
EMR1
ETL
F2R
F2RL1
F2RL2
F2RL3
FLJ14454
FPR1
FPR-RS2
FSHR
FY

TABLE 32-continued

GPCRs Expressed in the Uterus

FZD1
FZD10
FZD2
FZD3
FZD4
FZD5
FZD6
FZD7
G2A
GABBR1
GALR3
GLP1R
GPCR150
GPR1
GPR103
GPR105
GPR18
GPR19
GPR20
GPR21
GPR23
GPR24
GPR27
GPR30
GPR31
GPR33
GPR34
GPR35
GPR37
GPR37L1
GPR39
GPR4
GPR43
GPR44
GPR48
GPR49
GPR54
GPR55
GPR63
GPR64
GPR65
GPR73
GPR73L1
GPR75
GPR77
GPR82
GPR83
GPR84
GPR85
GPR86
GPR9
GPR90
GPR91
GPR92
GPRC5B
GPRC5C
GRCA
GRM8
H963
HCRTR2
HGPCR11
HGPCR19
HGPCR2
HM74
HRH1
HRH2
HRH3
HRH4
HTR1D
HTR2A
HTR2B
HTR4
HTR7
IL8RA
KIAA0758
LEC1
LEC2
LEC3

TABLE 32-continued

GPCRs Expressed in the Uterus

LGR6
LGR7
LGR8
LHCGR
LTB4R
LTB4R2
MAS1
MC2R
MC5R
MRG
MRGE
MRGF
NMU2R
NPY1R
OPN1MW
OPN3
OXTR
P2RY1
P2RY12
P2RY2
P2RY6
P2Y10
P2Y5
PGR1
PGR10
PGR13
PGR15
PGR16
PGR19
PGR2
PGR21
PGR22
PGR23
PGR25
PGR26
PGR27
PGR4
PGR5
PGR7
PTAFR
PTGDR
PTGER1
PTGER2
PTGER3
PTGER4
PTGFR
PTGIR
PTHR1
RAI3
RDC1
RE2
RRH
SCTR
SMOH
SREB3
SSTR2
SSTR4
TACR1
TACR2
TAR2
TBXA2R
TEM5
TM7SF1
TM7SF1L1
TM7SF3
TPRA40
TRHR2
TSHR
VIPR2

Exemplary diseases and disorders of the uterus include acute cervicitis, acute endometritis, adenocanthoma, adenocarcinoma, adenocarcinoma in situ, adenoid cystic carcinoma, adenomatoid tumor, adenomyoma, adenomyosis (endometriosis interna), adenosquamous carcinoma, amebiasis, arias-Stella phenomenon, atrophy of the endometrium, atypical hyperplasia, benign polypoid lesions, benign stromal nodule, carcinoid tumors, carcinoma in situ, cervical intraepithelial neoplasia, chlamydia, chronic cervicitis, chronic nonspecific endometritis, ciliated (tubal) metaplasia, clear cell adenocarcinoma, clear cell carcinoma, clear cell metaplasia, complex hyperplasia with atypia, complex hyperplasia without atypia, condyloma aduminatum, congenital abnormalities, corpus cancer syndrome, cystic hyperplasia, dysfunctional uterine bleeding, dysmenorrhea, dysplasia of the cervix (cervical intraepithelial neoplasia, squamous intraepithelial lesion), endocervical adenocarcinoma, endocervical polyp, endolymphatic stromal myosis, endometrial adenocarcinoma, endometrial carcinoma, endometrial hyperplasia, endometrial polyps, endometrial stromal neoplasms, endometriosis, endometritis, endometroid (pure) adenocarcinoma of the endometrium, endometroid adenocarcinoma with squamous differentiation, eosinophilic metaplasia, epimenorrhea, exogenous progestational hormone effect, extrauterine endometriosis (endometriosis externia), gestational trophoplastic disease, gonorrhea, hemangioma, herpes simplex virus. type 2, high-grade squamous intraepithelial lesion, human papillomavirus, hyperplasia, inadequate luteal phase, infertility, inflammatory cervical lesions, inflammatory lesions of the endometrium, intravenous leiomyomatosis, invasive carcinoma of cervix, invasive squamous cell carcinoma, leiomyoma, leiomyosarcoma, lipoma, low-grade squamous intraepithelial lesion, malignant mixed mesodermal (Mullerian) tumor, menorrhagia, metaplasia, metastasizing leiomyoma, metastatic carcinoma, microglandular hyperplasia, microinvasive carcinoma, microinvasive squamous cell carcinoma, mucinous adenocarcinoma, mucinous metaplasia, neoplasms of the cervix, neoplasms of the endometrium, neoplasms of the myometrium, nonneoplastic cervical proliferations, papillary synctial metaplasia, papilloma, pelvic inflammatory disease, peritoneal leiomyomatosis, persistent luteal phase, postmenopausal bleeding, serous papillary adenocarcinoma, simple hyperplasia with atypia, simple hyperplasia without atypia, spontaneous abortion, squamous carcinoma, squamous cell neoplasia, squamous intraepithelial lesions, squamous metaplasia, squamous metaplasia (acanthosis), stromal sarcoma, tuberculous endometritis, unopposed estrogen effect, uterine leiomyomata, verrucou carcinoma, vestigial and heterotopic structures, villoglandular papillary adenocarcinoma, and viral endometritis.

Other GPCRs

Additional GPCRs are listed in Table 33. The expression data for these receptors is unknown, and they may be expressed anywhere in the body, for example, in any of the tissues described above. These receptors may be potential targets for therapeutic compounds that may modulate their activity, expression, or stability for the treatment of a disease or disorder involving such a receptor. These polypeptides, or polymorphs of these polypeptides, may form the basis of a therapeutic regimen, or a diagnostic test to determine, e.g., the presence of a disease or disorder, the risk of developing a particular disease or disorder, or an appropriate therapeutic course.

TABLE 33

GPCRs Without Expression Data

| GPR32 | GPR38 | F2RL | FPRL1 | FPRL2 | TA10 |
| --- | --- | --- | --- | --- | --- |
| TA11 | TA12 | TA14 | TA15 | HTR1E | OR2I2 |
| GPR52 | CCRL2 | GPR8 | TG1019 | PGR24 | SLT |
| OR51Q1 | GPR78 | OPN1LW | HTR5B | HM74A | MRGA2 |
| MRGA3 | MRGA4 | MRGA5 | MRGA6 | MRGA7 | MRGA8 |

TABLE 33-continued

GPCRs Without Expression Data

| MRGB1 | MRGB2 | MRGB3 | MRGB4 | OR51E1 | MRGB5 |
|---|---|---|---|---|---|
| OR51E2 | CMKBR1L1 | FPR-RS1 | FPR-RS3 | FPR-RS4 | TA8 |
| PGR15L | OR2A1 | OR2A7 | P2RY11 | TA7 | OR7D2 |
| P2Y3L | TCP10C | OR7E102 | GPR103L | GNRHR2 | PGR9 |
| EMR2 | EMR3 | OR8B3 | OR4N4 | PGR6 | |
| MRGX1 | MRGX2 | MRGX3 | MRGX4 | | |

Other Tissues

GPCRs listed in Table 1 may also be expressed in the pancreas, bone and joints, breasts, immune system, or systemically. These GPCRs may thus be involved in metabolic diseases or disorders and diseases or disorders of the pancreas, bone and joints, breast, or immune system. Any GPCRs involved in these diseases are targets for diagnostic tests, drug design, and therapy.

Exemplary diseases and disorders of the pancreas include ACTHoma, acute pancreatitis, adult onset diabetes, annulare pancreas, carcinoid syndrome, carcinoid tumors, carcinoma of the pancreas, chronic pancreatitis, congenital cysts, Cushing's syndrome, cystadenocarcinoma, cystic fibrosis (mucoviscidosis, fibrocystic disease), diabetes mellitus, ectopic pancreatic tissue, gastinoma, gastrin excess, glucagon excess, glucagonomas, GRFomas, hereditary pancreatitis, hyperinsulinism, impaired insulin release, infected pancreatic necrosis, insulin resistance, insulinomas, islet cell hyperplasia, islet cell neoplasms, juvenile onset diabetes, macroamylasemia, maldevelopment of the pancreas, maturity-onset diabetes of the young, metastatic neoplasms, mucinous cystadenoma, neoplastic cysts, nonfunctional pancreatic endocrine tumors, pancreas divisum, pancreatic abcess, pancreatic cancer, pancreatic cholera, pancreatic cysts, pancreatic endocrine tumor causing carcinoid syndrome, pancreatic endocrine tumor causing hypercalcemia, pancreatic endocrine tumors, pancreatic exocrine insufficiency, pancreatic pleural effusion, pancreatic polypeptide excess, pancreatic pseudocyst, pancreatic trauma, pancreatogenous ascites, serous cystadenoma, Shwachman's syndrome, somatostatin excess, somatostatinoma syndrome, traumatic pancreatitis, type 1 (insulin-dependent) diabetes, type 2 (non-insulin-dependent) diabetes, vasoactive intestinal polypeptide excess, VIPomas, and Zollinger-Ellison syndrome.

Exemplary diseases and disorders of the bone and joints include achondroplasia, acute bacterial arthritis, acute pyogenic osteomyelitis, Albright's syndrome, alkaptonuria (ochronosis), aneurysmal bone cyst, ankylosing spondylitis, arthritic, arthropathies assocaited with hemoglobinopathies, arthropathy of acromegaly, arthropathy of hemochromatosis, bone cysts, calcium hydroxyapatite deposition disease, calcium pyrophosphate deposition disease, chondrocalcinosis, chondroma, chondrosarcoma, chostochondritis, chrondromblastoma, congenital dislocation of the hip, congenital disorders of joints, echondromatosis (dyschondroplasia, Ollier's disease), erosive osteoarthritis, Ewing's sarcoma, Felty's syndrome, fibromyalgia, fibrous cortical defect, fibrous dysplasia (McCune-Albright syndrome, fungal arthritis, ganglion, giant cell tumor, gout, hematogenous osteomyelitis, hemophilic arthropathy, hereditary hyperphosphatasia, hyperostosis, hyperostosis frontalis interna, hyperparathyroidism (osteitis fibrosa cystica), hypertrophic osteoarthropathy, infections diseases of joints, juvenile rheumatoid arthritis (Still's disease), lyme disease, lymphoid neoplasms, melorheostosis, metabolic diseases of joints, metastatic carcinoma, metastatic neoplasms, monostatic fibrous dysplasia, multiple exostoses (diaphyseal aclasis, osteochondromatosis), neoplasms, neuropathic joint (Charcot's joint), osteoarthritis, osteoarthrosis, osteoblastoma, osteochondroma (exostosis), osteogenesis imperfecta (brittle bone disease), osteoid osteoma, osteoma, osteomalacia, osteomyelitis, osteomyelosclerosis, osteopetrosis (marbel bone disease, Albers-Schonberg disease), osteopoikilosis, osteoporosis (osteopenia), osteosarcoma, osteosclerosis, Paget's disease of bone (osteitis deformans), parasitic arthritis, parosteal osteosarcome, pigmented villonodular synovitis, polyostotic fibrous dysplasia, postinfectious or reactive arthritis, progressive diaphyseal dysplasia (Camurati-Engelmann disease), pseudogout, psoriatic arthritis, pyknodysostosis, pyogenic arthritis, reflex sympathetic dystrophy syndrome, relapsing polychondritis, rheumatoid arthritis, rickets, senile osteoporosis, sickle cell disease, spondyloepiphyseal dysplasia, synovial chondromatosis, synovial sarcoma, syphilitic arthritis, talipes calcaneovalgus, talipes equinovarus, thalassemia, Tietze's syndrome, tuberculosis of bone, tuberculous arthritis, unicameral bone cyst (solitary bone cyst), and viral arthritis.

Exemplary diseases and disorders of the immune system include abnormal neutrophil function, acquired immunodeficiency, acute rejection, Addison's disease, advanced cancer, aging, allergic rhinitis, angioedema, arthrus-type hypersensitivity reaction, ataxia-telangiectasia, autoimmune disorders, autoimmune gastritis, autosomal recessive agammaglobulinemia, blood transfusion reactions, Bloom's syndrome, Bruton's congenital agammaglobulinemia, bullous pemphigoid, Chediak-Higashi syndrome, chronic active hepatitis, chronic granulomatous disease of childhood, chronic rejection, chronic renal failure, common variable immunodeficiency, complement deficiency, congenital (primary) immunodeficiency, contact dermatitis, deficiencies of immune response, deficiency of the vascular response, dermatomyositis, diabetes mellitus, disorders of microbial killing, disorders of phagocytosis, Goodpasture's syndrome, graft rejection, graft-versus-host disease, granulocyt deficiency, granulocytic leukemia, Graves' disease, Hashimoto's thyroiditis, hemolytic anemia, hemolytic disease of the newborn, HIV infection (AIDS), Hodgkin's disease, hyperacute rejection, hyper-IgE syndrome, hypersensitivity pneumonitis, hypoparathyroidism, IgA deficiency, IgG subclass deficiencies, immunodeficiency with thymoma, immunoglobulin deficiency syndromes, immunologic hypersensitivity, immunosupressive drug therapy, infertility, insulin-resistant diabetes mellitus, interferon γ receptor deficiency, interleukin 12 receptor deficiency, iron deficiency, juvenile insulin-dependent diabetes mellitus, Kaposi's sarcoma, lazy leuknock outcyte syndrom, localized type 1 hypersensitivity, lymphocytic leukemia, lymphoma, maignant B cell lymphoma, major histocompatibility complex class 2 deficiency, mixed connective tissue disease, mutliple myeloma, myasthenia gravis, myeloperoxidase deficiency, neutropenia, nude syndrome, pemphigus vulgaris, pernicious anemia, postinfectious immunodeficiency, primary biliary cirrhosis, primary immunodeficiency, primary T cell immunodeficiency, progressive systemic sclerosis, protein-calorie malnutrition, purine nucleoside phosphorylation deficiency, rheumatic fever, rheumatoid arthritis, secondary immunodeficiency, selective (isolated) IgA deficiency, serum sickness type hypersensitivity reaction, severe combined immunodeficiency, Sjogren's syndrome, sympathetic ophthalmitis, systemic lupus erythematosus, systemic mastocytosis, systemic type 1 hypersensitivity, T cell receptro deficiency, T lymphopenia (Nezelof's syndrome), thrombocytopenia, thymic hypoplasia (DiGeorge syndrome), thymic neoplasms, thymoma (Goode's syndrome), transient hypogammaglobulinemia of infancy, type 1

(immediate) hypersensitivity (atopy, anaphylaxis), type 2 hypersensitivity, type 3 hypersensitivity (immune complex injury), type 4 (delayed) hypersensitivity, urticaria, variable immunodeficiency, vitiligo, Wisknock outtt-Aldrich syndrom, x-linked agammaglobulinemia, x-linked immunodeficiency with hyper IgM, x-linked lymphoproliferative syndrome, and zap70 tyrosine kinase deficiency.

Exemplary diseases and disorders of the breasts include acute mastitis, breast abcess, carcinoma, chronic mastitis, congenital breast anomalies, cystic mastopathy, ductal carcinoma, ductal carcinoma in situ, ductal papilloma, fat necrosis, fibroadenoma, fibrocystic changes, fibrocystic disease, galactorrhea, granular cell tumor, gynecomastia, infiltrating ductal carcinoma, inflammatory breast carcinoma, inflammatory breast lesions, invasive lobular carcinoma, juvenile hypertrophy of the breast, lactating adenoma, lobular carcinoma in situ, neoplasms, Paget's disease of the nipple, phyllodes tumor (cystosarcome phyllodes), polymastia, polymazia, polythelia, silicone granuloma, supernumerary breast, and supernumerary nipples.

Exemplary metabolic or nutritive diseases or disorders include 5,10-methylenetetrahydrofolate reductase deficiency, achondrogenesis type 1B, acid c-1,4 glucosidase deficiency, acquired generalized lipodystrophy (Lawrence syndrome), acuired partial lipodystrophy (Barraquer-Simons syndrome), acute intermittent porphyria, acute panniculitis, adenine phosphoribosyltransferase deficiency, adenosine deaminase deficiency, adenylosuccinate lyase deficiency, adiposis dolorosa (Dercum disease), ALA dehydratase-deficient porphyria, albinism, alkaptonuria, amulopectinosis, Andersen disease, argininemia, argininosuccinic aciduria, astelosteogenesis type 2, Bartter's syndrome, benign familial neonatal epilepsy, benign fructosuria, benign recurrent and progressive familial intrahepatic cholestasis, biotin deficiency, branching enzyme deficiency, calcium deficiency, carnitine transport defect, choline deficiency, choline toxicity, chromium deficiency, chronic fat malabsorption, citrullinemia, classic branched-chain ketoaciduria, classic cystinuria, congenital chloridorrhea, congenital erythropoietic porphyria, congenital generalized lipodystrophy, congenital myotonia, copper deficiency, copper toxicity, cystathionine 3-synthase deficiency, cystathioninuria, cystic fibrosis, cystinosis, cystinuria, Darier disease, defect in transport of long-chain fatty acids, deficiency of cobalamin coenzyme deficiency, Dent's syndrome, diatrophic dysplasia, dibasic aminoaciduria, dicarboxylic aminoaciduria, dihydropyrimidine dehydrogenase deficiency, distal renal tubular acidosis, dry beriberi, Dubin-Johnson syndrome, dysbetalipoproteinemia, end-organ insensitivity to vitamin D, erythropoietic protoporphyria, Fabry disease, failure of intestinal absorption, familial apoprotein C2 deficiency, familial combined hyperlipidemia, familial defective Apo B100, familial goiter, familial hypercholesterolemia, familial hypertriglyceridemia, familial hypophosphatemic rickets, familial lipoprotein lipase deficiency, familial partial lipodystrophy, Fanconi-Bickel syndrome, fluoride deficiency, folate malabsorption, folic adic deficiency, formiminoglutamic aciduria, fructose 1,6 diphosphatase deficiency, galactokinase deficiency, galactose 1-phosphate uridyl transferase deficiency galactosemia, Gaucher disease, Gitelman's syndrome, globoid cell leuknock outdystrophy, glucose-6-phosphatease deficiency, glucose-6-translocase deficiency, glucose-galactose malabsorption, glucose-tranporter protein syndrome, glutaric aciduria, glycogen storage disease type 2, glycogen storage disease type 1 b, glycogen storage disease type ID, glycogen synthase deficiency, gout, Hartnup disease, hawkinsinuria, hemochromatosis, hepatic glycogenosis with renal fanconi syndrome, hepatic lipase deficiency, hepatic porphyria, hereditary coproporphyria, hereditary fructose intolerance, hereditary xanthinuria, Hers disease, histidinemia, histidinuria, HIV-1 protease inhibitor-induced lipodystrophy, homocitrullinuria, homocystinuria, homocystinuria, homocystinuria and methylmalonic acidemia, homocystinurias, Hunter syndrome, Hurler disease, Hurler-Scheie disease, hyophosphatemic rickets, hyperammonemia, hyperammonemia, hypercholesterolemia, hypercystinuria, hyperglycinemia, hyperhydroxyprolinemia, hyperkalemic periodic paralysis, hyperleucineisoleucinemia, hyperlipoproteinemias, hyperlysinemia, hypermagnesemia, hypermetabolism, hypermethioninemia, hyperornithinemia, hyperoxaluria, hyperphenylalaninemia with primapterinuria, hyperphenylalaninemias, hyperphosphatemia, hyperprolinemia, hypertriglyceridemia, hyperuricemia, hypervalinemia, hypervitaminosis A, hypervitaminosis D, hypocholesterolemia, hypometabolism, hypophosphatemia, hypouricemia, hypovitaminosis A, hypoxanthine phosphoribosyltransferase deficiency, iminoglycinuria, iminopeptiduria, intermittent branched-chain ketoaciduria, intestinal malabsorption, iodine deficiency, iron deficiency, isovaleric acidemia, Jervell and Lange-Nielsen syndrome, juvenile pernicious anemia, keshan disease, Knock outrsaknock outff's syndrome, kwashiorknock outr, leuknock outdystrophies, Liddle's syndrome, lipodystrophies, lipomatosis, liver glycogenoses, liver phosphorylase kinase deficiency, long QT syndrome, lysinuria, lysosomal storage diseases, magnesium deficiency, malabsorptive diseases, malignant hyperphenylalaninemia, manganese deficiency, marasmus, Maroteaux-Lamy disease, McArdle disease, Menkes' disease, metachromatic leuknock outdystrophy, methionine malabsorption, methylmalonic acidemia, molybdenum deficiency, monosodiumurate gout, Morquio syndrome, mucolipidoses, mucopolysaccharidoses, multiple carboxylase deficiency syndrome, multiple symmetric lipomatosis, Madelung disease, muscle glycogenoses, muscle phosphofructokinase deficiency, muscle phosphorylase deficiency, myoadenylate deaminase deficiency, nephrogenic diabetes insipidus, nesidioblastosis of pancreas, niacin deficiency, niacin toxicity, Niemann-Pick disease, obesity, orotic aciduria, osteomalacia, paramyotonia congenita, pellagra, Pendred syndrome, phenylketonuria, phenylketonuria type 1, phenylketonuria type 2, phenylketonuria type 3, phosphate deficiency, phosphoribosylpyrophosphate synthetase overactivity, polygenic hypercholesterolemia, Pompe disease, porphyria cutanea tarda, porphyrias, primary bile acid malabsorption, primary hyperoxaluria, primary hypoalphalipoproteinemia, propionic acidemia, protein-energy malnutrition, proximal renal tubular acidosis, purine nucleoside phosphorylase deficiency, pyridoxine deficiency, pyrimidine 5'-nucleotidase deficiency, renal glycosuria, riboflavin deficiency, rickets, Rogers' syndrome, saccharopinuria, Sandhoff disease, Sanfilippo syndromes, sarcosinemia, Scheie disease, scurvy (vitamin C deficiency), selenium deficiency, selenosis, sialic acid storage disease, S-sulfo-L-cysteine, sulfite, thiosulfaturia, Tarui disease, Tay-Sachs disease, thiamine deficiency, tryptophan malabsorption, tryptophanuria, type 1 pseudohypoaldosteronism, type 3 glycogen storage disease (debrancher deficiency, limit dextrinosis), tyrosinemia, tyrosinemia type 1, tyrosinemia type 2, tyrosinemia type 3, uridine diphosphate galactose 4-epimerase deficiency, urocanic aciduria, variegate porphyria, vitamin B12 deficiency, vitamin C toxicity, vitamin D deficiency, vitamin D-resistant rickets, vitamin d-sensitive rickets, vitamin E deficiency, vitamin E toxicity, vitamin K deficiency, vitamin K toxicity, von Gierke disease, Wernicke's encephalopathy, wet beriberi, Wilson's disease, xanthurenic aciduria, X-linked sideroblastic anemia, zinc deficiency, zinc toxicity, α-ketoadipic aciduria, α-methylacetoacetic aciduria, β-hydroxy-β-methylglutaric aciduria, and β-methylcrotonyl glycinuria.

Combinatorial Expression of GPCRs

Figure 3:
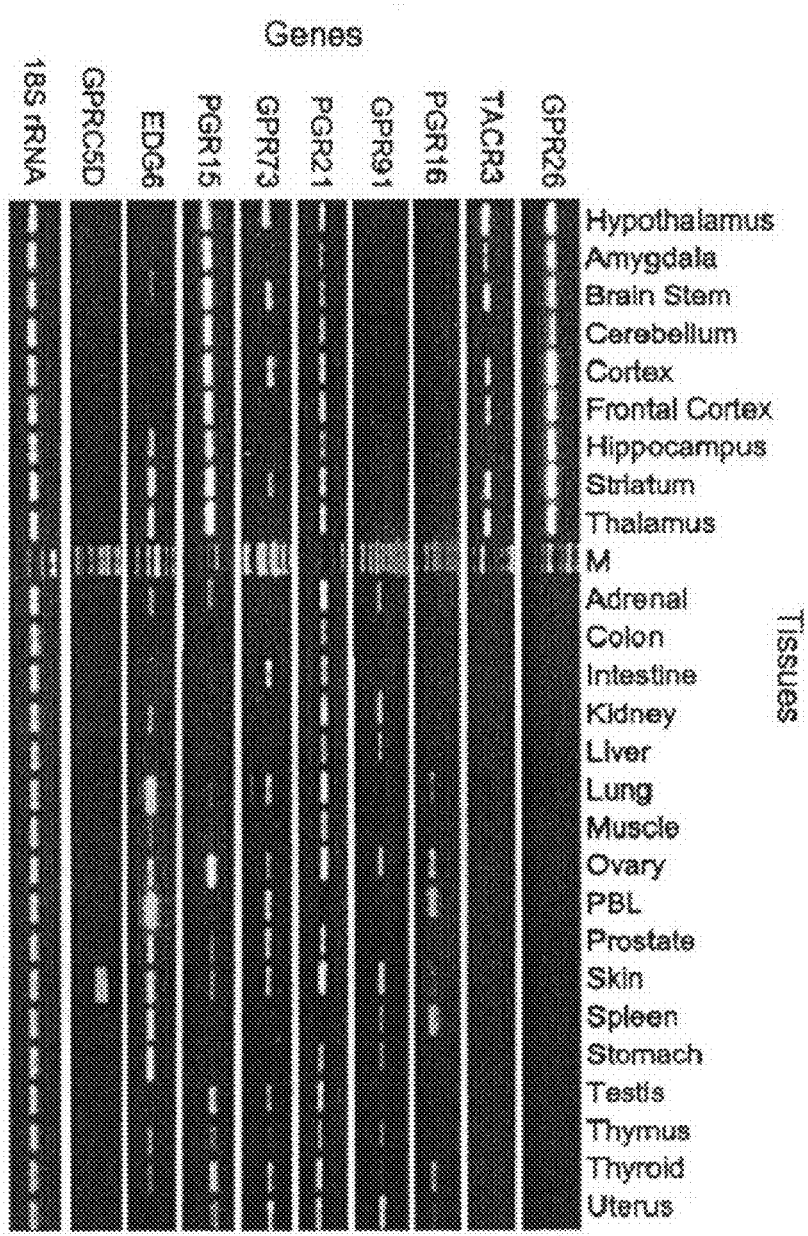
FIG. 3 is a photograph showing the expression profiles of nine GPCRs as identified by RT-PCR.
Figure 4A:
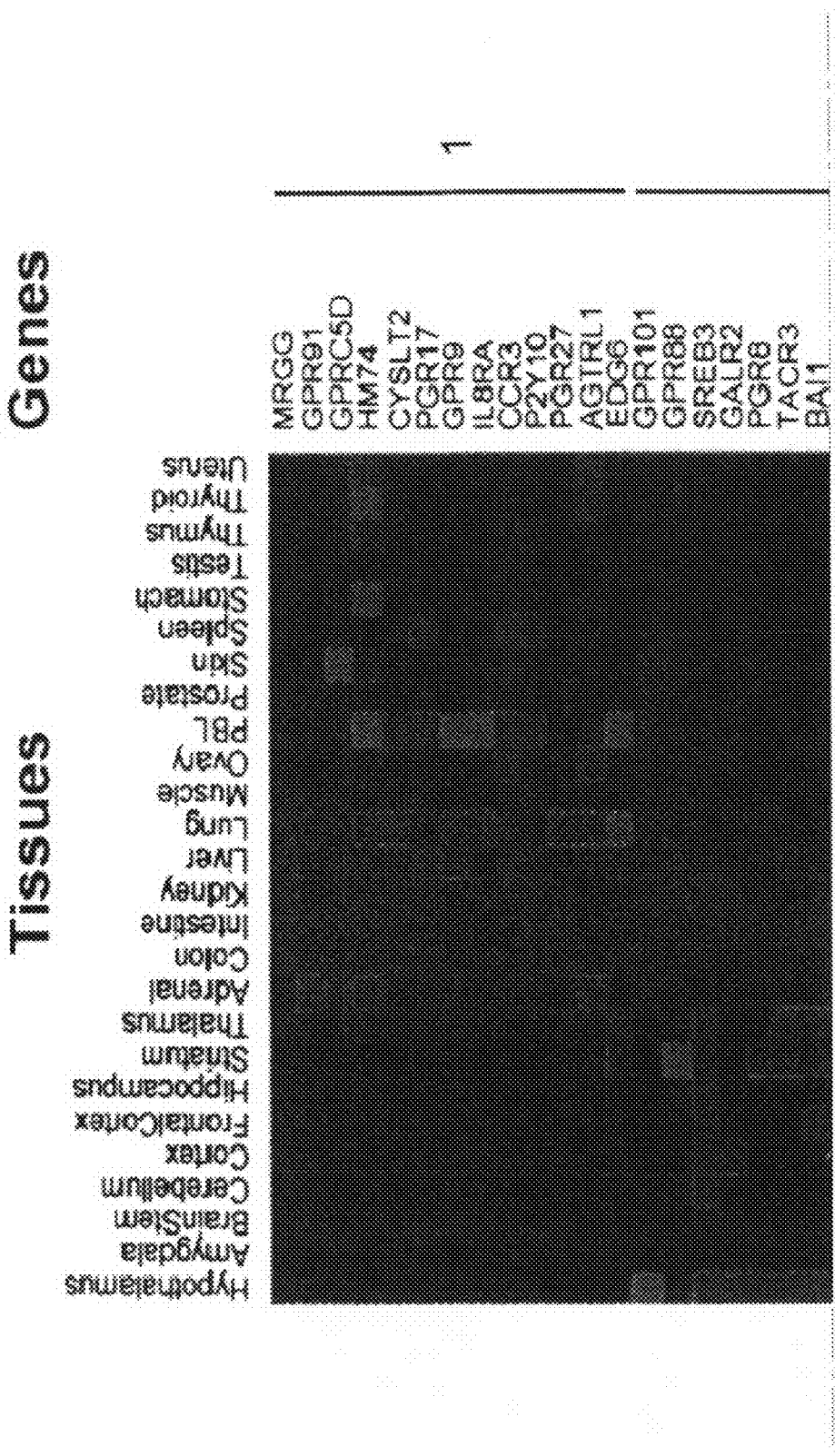
FIGS. 4A-4D are a schematic summary of tissue expression in 100 GPCR polynucleotides. Polynucleotides were analyzed individually by RT-PCR, as shown in FIG. 3, and the intensity of the observed bands determined by scanning, Each gene is represented by a single row of colored boxes, with four different expression levels: no expression—blue; low expression—purple; moderate expression—dark red; strong expression—pure red. Polynucleotides and tissues, as well as groups of expression patterns, are indicated.
Figure 4B:
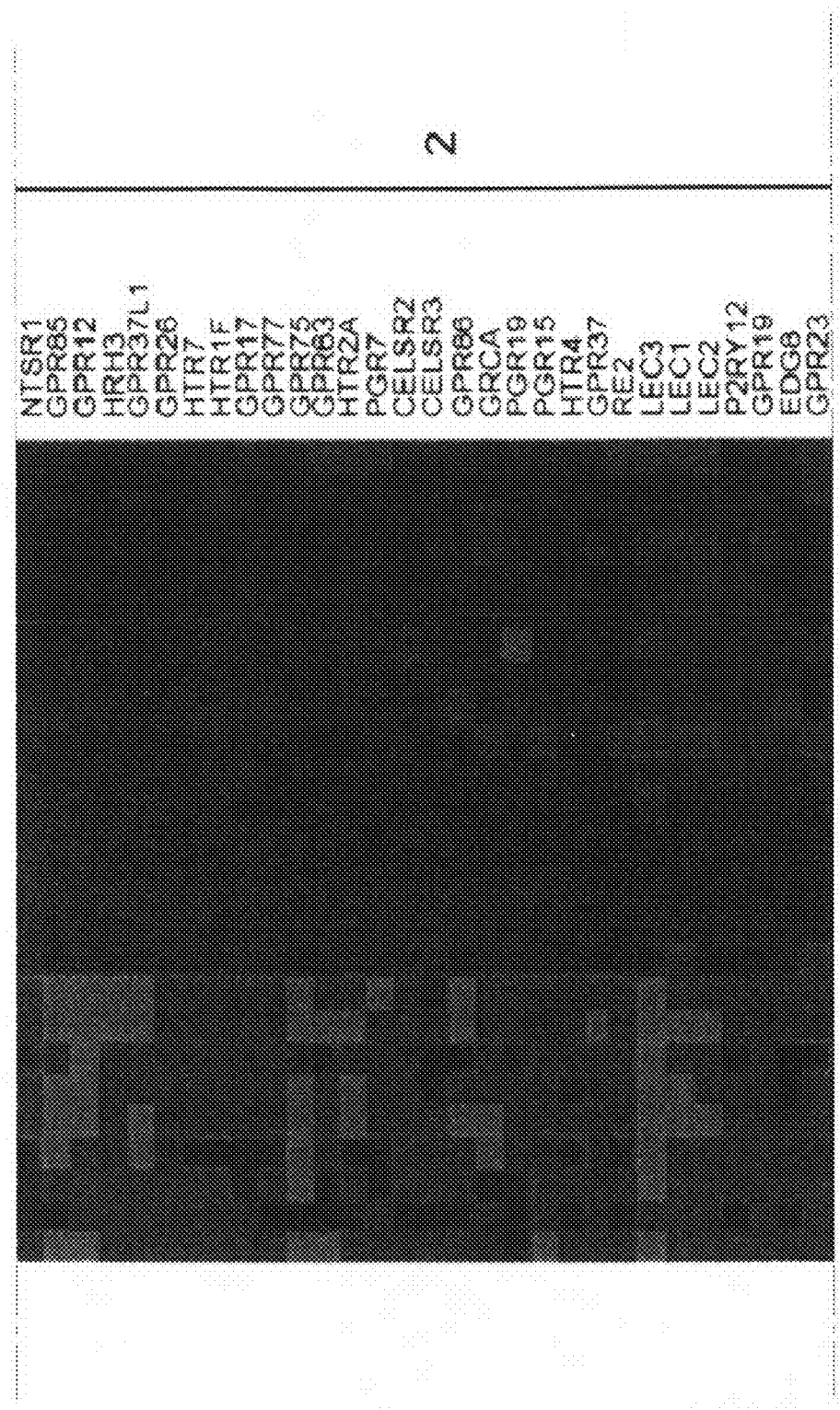
Figure 4C:
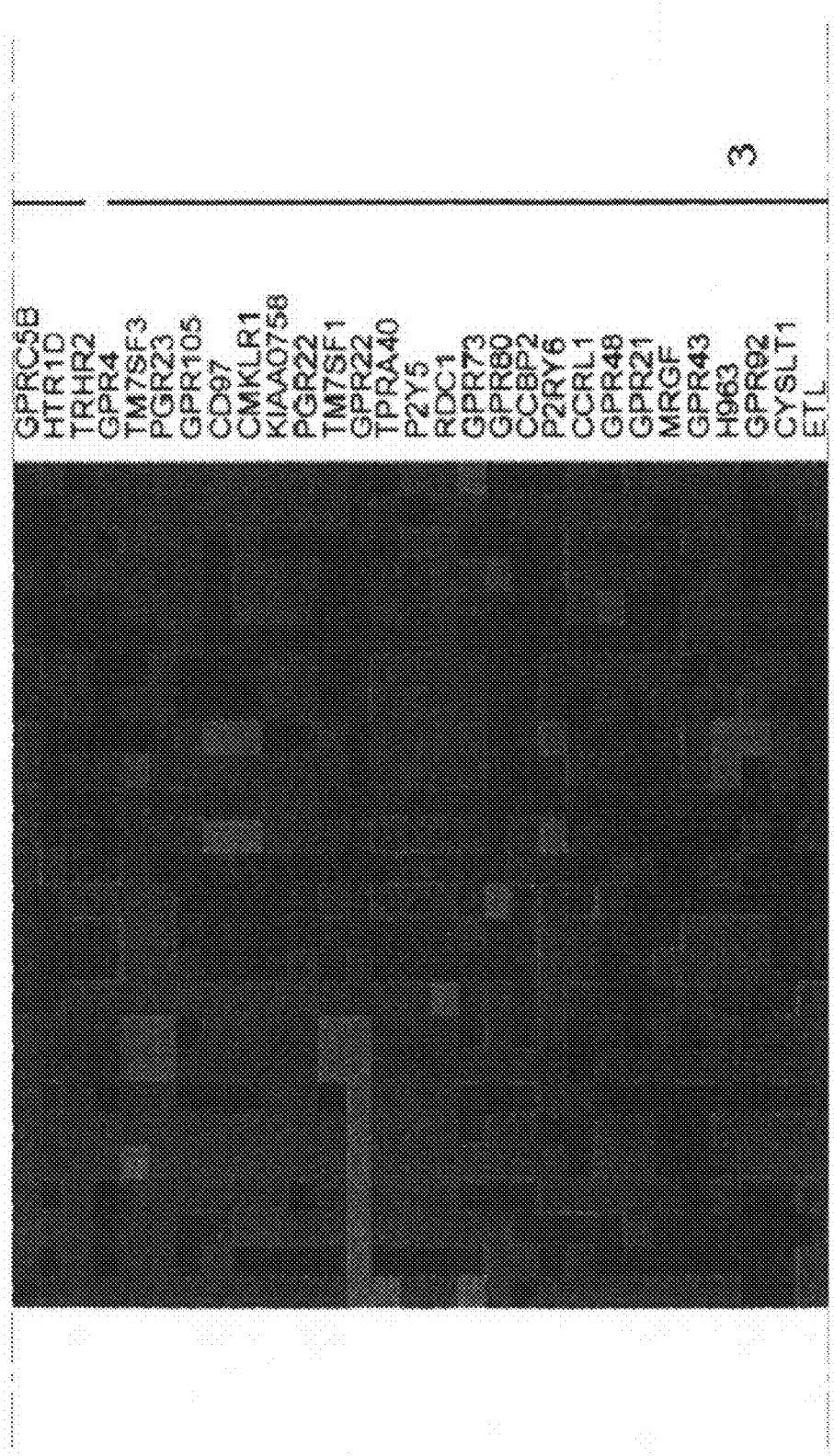
Figure 4D:
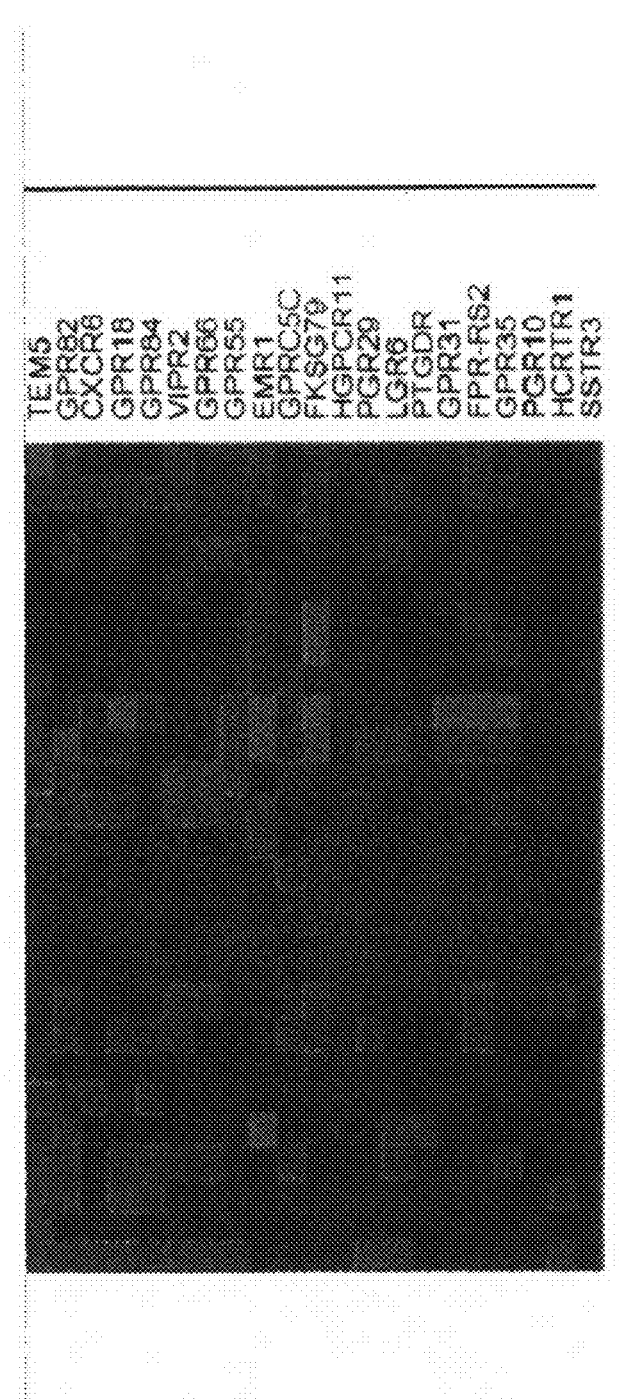

To begin a dissection of the functions of individual GPCRs, we analyzed the expression patterns of GPCRs in different mouse tissues. In these experiments, we used RT-PCR with receptor-specific primers to analyze the expression of GPCR genes in RNAs from 17 peripheral tissues and 9 distinct regions of the brain (FIGS. 3 and 4). The conditions used could consistently detect 50 or fewer RNA molecules per sample and could reliably reproduce the expression profiles of a number of known tissue-specific genes. All tissue samples were normalized according to their 18S rRNA content and were used at two concentrations (2 ng and 20 ng) of RNA to permit semi-quantitative evaluation.

Specific patterns of expression were clearly delineated. For example, GPR26 and TACR3 were exclusively expressed in the brain, while GPR91 and PGR16 were expressed solely in peripheral tissues. Four other genes, GPR73, EDG6, PGR15 and PGR21, were expressed in both brain and peripheral tissues. Also shown is GPRC5D, the only GPCR found to be expressed in just a single tissue, skin.

The results of RT-PCR analysis with 100 different GPCRs and 26 mouse tissues (17 peripheral tissues and 9 brain regions) are shown in FIG. 4. The data is presented as a semi-quantitative scattergram. The most remarkable finding was that 94% of GPCRs were detected in the brain, generally in 4 to 5 distinct anatomical areas. The largest number of genes was detected in the hypothalamus (82 genes), a brain region of high structural complexity. Individual peripheral tissues also showed expression of multiple different GPCRs, ranging from 12 genes in muscle to 69 genes in ovary.

Though individual GPCR genes were generally expressed in numerous tissues, most genes had unique expression profiles. Three groups with broadly related profiles were observed. In the first group were genes expressed primarily in peripheral tissues. Six of these genes were expressed exclusively in the peripheral tissues and not in the brain. The second group contained genes expressed primarily in brain. Of these 41 genes, 14 were solely expressed in brain and not in peripheral tissues. In the third group the genes were broadly expressed in the brain and throughout the periphery.

To further investigate GPCR expression in the brain, we used in situ hybridization to localize GPCR mRNA in brain sections. In these experiments 33P-labeled cRNA probes prepared from the coding regions of the receptor genes were hybridized to a series of sections throughout the entire brain, except the olfactory bulb.

Figure 5:
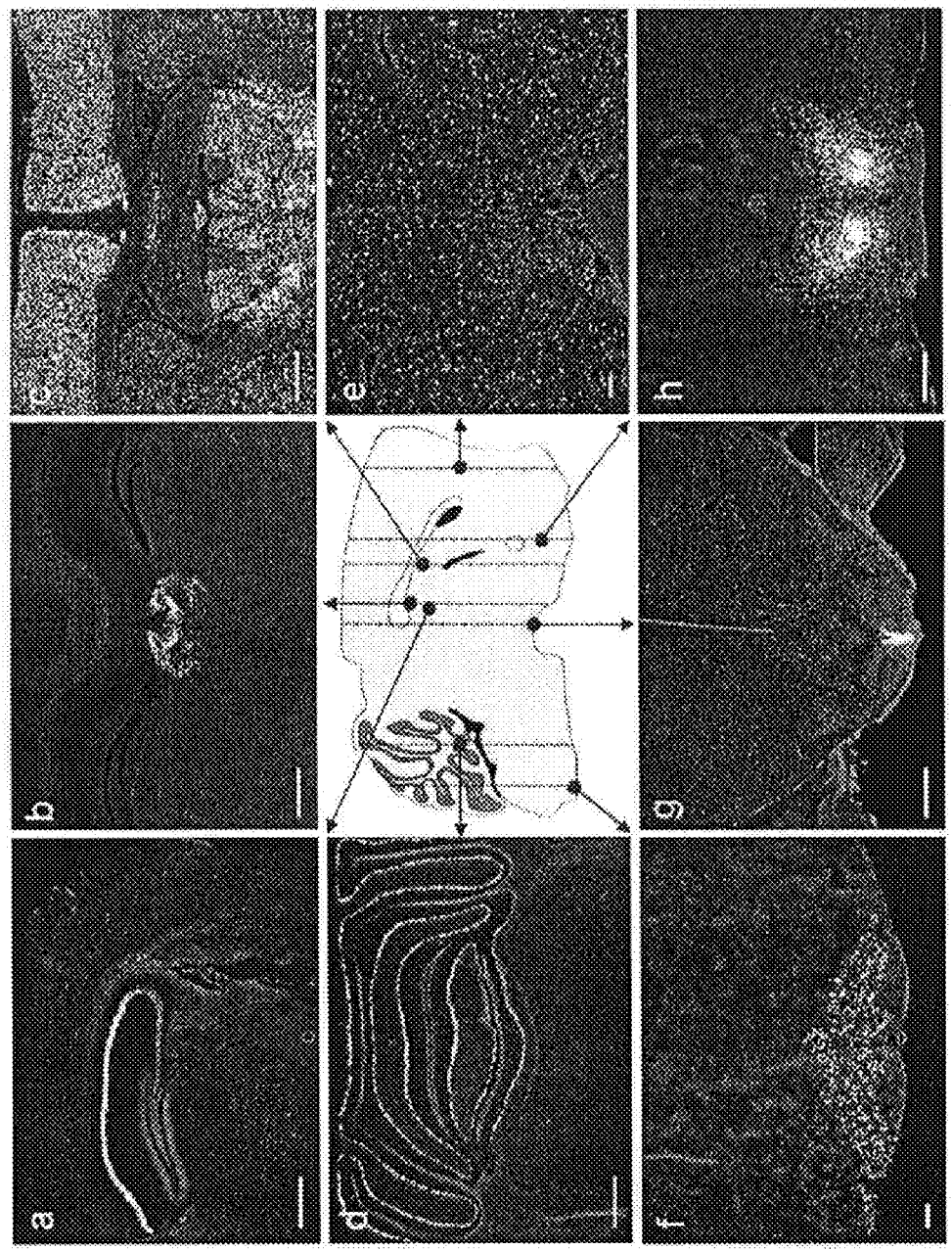
FIGS. 5A-5H are representative in situ hybridization photomicrographs of GPCR expression in the mouse brain.

FIG. 5 presents different expression patterns for GPCRs in the brain that are illustrative, but not totally inclusive, of those observed. One pattern is exemplified by PGR15, which was highly expressed in numerous subregions of the hypothalamus, with much less specific labeling noted in the adjacent thalamus or striatum (FIG. 5H). Other GPCRs, such as PGR7, were highly expressed in a single nucleus or region, with relatively little signal observed elsewhere (FIG. 5B). In contrast, several orphan receptors were widely distributed throughout the brain, but with highest levels noted in specific regions. For example, GPR63 was robustly expressed both in the pyramidal cells of the hippocampus (FIG. 5A) and in the Purkinje cell layer of the cerebellum (FIG. 5D). Other orphan receptors exhibited a non-localized profile. For instance, GRCA was distributed in nearly every neuronal region in the entire brain, while the white matter regions containing processes were conspicuously devoid of GRCA mRNA (FIG. 5C). In contrast, the orphan gene GPR37 was diffusely expressed in scattered cells from the frontal cortex (FIG. 5E) to the medulla, in both white and gray matter, suggesting a glial cell distribution. A number of GPCRs were prominently expressed in circumventricular organs, the choroid plexus, and the ependymal cells of the ventricles, areas involved in chemical communication between the brain and periphery. This pattern is exemplified by GPR50, found at very high levels in virtually all cells lining the ventral portion of the third ventricle (FIG. 5G).

The in situ hybridization analyses demonstrate that the expression of GPCRs in the brain is even more diverse than could be revealed by RT-PCR profiling. In addition to confirming the results obtained by RT-PCR for different brain regions, these studies reveal that GPCRs are expressed in diverse patterns within those regions, further highlighting the involvement of combinations of GPCRs in different functions.

Modulators of GPCRs for Use in the Treatment or Prevention of Neurological and Metabolic Diseases and Disorders The methods of the present invention may be practiced using a variety of different compounds that modulate the expression or activity of one or more GPCRs ("modulators"), which are described herein below with reference to certain US patents, published International PCT Patent Applications, texts and scientific journals, each of which is hereby specifically incorporated by reference in its entirety whether or not so specified. In particular embodiments, a GPCR modulator modulates the expression or activity of GPR88, GPR22, or one or more SREBs.

In particular embodiments, modulators are polynucleotides, polypeptides, peptides, peptide nucleic acids, antibodies and fragments thereof, viruses, small molecules, inorganic compounds and organic compounds. Examples of modulators that increase GPCR expression include GPCR polypeptides and polynucleotides, such as transgenes and expression vectors. Examples of modulators that decrease GPCR expression include, e.g., knockout constructs, GPCR antisense RNA, GPCR-directed microRNA, and GPCR RNAi molecules. Examples of modulators that decrease GPCR activity include compounds that interfere with GPCR binding to a ligand or inhibit downstream signaling events, such as antagonist antibodies to a GPCR. Examples of modulators that increase GPCR activity include compounds that enhance GPCR binding to a ligand or promote downstream signaling events, such as agonist antibodies to a GPCR.

1. Polypeptides and Polynucleotides

In certain embodiments, methods of the invention are practiced using peptide or polypeptide modulators of a GPCR. In certain embodiments, the modulator is a peptide or polypeptide comprising an amino acid sequence identical to or substantially identical to a portion of a GPCR, including human and other GPCRs. The amino acid sequences of human SREBs is provided in SEQ ID NOs:1 (SREB2), 3 (SREB1), and 5 (SREB3). The amino acid sequences of human GPR88 and human GPR22 are provides in SEQ ID NOs:13 and 17, respectively. Thus, in certain embodiments, the polypeptide modulator may be a fragment of a GPCR, and preferably a functional fragment, which has one or more biological activities in common with a full length GPCR, e.g., binding to a ligand or stimulation of a downstream signaling pathway.

Peptides and polypeptides may be readily synthesized or produced recombinantly using routine methods known and available in the art. For example, GPCR polynucleotides can be used as a tool to express a GPCR polypeptide in an appropriate cell in vitro or in vivo (gene therapy). Methods well known to those skilled in the art may be used to construct expression vectors containing sequences encoding a polynucleotide or polypeptide of interest and appropriate transcriptional and translational control elements. These methods include in vitro recombinant DNA techniques, synthetic techniques, and in vivo genetic recombination. Such techniques are described, for example, in Sambrook, J. et al. (1989) Molecular Cloning, A Laboratory Manual, Cold Spring Harbor Press, Plainview, N.Y., and Ausubel, F. M. et al. (1989) Current Protocols in Molecular Biology, John Wiley & Sons, New York. N.Y., and in further detail below.

In one embodiment, GPCR expression is increased using an expression construct that expresses a full length GPCR, or a functional variant or fragment thereof. In various embodiments, the expression construct is adapted for transient expression in a cell, while in other embodiments, the expression construct is adapted for stable expression in a cell. Accordingly, in certain embodiments, the expression construct may be a plasmid or virus.

In another embodiment, GPCR expression is increased by inserting a transgene into an animal. A variety of vectors and constructs suitable for introducing a transgene into an animal's genome have been described and demonstrated to successfully deliver therapeutic levels of a polypeptide to a cell.

In one embodiment, expression constructs of the invention comprise polynucleotide sequences encoding all or a region of a modulator, in addition to regulatory sequences that govern expression of coding sequences. Regulatory sequences present in an expression vector include those non-translated regions of the vector, e.g., enhancers, promoters, 5' and 3' untranslated regions, which interact with host cellular proteins to carry out transcription and translation. Such elements may vary in their strength and specificity. Depending on the vector system and cell utilized, any number of suitable transcription and translation elements, including constitutive and inducible promoters, may be used. A variety of expression systems may be employed for the recombinant production of polypeptides, including, e.g., baculovirus, herpes virus, adenovirus, adeno-associated virus, bacterial systems, and eukaryotic systems such as CHO cells. Naked DNA and DNA-liposome complexes can also be used. In particular embodiments, polynucleotides and polypeptides may be introduced into cells in plasmid DNA vectors, viral DNA vectors (such as adenovirus or adeno-associated vectors), or viral RNA vectors (such as retroviral, semliki forest virus, sindbis virus vectors).

In another embodiment, the activity of a GPCR is altered by over expression of a dominant negative inhibitor of a GPCR. Dominant negative inhibitors of GPCRs are typically mutant forms of a GPCR, which reduce or block the activity of wild type GPCR, e.g., by competing for binding to a ligand but failing to fully activate the GPCR signaling pathway. In one embodiment, the dominant negative is a soluble ligand binding domain of a GPCR.

Polypeptide inhibitors also include other variants and fragments of GPCRs having reduced biological activity as compared to wild type GPCRs. One example of a mutant GPCR inhibitor is a GPCR in which a region that binds a ligand is mutated, so that it has reduced binding ability. One example of an inhibitor is a soluble fragment of a GPCR that includes a GPCR extracellular domain and is capable of binding to ligand. Extracellular regions of GPCRs can be predicted based upon the conserved structure of GPCRs.

Examples of peptide modulators of GPCR receptors exhibit the following primary structures: GLGPRPLRFamide, GNSFLRFamide, GGPQGPLRFamide, GPSGPLRFamide, PDVDHVFLRFamide, and pyro-EDVDHVFLRFamide.

Various polynucleotides are contemplated for use as modulators of GPCR expression and/or activity. In one embodiment, a polynucleotide encoding a GPCR or a functional variant or fragment thereof is used to increase GPCR expression, essentially as described above. The polynucleotide sequence of human SREBs is provided in SEQ ID NOs:2 (SREB2), 4 (SREB1), and 6 (SREB3). The polynucleotide sequence of human GPR88 and human GPR22 are provided in SEQ ID NOs:14 and 18, respectively. In certain embodiments, polynucleotides include expression vectors and replacement or insertion vectors designed for integration into the genome of a cell, and suitable for gene therapy, e.g., transgenes, or disruption of one or more alleles, e.g., knockout constructs.

In certain embodiments, polynucleotide inhibitors of GPCR s are double-stranded or single-stranded DNA or RNA, including, e.g., antisense RNA, ribozymes, or RNA interference reagents designed to specifically target a GPCR polynucleotide, according to methods known and available in the art. Polynucleotide inhibitors may also be DNA-RNA hybrids. Other polynucleotide inhibitors include, e.g., targeting vectors designed for integration into the genome and suitable for deleting all or a portion of a GPCR allele or mutating a GPCR allele, e.g., through insertional mutagenesis.

In one embodiment, a GPCR inhibitor is an antisense RNA directed to a GPCR polynucleotide, or other components of the signaling cascade. Antisense oligonucleotides have been demonstrated to be effective and targeted inhibitors of protein synthesis, and, consequently, can be used to specifically inhibit protein synthesis by a targeted gene. The efficacy of antisense oligonucleotides for inhibiting protein synthesis is well established. For example, the synthesis of polygalactauronase and the muscarine type 2 acetylcholine receptor are inhibited by antisense oligonucleotides directed to their respective mRNA sequences (U.S. Pat. No. 5,739,119 and U.S. Pat. No. 5,759,829). Further, examples of antisense inhibition have been demonstrated with the nuclear protein cyclin, the multiple drug resistance gene (MDG1), ICAM-1, E-selectin, STK-1, striatal $GABA_A$ receptor and human EGF (Jaskulski et al., Science. 1988 Jun. 10; 240(4858):1544-6; Vasanthakumar and Ahmed, Cancer Commun. 1989; 1(4): 225-32; Peris et al., Brain Res Mol Brain Res. 1998 Jun. 15; 57(2):310-20; U.S. Pat. No. 5,801,154; U.S. Pat. No. 5,789, 573; U.S. Pat. No. 5,718,709 and U.S. Pat. No. 5,610,288). Furthermore, antisense constructs have also been described that inhibit and can be used to treat a variety of abnormal cellular proliferations, e.g. cancer (U.S. Pat. No. 5,747,470; U.S. Pat. No. 5,591,317 and U.S. Pat. No. 5,783,683).

Therefore, in certain embodiments, the present invention relates to methods of providing oligonucleotide sequences that comprise all, or a portion of, any sequence that is capable of specifically binding to a GPCR target polynucleotide sequence, or a complement thereof. In another embodiment, the oligonucleotide sequence comprises all, or a portion of a GPCR polynucleotide sequence set forth in any one of SEQ ID NOs:2, 4, 6, 14, or 18, or a complement thereof. In one embodiment, the antisense oligonucleotide comprises DNA or derivatives thereof. In another embodiment, the oligonucleotide comprises RNA or derivatives thereof. The antisense oligonucleotides may be modified DNAs comprising a phosphorothioated modified backbone. Also, the oligonucleotide sequences may comprise peptide nucleic acids or derivatives thereof. In each case, preferred compositions comprise a sequence region that is complementary, and more preferably, completely complementary to one or more portions of a GPCR target gene or polynucleotide sequence.

Methods of producing antisense molecules are known in the art and can be readily adapted to produce an antisense molecule that targets a GPCR. Selection of antisense compositions specific for a given sequence is based upon analysis of the chosen target sequence and determination of secondary structure, $T_m$, binding energy, and relative stability. Antisense compositions may be selected based upon their relative inability to form dimers, hairpins, or other secondary structures that would reduce or prohibit specific binding to the target mRNA in a host cell. Highly preferred target regions of the mRNA include those regions at or near the AUG translation initiation codon and those sequences that are substantially complementary to 5' regions of the mRNA. These secondary structure analyses and target site selection considerations can be performed, for example, using v.4 of the OLIGO primer analysis software (Molecular Biology Insights) and/or the BLASTN 2.0.5 algorithm software (Altschul et al., Nucleic Acids Res. 1997, 25(17):3389-402).

According to another embodiment of methods of the invention, ribozyme molecules are used to inhibit expression of a GPCR target gene or polynucleotide sequence. Ribozymes are RNA-protein complexes having specific catalytic domains that possess endonuclease activity (Kim and Cech, Proc Natl Acad Sci USA. 1987 December; 84(24):8788-92; Forster and Symons, Cell. 1987 Apr. 24; 49(2):211-20). For example, a large number of ribozymes accelerate phosphoester transfer reactions with a high degree of specificity, often cleaving only one of several phosphoesters in an oligonucleotide substrate (Cech et al., Cell. 1981 December; 27(3 Pt 2):487-96; Michel and Westhof, J Mol Biol. 1990 Dec. 5; 216(3):585-610; Reinhold-Hurek and Shub, Nature. 1992 May 14; 357(6374):173-6). This specificity has been attributed to the requirement that the substrate bind via specific base-pairing interactions to the internal guide sequence ("IGS") of the ribozyme prior to chemical reaction.

At least six basic varieties of naturally-occurring enzymatic RNAs are known presently. Each can catalyze the hydrolysis of RNA phosphodiester bonds in trans (and thus can cleave other RNA molecules) under physiological conditions. In general, enzymatic nucleic acids act by first binding to a target RNA. Such binding occurs through the target binding portion of a enzymatic nucleic acid which is held in close proximity to an enzymatic portion of the molecule that acts to cleave the target RNA. Thus, the enzymatic nucleic acid first recognizes and then binds a target RNA through complementary base-pairing, and once bound to the correct site, acts enzymatically to cut the target RNA. Strategic cleavage of such a target RNA will destroy its ability to direct synthesis of an encoded protein. After an enzymatic nucleic acid has bound and cleaved its RNA target, it is released from that RNA to search for another target and can repeatedly bind and cleave new targets.

The enzymatic nucleic acid molecule may be formed in a hammerhead, hairpin, a hepatitis δ virus, group I intron or RNaseP RNA (in association with an RNA guide sequence) or Neurospora VS RNA motif, for example. Specific examples of hammerhead motifs are described by Rossi et al. Nucleic Acids Res. 1992 Sep. 11; 20(17):4559-65. Examples of hairpin motifs are described by Hampel et al. (Eur. Pat. Appl. Publ. No. EP 0360257), Hampel and Tritz, Biochemistry 1989 Jun. 13; 28(12):4929-33; Hampel et al., Nucleic Acids Res. 1990 Jan. 25; 18(2):299-304 and U.S. Pat. No. 5,631,359. An example of the hepatitis δ virus motif is described by Perrotta and Been, Biochemistry. 1992 Dec. 1; 31(47):11843-52; an example of the RNaseP motif is described by Guerrier-Takada et al., Cell. 1983 December; 35(3 Pt 2):849-57; Neurospora VS RNA ribozyme motif is described by Collins (Saville and Collins, Cell. 1990 May 18; 61(4):685-96; Saville and Collins, Proc Natl Acad Sci USA. 1991 Oct. 1; 88(19):8826-30; Collins and Olive, Biochemistry. 1993 Mar. 23; 32(11):2795-9); and an example of the Group I intron is described in U.S. Pat. No. 4,987,071. Important characteristics of enzymatic nucleic acid molecules used according to the invention are that they have a specific substrate binding site which is complementary to one or more of the target gene DNA or RNA regions, and that they have nucleotide sequences within or surrounding that substrate binding site which impart an RNA cleaving activity to the molecule. Thus the ribozyme constructs need not be limited to specific motifs mentioned herein.

Methods of producing a ribozyme targeted to a GPCR are known in the art. Ribozymes may be designed as described in Int. Pat. Appl. Publ. No. WO 93/23569 and Int. Pat. Appl. Publ. No. WO 94/02595, each specifically incorporated herein by reference, and synthesized to be tested in vitro and in vivo, as described therein.

Ribozyme activity can be optimized by altering the length of the ribozyme binding arms or chemically synthesizing ribozymes with modifications that prevent their degradation by serum ribonucleases (see e.g., Int. Pat. Appl. Publ. No. WO 92/07065; Int. Pat. Appl. Publ. No. WO 93/15187; Int. Pat. Appl. Publ. No. WO 91/03162; Eur. Pat. Appl. Publ. No. 92110298.4; U.S. Pat. No. 5,334,711; and Int. Pat. Appl. Publ. No. WO 94/13688, which describe various chemical modifications that can be made to the sugar moieties of enzymatic RNA molecules), modifications which enhance their efficacy in cells, and removal of stem II bases to shorten RNA synthesis times and reduce chemical requirements.

RNA interference methods using RNAi molecules also may be used to disrupt the expression of a gene or polynucleotide of interest, including a GPCR gene or another gene associated with a GPCR signaling cascade. While the first described RNAi molecules were RNA:RNA hybrids comprising both an RNA sense and an RNA antisense strand, it has now been demonstrated that DNA sense:RNA antisense hybrids, RNA sense:DNA antisense hybrids, and DNA:DNA hybrids are capable of mediating RNAi (Lamberton, J. S. and Christian, A. T., (2003) Molecular Biotechnology 24:111-119). Accordingly, the invention includes the use of RNAi reagents comprising any of these different types of double-stranded molecules. In addition, it is understood that RNAi reagents may be used and introduced to cells in a variety of forms. Accordingly, as used herein, RNAi reagents encompasses any and all reagents capable of inducing an RNAi response in cells, including, but not limited to, double-stranded polynucleotides comprising two separate strands, i.e. a sense strand and an antisense strand, polynucleotides comprising a hairpin loop of complementary sequences, which forms a double-stranded region, e.g., shRNAi molecules, and expression vectors that express one or more polynucleotides capable of forming a double-stranded polynucleotide alone or in combination with another polynucleotide.

In one particular embodiment, a dsRNA molecule that targets and induces degradation of a GPCR polynucleotide is introduced to a cell. While the exact mechanism is not essential to the invention, it is believed the association of the dsRNA to the target gene is defined by the homology between the dsRNA and the actual and/or predicted mRNA transcript. It is believed that this association will affect the ability of the dsRNA to disrupt the target gene. DsRNA methods and reagents are described in PCT applications WO 99/32619, WO 01/68836, WO 01/29058, WO 02/44321, WO 01/92513, WO 01/96584, and WO 01/75164, which are hereby incorporated by reference in their entirety.

In one embodiment of the invention, RNA interference (RNAi) may be used to specifically inhibit expression of a GPCR. Double-stranded RNA-mediated suppression of gene and nucleic acid expression may be accomplished according to the invention by introducing dsRNA, siRNA or shRNA into cells or organisms. SiRNA may be double-stranded RNA, or a hybrid molecule comprising both RNA and DNA, e.g., one RNA strand and one DNA strand. It has been demonstrated that the direct introduction of siRNAs to a cell can trigger RNAi in mammalian cells (Elshabir, S. M., et al. Nature 411:494-498 (2001)). Furthermore, suppression in mammalian cells occurred at the RNA level and was specific for the targeted genes, with a strong correlation between RNA and protein suppression (Caplen, N. et al., Proc. Natl. Acad. Sci. USA 98:9746-9747 (2001)). In addition, it was shown that a wide variety of cell lines, including HeLa S3, COS7, 293, NIH/3T3, A549, HT-29, CHO-KI and MCF-7 cells, are susceptible to some level of siRNA silencing (Brown, D. et al. TechNotes 9(1):1-7, available at http://www.dot.ambion.dot.com/techlib/tn/91/912.html (9/1/02)).

RNAi reagents targeting a GPCR can be readily prepared according to procedures known in the art. Structural characteristics of effective siRNA molecules have been identified. Elshabir, S. M. et al. (2001) Nature 411:494-498 and Elshabir, S. M. et al. (2001), EMBO 20:6877-6888. Accordingly, one of skill in the art would understand that a wide variety of different siRNA molecules may be used to target a specific gene or transcript. In certain embodiments, siRNA molecules according to the invention are 16-30 or 18-25 nucleotides in length, including each integer in between. In one embodiment, an siRNA is 21 nucleotides in length. In certain embodiments, siRNAs have 0-7 nucleotide 3' overhangs or 0-4 nucleotide 5' overhangs. In one embodiment, an siRNA molecule has a two nucleotide 3' overhang. In one embodiment, an siRNA is 21 nucleotides in length with two nucleotide 3' overhangs (i.e. they contain a 19 nucleotide complementary region between the sense and antisense strands). In certain embodiments, the overhangs are UU or dTdT 3' overhangs. Generally, siRNA molecules are completely complementary to one strand of a target DNA molecule, since even single base pair mismatches have been shown to reduce silencing. In other embodiments, siRNAs may have a modified backbone composition, such as, for example, 2'-deoxy or 2'-O-methyl modifications. However, in preferred embodiments, the entire strand of the siRNA is not made with either 2' deoxy or 2'-O-modified bases.

In one embodiment, siRNA target sites are selected by scanning the target mRNA transcript sequence for the occurrence of AA dinucleotide sequences. Each AA dinucleotide sequence in combination with the 3' adjacent approximately 19 nucleotides are potential siRNA target sites. In one embodiment, siRNA target sites are preferentially not located within the 5' and 3' untranslated regions (UTRs) or regions near the start codon (within approximately 75 bases), since proteins that bind regulatory regions may interfere with the binding of the siRNP endonuclease complex (Elshabir, S. et al. Nature 411:494-498 (2001); Elshabir, S. et al. EMBO J. 20:6877-6888 (2001)). In addition, potential target sites may be compared to an appropriate genome database, such as BLASTN 2.0.5, available on the NCBI server at www.ncbi.nlm, and potential target sequences with significant homology to other coding sequences eliminated.

Short hairpin RNAs may also be used to inhibit or knockdown gene or nucleic acid expression according to the invention. Short Hairpin RNA (shRNA) is a form of hairpin RNA capable of sequence-specifically reducing expression of a target gene. Short hairpin RNAs may offer an advantage over siRNAs in suppressing gene expression, as they are generally more stable and less susceptible to degradation in the cellular environment. It has been established that such short hairpin RNA-mediated gene silencing (also termed SHAGging) works in a variety of normal and cancer cell lines, and in mammalian cells, including mouse and human cells. Paddison, P. et al., Genes Dev. 16(8):948-58 (2002). Furthermore, transgenic cell lines bearing chromosomal genes that code for engineered shRNAs have been generated. These cells are able to constitutively synthesize shRNAs, thereby facilitating long-lasting or constitutive gene silencing that may be passed on to progeny cells. Paddison, P. et al., Proc. Natl. Acad. Sci. USA 99(3):1443-1448 (2002).

ShRNAs contain a stem loop structure. In certain embodiments, they may contain variable stem lengths, typically from 19 to 29 nucleotides in length, or any number in between. In certain embodiments, hairpins contain 19 to 21 nucleotide stems, while in other embodiments, hairpins contain 27 to 29 nucleotide stems. In certain embodiments, loop size is between 4 to 23 nucleotides in length, although the loop size may be larger than 23 nucleotides without significantly affecting silencing activity. ShRNA molecules may contain mismatches, for example G-U mismatches between the two strands of the shRNA stem without decreasing potency. In fact, in certain embodiments, shRNAs are designed to include one or several G-U pairings in the hairpin stem to stabilize hairpins during propagation in bacteria, for example. However, complementarity between the portion of the stem that binds to the target mRNA (antisense strand) and the mRNA is typically required, and even a single base pair mismatch is this region may abolish silencing. 5' and 3' overhangs are not required, since they do not appear to be critical for shRNA function, although they may be present (Paddison et al. (2002) Genes & Dev. 16(8):948-58).

In certain embodiments, the activity of a GPCR is altered is by mutating a gene encoding the GPCR molecule or a gene encoding another component of the GPCR biological pathway. A variety of methods of mutating an endogenous gene are known and available in the art, including, e.g., insertional mutagenesis and knockout methods, such as those described herein. Accordingly, the invention includes methods of knocking out one or more alleles of a GPCR gene. It is understood that knockout vectors according to the invention include any vector capable of disrupting expression or activity of a GPCR gene, including, in certain embodiments, both gene trap and targeting vectors.

In preferred methods, targeting vectors are used to selectively disrupt one or more GPCR genes. Knockout vectors of the invention include those that alter gene expression, for example, by disrupting a regulatory element of GPCR gene, including, e.g., inserting a regulatory element that reduces gene expression or deleting or otherwise reducing the activity of an endogenous element that positively affects transcription of the target gene. In other embodiments, knockout vectors of the invention disrupt, e.g., delete or mutate, the 5' region, 3' region or coding region of a GPCR gene. In some embodiments, knockout vectors delete a region or the entirety of the coding region of a GPCR gene. In certain embodiments, knockout vectors delete a region of a GPCR gene, while in other embodiments, they insert exogenous sequences into a GPCR gene. In addition, in certain embodiments, including those using replacement vectors, knockout vectors both remove a region of a gene and introduce an exogenous sequence.

Targeting vectors of the invention include all vectors capable of undergoing homologous recombination with an endogenous GPCR gene, including replacement vectors. Targeting vectors include all those used in methods of positive selection, negative selection, positive-negative selection, and positive switch selection. Targeting vectors employing positive, negative, and positive-negative selection are well known in the art and representative examples are described in Joyner, A. L., Gene Targeting: A practical Approach, 2nd ed. (2000) and references cited therein.

2. Polypeptide Expression and Purification

Recombinant GPCR polypeptides may be produced using standard techniques known in the art. Such recombinant GPCR polypeptides are, for example, useful in in vitro assays for identifying therapeutic compounds.

Accordingly, the present invention relates to expression systems that include a polynucleotide of the present invention, host cells that are genetically engineered with such expression systems, and production of polypeptides of the invention by recombinant techniques. Cell-free translation systems can also be employed to produce such proteins using RNAs derived from the DNA constructs of the present invention.

For recombinant production, host cells can be genetically engineered to incorporate expression systems or portions thereof for any polynucleotide of the present invention. Polynucleotides may be introduced into host cells by methods described in standard laboratory manuals. Preferred methods of introducing polynucleotides into host cells include, for instance, calcium phosphate transfection, DEAE-dextran mediated transfection, transvection, microinjection, cationic lipid-mediated transfection, electroporation, transduction, ballistic introduction, infection or fusion with carriers such as liposomes, micelles, ghost cells, and protoplasts.

A great variety of expression systems can be used. These include, without limitation, chromosomal, episomal, and virus-derived systems such as vector derived bacterial plasmids, bacteriophage, transposons, yeast episomes, insertion elements, yeast chromosomal elements, viruses (such as baculoviruses, papova viruses, such as SV40, vaccinia viruses, adenoviruses, fowl pox viruses, pseudorabies viruses, and retroviruses), and vectors derived from combinations thereof, such as those derived from plasmid and bacteriophage genetic elements, such as cosmids and phagemids. Preferred expression vectors include, but are not limited to, pcDNA3 (Invitrogen) and pSVL (Pharmacia Biotech). Other expression vectors include, but are not limited to, pSPORT™ vectors, pGEM™ vectors (Promega), pPROEXvectors™ (LTI, Bethesda, Md.), Bluescript™ vectors (Stratagene), pQE™ vectors (Qiagen), pSE420™ (Invitrogen), and pYES2™ (Invitrogen). The expression systems may contain control regions that regulate as well as engender expression. Generally, any system or vector that is able to maintain, propagate, or express a polynucleotide to produce a polypeptide in a host may be used. The appropriate polynucleotide may be inserted into an expression system by any of a variety of well-known and routine techniques, including transformation, transfection, electroporation, nuclear injection, or fusion with carriers such as liposomes, micelles, ghost cells, and protoplasts. Expression systems of the invention include bacterial, yeast, fungal, plant, insect, invertebrate, vertebrate, and mammalian cells systems.

If a eukaryotic expression vector is employed, then the appropriate host cell would be any eukaryotic cell capable of expressing the cloned sequence. Preferably, eukaryotic cells are cells of higher eukaryotes. Suitable eukaryotic cells include, but are not limited to, non-human mammalian tissue culture cells and human tissue culture cells. Preferred host cells include, but are not limited to, insect cells, HeLa cells, Chinese hamster ovary cells (CHO cells), African green monkey kidney cells (COS cells), human 293 cells, murine embryonal stem (ES) cells and murine 3T3 fibroblasts. Propagation of such cells in cell culture has become a routine procedure (see, Tissue Culture, Academic Press, Kruse and Patterson, eds. (1973), which is incorporated herein by reference in its entirety). In addition, a yeast host may be employed as a host cell. Preferred yeast cells include, but are not limited to, the genera, *Saccharomyces, Pichia*, and *Kluveromyces*. Preferred yeast hosts are *S. cerevisiae* and *P. pastoris*. Preferred yeast vectors can contain an origin of replication sequence from a 2T yeast plasmid, an autonomously replication sequence (ARS), a promoter region, sequences for polyadenylation, sequences for transcription termination, and a selectable marker gene. Shuttle vectors for replication in both yeast and *E. coli* are also included herein.

Alternatively, insect cells may be used as host cells. In a preferred embodiment, the polypeptides of the invention are expressed using a baculovirus expression system (see, Luckow et al., BioTechnology, 1988, 6. and Baculovirus Expression Vectors: A Laboratory Manual, O'Rielly et al. (Eds.), W.H. Freeman and Company, New York, 1992, each of which is incorporated herein by reference in its entirety). In addition, the Bac-to-Bac™ complete baculovirus expression system (Invitrogen) can, for example, be used for production in insect cells.

Expression of proteins in prokaryotes is most often carried out in *E. coli* with vectors containing constitutive or inducible promoters directing the expression of either fusion or non-fusion proteins. Fusion vectors add a number of amino acids to a protein encoded therein, usually to the amino terminus of the recombinant protein. Such fusion vectors typically serve three purposes: 1) to increase expression of recombinant protein; 2) to increase the solubility of the recombinant protein; and 3) to aid in the purification of the recombinant protein by acting as a ligand in affinity purification. Often, in fusion expression vectors, a proteolytic cleavage site is introduced at the junction of the fusion moiety and the recombinant protein to enable separation of the recombinant protein from the fusion moiety subsequent to purification of the fusion protein. Such enzymes, and their cognate recognition sequences, include Factor Xa, thrombin and enterokinase.

Typical fusion expression vectors include pGEX (Pharmacia Biotech Inc; Smith, D. B. and Johnson, K. S. (1988) Gene 67:31-40), pMAL (New England Biolabs, Beverly, Mass.) and pRIT5 (Pharmacia, Piscataway, N.J.) which fuse glutathione S-transferase (GST), maltose E binding protein, or protein A, respectively, to the target recombinant protein.

If a polypeptide of the present invention is to be expressed for use in screening assays, it maybe produced at the surface of the cell. In this event, the cells may be harvested prior to use in the screening assay. If the polypeptide is secreted into the medium, the medium can be recovered in order to recover and purify the polypeptide. If produced intracellularly, the cells must first be lysed before the polypeptide is recovered.

Polypeptides of the present invention can be recovered and purified from recombinant cell cultures by well-known methods including ammonium sulfate or ethanol precipitation, acid extraction, anion or cation exchange chromatography, phosphocellulose chromatography, hydrophobic interaction chromatography, affinity chromatography, hydroxyapatite chromatography and lectin chromatography. Most preferably, high performance liquid chromatography is employed for purification. Well-known techniques for refolding proteins may be employed to regenerate active conformation when the polypeptide is denatured during intracellular synthesis, isolation, and/or purification.

Recombinant GPCR polypeptides (or alternatively, GPCR polypeptides isolated from an organism) may be targeted to the cell membrane. Membrane bound GPCR can be prepared by expressing the GPCR in a suitable cell or cell line, e.g., *Pichia pastoris* cells, oocytes, or COS cells. Membranes containing the recombinant polypeptide may then be isolated from other cellular components by standard methods known in the art.

In certain embodiments, recombinant expression of GPR85 or other GPCR encoding polynucleotide listed in Table 1 is expressed in a suitable host cell using a suitable expression vector by standard genetic engineering techniques. For example, the GPR85 is subcloned into the commercial expression vector pcDNA3.1 (Invitrogen, San Diego, Calif.) and transfected into Chinese Hamster Ovary (CHO) cells using the transfection reagent FuGENE6 (Boehringer-Mannheim) and the transfection protocol provided in the product insert. Other eukaryotic cell lines, including human embryonic kidney (HEK293) and COS cells, are suitable as well. Cells stably expressing GPCR are selected by growth in the presence of 100 μg/ml zeocin (Stratagene, LaJolla, Calif.). Optionally, GPR85 may be purified from the cells using standard chromatographic techniques. To facilitate purification, antisera, is raised against one or more synthetic peptide sequences that correspond to portions of the GPR85 amino acid sequence, and the antisera is used to affinity purify GPCR. GPR85 also may be expressed in-frame with a tag sequence (e.g., polyhistidine, hemagluttinin, FLAG) to facilitate purification. Moreover, it will be appreciated that many of the uses for GPCR polypeptides, such as assays described below, do not require purification of GPCR from the host cell.

In one embodiment, for expression of GPCR polypeptides in mammalian cells HEK293 (transformed human, primary embryonic kidney cells), a plasmid bearing the relevant GPCR coding sequence is prepared (Table 1), using vector pcDNA3.1 (Invitroen). The forward primer for amplification of this GPCR cDNA is determined by routine procedures and preferably contains a 5' extension of nucleotides to introduce the HindIII cloning site and nucleotides matching the GPCR sequence. The reverse primer is also determined by routine procedures and preferably contains a 5' extension of nucleotides to introduce an XbaI restriction site for cloning and nucleotides corresponding to the reverse complement of the GPCR sequence. The PCR product is gel purified and cloned into the HindIII-XbaI sites of the vector.

The expression vector containing the GPCR gene is purified using Qiagen chromatography columns and transfected into 293 cells using DOTAP™ transfection media (Bochringer Mannheim, Indianapolis, Ind.). Transiently transfected cells are tested for expression after 24 hours of transfection, using western blots probed with anti-His and anti-GPCR peptide antibodies. Permanently transfected cells are selected with Zeocin and propagated. Production of the recombinant protein is detected from both cells and media by western blots probed with anti-His, or anti-GPCR peptide antibodies.

In another embodiment, for expression of the GPCR in COS7 cells, a polynucleotide molecule having a sequence selected from the group consisting of polynucleotide sequences listed in Table 1, can be cloned into vector p3-Cl. This vector is a pUC18-derived plasmid that contains the HCMV (human cytomegalovirus) promoter-intron located upstream from the bGH (bovine growth hormone) polyadenylation sequence and a multiple cloning site. In addition, the plasmid contains the DHRF (dihydrofolate reductase) gene which provides selection in the presence of the drug methotrexane (MTX) for selection of stable transformants.

The forward primer is determined by routine procedures and preferably contains a 5' extension which introduces an XbaI restriction site for cloning, followed by nucleotides which correspond to a sequence selected from the group consisting of sequences listed in Table 1. The reverse primer is also determined by routine procedures and preferably contains 5' extension of nucleotides which introduces a restriction cloning site followed by nucleotides which correspond to the reverse complement of a sequence selected from the group consisting of sequences listed in Table 1. The PCR reaction is performed as described in the manufactures instructions. The PCR product is gel purified and ligated into the p3-C1 vector. This construct is transformed into *E. coli* cells for amplification and DNA purification. The expression vector containing the GPCR polynucleotide sequence is purified with Qiagen chromatography columns and transfected into COS 7 cells using Lipofectamine™ reagent from BRL, following the manufacturer's protocols. Forty-eight and 72 hours after transfection, the media and the cells are tested for recombinant protein expression. GPCR expressed from a COS cell culture can be purified by concentrating the cell-growth media to about 10 mg of protein/ml, and purifying the protein by chromatography.

In a further embodiment, for expression of GPCR in insect cells, e.g., for expression of GPCR in a baculovirus system, a polynucleotide molecule having a sequence selected from the group consisting of sequences listed in Table 1, can be amplified by PCR. The forward primer is determined by routine procedures and preferably contains a 5' extension which adds the NdeI cloning site, followed by nucleotides which correspond to a sequence selected from the group consisting of sequences listed in Table 1. The reverse primer is also determined by routine procedures and preferably contains a 5' extension which introduces the KpnI cloning site, followed by nucleotides which correspond to the reverse complement of a sequence selected from the group consisting of sequences listed in Table 1.

The PCR product is gel purified, digested with NdeI and KpnI, and cloned into the corresponding sites of vector pACHTL-A (Pharmingen, San Diego, Calif.). The pAcHTL-A expression vector contains the strong polyhedrin promoter of the *Autographa californica* nuclear polyhedrosis virus (AcMNPV), and a 6×His tag upstream from the multiple cloning site. A protein kinase site for phosphorylation and a thrombin site for excision of the recombinant protein precede the multiple cloning site is also present. Of course, many other baculovirus vectors could be used in place of pAcHTL-A, such as pAc373, pVL941 and pAcIML. Other suitable vectors for the expression of GPCR polypeptides can be used, provided that the vector construct includes appropriately located signals for transcription, translation, and trafficking, such as an in-frame AUG and a signal peptide, as required. Such vectors are described in Luckow et al., Virology 170:31-39, among others. The virus is grown and isolated using standard baculovirus expression methods, such as those described in Summers et al. (A Manual of Methods for Baculovirus Vectors and Insect Cell Culture Procedures, Texas Agricultural Experimental Station Bulletin No. 1555 (1987));

In a preferred embodiment, pAcHLT-A containing a GPCR gene is introduced into baculovirus using the "BaculoGold™" transfection kit (Pharmingen, San Diego, Calif.) using methods established by the manufacturer. Individual virus isolates are analyzed for protein production by radiolabeling infected cells with 35S-methionine at 24 hours post infection. Infected cells are harvested at 48 hours post infection, and the labeled proteins are visualized by SDS-PAGE.

Viruses exhibiting high expression levels can be isolated and used for scaled up expression.

In one embodiment, for expression of a GPCR polypeptide in a Sf9 cells, a polynucleotide molecule having a sequence selected from the group consisting of sequences listed in Table 1, can be amplified by PCR using the primers and methods described above for baculovirus expression. The GPCR cDNA is, cloned into vector pAcHLT-A (Pharmingen) for expression in Sf9 insect cells. The insert is cloned into the NdeI and KpnI sites, after elimination of an internal NdeI site (using the same primers described above for expression in baculovirus). DNA is purified with Qiagen chromatography columns and expressed in Sf9 cells. Preliminary Western blot experiments from non-purified plaques are tested for the presence of the recombinant protein of the expected size which reacted with the GPCR-specific antibody.

3. Antibodies

Antibodies, or antigen-binding fragments thereof, that specifically bind a GPCR are also modulators, i.e., activators or inhibitors, of GPCR s according to the methods described herein. An antibody, or antigen-binding fragment thereof, is said to "specifically bind," "immunogically bind," and/or is "immunologically reactive" to a polypeptide of the invention if it reacts at a detectable level (within, for example, an ELISA assay) with the polypeptide, and does not react detectably with unrelated polypeptides under similar conditions. Antibodies are considered to specifically bind to a target polypeptide when the binding affinity is at least $1 \times 10^{-7}$ M or, preferably, at least $1 \times 10^{-8}$ M. In one embodiment, a modulator is an antibody that specifically binds the extracellular domain of a GPCR.

Antibodies used in the methods of the invention include, but are not limited to, polyclonal antibodies, monoclonal antibodies, chimeric antibodies, humanized antibodies, fully human antibodies, Primatized® antibodies, single chains, Fab fragments and scFv fragments.

Antibodies may be prepared by any of a variety of techniques known to those of ordinary skill in the art. See, e.g., Harlow and Lane, *Antibodies: A Laboratory Manual*, Cold Spring Harbor Laboratory, 1988. In general, antibodies can be produced by cell culture techniques, including the generation of monoclonal antibodies via conventional techniques known in the art, or via transfection of antibody genes into suitable bacterial or mammalian cell hosts, in order to allow for the production of recombinant antibodies. Monoclonal antibodies specific for an antigenic polypeptide of interest may be prepared, for example, using the technique of Kohler and Milstein, Eur. J. Immunol. 6:511-519, 1976, and improvements thereto. Methods of making chimeric and humanized antibodies are well known in the art, (see, e.g., U.S. Pat. No. 4,816,567, International Application No. WO84/03712, respectively).

In certain embodiment, methods of preparing monoclonal antibodies involve the preparation of immortal cell lines capable of producing antibodies having the desired specificity (i.e., reactivity with the polypeptide of interest). Such cell lines may be produced, for example, from spleen cells obtained from an animal immunized as described above. The spleen cells are then immortalized by, for example, fusion with a myeloma cell fusion partner, preferably one that is syngeneic with the immunized animal. A variety of fusion techniques may be employed. For example, the spleen cells and myeloma cells may be combined with a nonionic detergent for a few minutes and then plated at low density on a selective medium that supports the growth of hybrid cells, but not myeloma cells. A preferred selection technique uses HAT (hypoxanthine, aminopterin, thymidine) selection. After a sufficient time, usually about 1 to 2 weeks, colonies of hybrids are observed. Single colonies are selected and their culture supernatants tested for binding activity against the polypeptide. Hybridomas having high reactivity and specificity are preferred.

Monoclonal antibodies may be isolated from the supernatants of growing hybridoma colonies. In addition, various techniques may be employed to enhance the yield, such as injection of the hybridoma cell line into the peritoneal cavity of a suitable vertebrate host, such as a mouse. Monoclonal antibodies may then be harvested from the ascites fluid or the blood. Contaminants may be removed from the antibodies by conventional techniques, such as chromatography, gel filtration, precipitation, and extraction. The polypeptides of this invention may be used in the purification process in, for example, an affinity chromatography step.

A number of therapeutically useful molecules are known in the art, which comprise antigen-binding sites that are capable of exhibiting immunological binding properties of an antibody molecule. The proteolytic enzyme papain preferentially cleaves IgG molecules to yield several fragments, two of which (the "F(ab)" fragments) each comprise a covalent heterodimer that includes an intact antigen-binding site. The enzyme pepsin is able to cleave IgG molecules to provide several fragments, including the "F(ab')$_2$" fragment which comprises both antigen-binding sites. An "Fv" fragment can be produced by preferential proteolytic cleavage of an IgM, and on rare occasions IgG or IgA immunoglobulin molecule. Fv fragments are, however, more commonly derived using recombinant techniques known in the art. The Fv fragment includes a non-covalent $V_H::V_L$ heterodimer including an antigen-binding site which retains much of the antigen recognition and binding capabilities of the native antibody molecule. Inbar et al. (1972) Proc. Nat. Acad. Sci. USA 69:2659-2662; Hochman et al. (1976) Biochem 15:2706-2710; and Ehrlich et al. (1980) Biochem 19:4091-4096.

A single chain Fv ("sFv") polypeptide is a covalently linked $V_H::V_L$ heterodimer which is expressed from a gene fusion including $V_H$- and $V_L$-encoding genes linked by a peptide-encoding linker. Huston et al. (1988) Proc. Nat. Acad. Sci. USA 85(16):5879-5883. A number of methods have been described to discern chemical structures for converting the naturally aggregated—but chemically separated—light and heavy polypeptide chains from an antibody V region into an sFv molecule which will fold into a three dimensional structure substantially similar to the structure of an antigen-binding site. See, e.g., U.S. Pat. Nos. 5,091,513 and 5,132,405, to Huston et al.; and U.S. Pat. No. 4,946,778, to Ladner et al.

In certain embodiments, each of the above-described molecules includes a heavy chain and a light chain CDR set, respectively interposed between a heavy chain and a light chain FR set which provide support to the CDRS and define the spatial relationship of the CDRs relative to each other. As used herein, the term "CDR set" refers to the three hypervariable regions of a heavy or light chain V region. Proceeding from the N-terminus of a heavy or light chain, these regions are denoted as "CDR1," "CDR2," and "CDR3" respectively. An antigen-binding site, therefore, includes six CDRs, comprising the CDR set from each of a heavy and a light chain V region. A polypeptide comprising a single CDR, (e.g., a CDR1, CDR2 or CDR3) is referred to herein as a "molecular recognition unit." Crystallographic analysis of a number of antigen-antibody complexes has demonstrated that the amino acid residues of CDRs form extensive contact with bound antigen, wherein the most extensive antigen contact is with the heavy chain CDR3. Thus, the molecular recognition units are primarily responsible for the specificity of an antigen-binding site.

As used herein, the term "FR set" refers to the four flanking amino acid sequences which frame the CDRs of a CDR set of a heavy or light chain V region. Some FR residues may contact bound antigen; however, FRs are primarily responsible for folding the V region into the antigen-binding site, particularly the FR residues directly adjacent to the CDRS. Within FRs, certain amino residues and certain structural features are very highly conserved. In this regard, all V region sequences contain an internal disulfide loop of around 90 amino acid residues. When the V regions fold into a binding-site, the CDRs are displayed as projecting loop motifs which form an antigen-binding surface. It is generally recognized that there are conserved structural regions of FRs which influence the folded shape of the CDR loops into certain "canonical" structures—regardless of the precise CDR amino acid sequence. Further, certain FR residues are known to participate in non-covalent interdomain contacts which stabilize the interaction of the antibody heavy and light chains.

The invention further includes veneered framework (FR) antibodies. As used herein, the terms "veneered FRs" and "recombinantly veneered FRs" refer to the selective replacement of FR residues from, e.g., a rodent heavy or light chain V region, with human FR residues in order to provide a xenogeneic molecule comprising an antigen-binding site which retains substantially all of the native FR polypeptide folding structure. Veneering techniques are based on the understanding that the ligand binding characteristics of an antigen-binding site are determined primarily by the structure and relative disposition of the heavy and light chain CDR sets within the antigen-binding surface. Davies et al. (1990) Ann. Rev. Biochem. 59:439-473. Thus, antigen binding specificity can be preserved in a humanized antibody only wherein the CDR structures, their interaction with each other, and their interaction with the rest of the V region domains are carefully maintained. By using veneering techniques, exterior (e.g., solvent-accessible) FR residues which are readily encountered by the immune system are selectively replaced with human residues to provide a hybrid molecule that comprises either a weakly immunogenic, or substantially non-immunogenic veneered surface.

The process of veneering makes use of the available sequence data for human antibody variable domains compiled by Kabat et al., in Sequences of Proteins of Immunological Interest, 4th ed., (U.S. Dept. of Health and Human Services, U.S. Government Printing Office, 1987), updates to the Kabat database, and other accessible U.S. and foreign databases (both nucleic acid and protein). Solvent accessibilities of V region amino acids can be deduced from the known three-dimensional structure for human and murine antibody fragments. There are two general steps in veneering a murine antigen-binding site. Initially, the FRs of the variable domains of an antibody molecule of interest are compared with corresponding FR sequences of human variable domains obtained from the above-identified sources. The most homologous human V regions are then compared residue by residue to corresponding murine amino acids. The residues in the murine FR which differ from the human counterpart are replaced by the residues present in the human moiety using recombinant techniques well known in the art. Residue switching is only carried out with moieties which are at least partially exposed (solvent accessible), and care is exercised in the replacement of amino acid residues which may have a significant effect on the tertiary structure of V region domains, such as proline, glycine and charged amino acids.

In this manner, the resultant "veneered" murine antigen-binding sites are thus designed to retain the murine CDR residues, the residues substantially adjacent to the CDRs, the residues identified as buried or mostly buried (solvent inaccessible), the residues believed to participate in non-covalent (e.g., electrostatic and hydrophobic) contacts between heavy and light chain domains, and the residues from conserved structural regions of the FRs which are believed to influence the "canonical" tertiary structures of the CDR loops. These design criteria are then used to prepare recombinant nucleotide sequences which combine the CDRs of both the heavy and light chain of a murine antigen-binding site into human-appearing FRs that can be used to transfect mammalian cells for the expression of recombinant human antibodies which exhibit the antigen specificity of the murine antibody molecule.

Fab or F(ab')$_2$ fragments may be wholly animal or human derived, or they may be in chimeric form, such that the constant domains are derived from the constant regions of human immunoglobulins and the variable regions are derived from the parent murine MAb. Alternatively, the Fv, Fab, or F(ab')$_2$ may be humanized, so that only the complementarity determining regions (CDR) are derived from an animal MAb, and the constant domains and the framework regions of the variable regions are of human origin. These chimeric and humanized fragments are less immunogenic than their wholly animal counterparts, and thus more suitable for in vivo use, especially over prolonged periods.

A number of "humanized" antibody molecules comprising an antigen-binding site derived from a non-human immunoglobulin have been described, including chimeric antibodies having rodent V regions and their associated CDRs fused to human constant domains (Winter et al. (1991) Nature 349: 293-299; Lobuglio et al. (1989) Proc. Nat. Acad. Sci. USA 86:4220-4224; Shaw et al. (1987) J Immunol. 138:4534-4538; and Brown et al. (1987) Cancer Res. 47:3577-3583), rodent CDRs grafted into a human supporting FR prior to fusion with an appropriate human antibody constant domain (Riechmann et al. (1988) Nature 332:323-327; Verhoeyen et al. (1988) Science 239:1534-1536; and Jones et al. (1986) Nature 321:522-525), and rodent CDRs supported by recombinantly veneered rodent FRs (European Patent Publication No. 519,596, published Dec. 23, 1992). These "humanized" molecules are designed to minimize unwanted immunological response toward rodent antihuman antibody molecules which limits the duration and effectiveness of therapeutic applications of those moieties in human recipients.

Methods for humanizing non-human antibodies have been described in the art. Preferably, a humanized antibody has one or more amino acid residues introduced into it from a source which is non-human. These non-human amino acid residues are often referred to as "import" residues, which are typically taken from an "import" variable domain. Humanization can be essentially performed following the method of Winter and co-workers (Jones et al., Nature, 321:522-525 (1986); Riechmann et al., Nature, 332:323-327 (1988); Verhoeyen et al., Science, 239:1534-1536 (1988)), by substituting hypervariable region sequences for the corresponding sequences of a human antibody. Accordingly, such "humanized" antibodies are chimeric antibodies (U.S. Pat. No. 4,816,567) wherein substantially less than an intact human variable domain has been substituted by the corresponding sequence from a non-human species. In practice, humanized antibodies are typically human antibodies in which some hypervariable region residues and possibly some FR residues are substituted by residues from analogous sites in rodent antibodies.

The choice of human variable domains, both light and heavy, to be used in making the humanized antibodies is very important to reduce antigenicity. According to the so-called "best-fit" method, the sequence of the variable domain of a rodent antibody is screened against the entire library of known human variable-domain sequences. The human sequence which is closest to that of the rodent is then accepted as the human framework region (FR) for the humanized antibody (Sims et al., J. Immunol., 151:2296 (1993); Chothia et al., J. Mol. Biol., 196:901 (1987)). Another method uses a particular framework region derived from the consensus sequence of all human antibodies of a particular subgroup of light or heavy chains. The same framework may be used for several different humanized antibodies (Carter et al., Proc. Natl. Acad. Sci. USA, 89:4285 (1992); Presta et al., J. Immunol., 151:2623 (1993)).

It is further important that antibodies be humanized with retention of high affinity for the antigen and other favorable biological properties. To achieve this goal, according to a preferred method, humanized antibodies are prepared by a process of analysis of the parental sequences and various conceptual humanized products using three-dimensional models of the parental and humanized sequences. Three-dimensional immunoglobulin models are commonly available and are familiar to those skilled in the art. Computer programs are available which illustrate and display probable three-dimensional conformational structures of selected candidate immunoglobulin sequences. Inspection of these displays permits analysis of the likely role of the residues in the functioning of the candidate immunoglobulin sequence, i.e., the analysis of residues that influence the ability of the candidate immunoglobulin to bind its antigen. In this way, FR residues can be selected and combined from the recipient and import sequences so that the desired antibody characteristic, such as increased affinity for the target antigen(s), is achieved. In general, the hypervariable region residues are directly and most substantially involved in influencing antigen binding.

As an alternative to humanization, human antibodies can be generated. For example, it is now possible to produce transgenic animals (e.g., mice) that are capable, upon immunization, of producing a full repertoire of human antibodies in the absence of endogenous immunoglobulin production. For example, it has been described that the homozygous deletion of the antibody heavy-chain joining region ($J_H$) gene in chimeric and germ-line mutant mice results in complete inhibition of endogenous antibody production. Transfer of the human germ-line immunoglobulin gene array in such germ-line mutant mice will result in the production of human antibodies upon antigen challenge. See, e.g., Jakobovits et al., Proc. Natl. Acad. Sci. USA, 90:2551 (1993); Jakobovits et al., Nature, 362:255-258 (1993); Bruggermann et al., Year in Immuno., 7:33 (1993); and U.S. Pat. Nos. 5,591,669, 5,589,369 and 5,545,807.

In one embodiment, humanized or fully human antibodies of the present invention are prepared according to the methods described in U.S. Pat. Nos. 5,770,429, 5,833,985, 5,837,243, 5,922,845, 6,071,517, 6,096,311, 6,111,166, 6,270,765, 6,303,755, 6,365,116, 6,410,690, 6,682,928, and 6,984,720, all assigned to Medarex, Inc.

Alternatively, phage display technology (McCafferty et al., Nature 348:552-553 (1990)) can be used to produce human antibodies and antibody fragments in vitro, from immunoglobulin variable (V) domain gene repertoires from unimmunized donors. According to this technique, antibody V domain genes are cloned in-frame into either a major or minor coat protein gene of a filamentous bacteriophage, such as M13 or fd, and displayed as functional antibody fragments on the surface of the phage particle. Because the filamentous particle contains a single-stranded DNA copy of the phage genome, selections based on the functional properties of the antibody also result in selection of the gene encoding the antibody exhibiting those properties. Thus, the phage mimics some of the properties of the B cell. Phage display can be performed in a variety of formats; for their review see, e.g., Johnson, Kevin S. and Chiswell, David J., Current Opinion in Structural Biology 3:564-571 (1993). Several sources of V-gene segments can be used for phage display. Clackson et al., Nature, 352:624-628 (1991) isolated a diverse array of anti-oxazolone antibodies from a small random combinatorial library of V genes derived from the spleens of immunized mice. A repertoire of V genes from unimmunized human donors can be constructed and antibodies to a diverse array of antigens (including self-antigens) can be isolated essentially following the techniques described by Marks et al., J. Mol. Biol. 222:581-597 (1991), or Griffith et al., EMBO J. 12:725-734 (1993). See, also, U.S. Pat. Nos. 5,565,332 and 5,573,905.

Human antibodies may also be generated by in vitro activated B cells (see U.S. Pat. Nos. 5,567,610 and 5,229,275).

Antibodies to GPCR s may be agonists that increase an activity of a GPCR, or they may be antagonists that decrease an activity of a GPCR. In one embodiment, an antibody serves as an inhibitor of GPCR signaling by binding to a GPCR, e.g., the extracellular domain, and thereby inhibiting binding of a ligand to the GPCR.

4. Small Molecules

Modulators (inhibitors or activators) of the present invention further include large or small inorganic or organic molecules. In certain embodiments, modulators are small organic molecules, or derivatives or analogs thereof. Such small molecules preferably have a molecular weight below 2,000 daltons, more preferably between 300 and 1,000 daltons, and most preferably between 400 and 700 daltons. It is preferred that these small molecules be organic molecules.

In certain embodiments, a modulator includes a protecting group. The term "protecting group" refers to chemical moieties that block at least some reactive moieties and prevent such groups from participating in chemical reactions until the protective group is removed (or "cleaved"). Examples of blocking/protecting groups are described, e.g., in Greene and Wuts, Protective Groups in Organic Synthesis, 3rd Ed., John Wiley & Sons, New York, N.Y., 1999.

Any of the modulators may possess one or more chiral centers and each center may exist in the R or S configuration. Modulators of the present invention include all diastereomeric, enantiomeric, and epimeric forms as well as mixtures thereof. Stereoisomers may be obtained, if desired, by methods known in the art as, for example, the separation of stereoisomers by chiral chromatographic columns. Modulators further include of N-oxides, crystalline forms (also known as polymorphs), and pharmaceutically acceptable salts, as well as active metabolites of any inhibitor. All tautomers are included within the scope of the modulators presented herein. In addition, the modulators described herein can exist in unsolvated as well as solvated forms with pharmaceutically acceptable solvents such as water, ethanol, and the like. The solvated forms of the modulators presented herein are also included within the present invention.

In a particular embodiment, a small molecule modulator binds to a GPCR, such as SREB1, SREB2, SREB3, GPR88, or GPR22. In one embodiment, a small molecule binds to the extracellular region of a GPCR and interferes or reduces ligand binding to the GPCR. In another embodiment, it binds to the extracellular region of a GPCR and acts as an agonist to stimulate GPCR activity.

Modulators of a GPCR, including small organic compounds, may be identified according to routine screening procedures available in the art, e.g., using commercially available libraries of such compounds.

5. Characteristic of GPCR Modulators

The ability of a compound of the present invention to modulate GPCR biological activity or expression may be readily confirmed using routine assays known and available in the art. For expression based assays, a cell or animal is contacted with a compound that modulates GPCR expression, and the expression levels of a GPCR in the cell or animal contacted with the compound are compared to the expression level of the GPCR in cells or an animal not contacted with the compound. Any increase or decrease in GPCR expression levels associated with contact with the compound indicates that the compound modulates GPCR expression. Expression levels of GPCR polypeptides and polynucleotides may be measured by routine procedures in the art, including, e.g., reverse transcriptase-polymerase chain reaction (RT-PCR) or immunological-based assays using an antibody that binds a GPCR. In preferred embodiments, a compound that increases GPCR expression results in an at least two-fold, at least three-fold, at least five-fold, or at least ten-fold increase in GPCR expression, and a compound that decreases GPCR expression results in GPCR expression levels less than 75%, less than 50%, less than 20%, or less than 10% those determined in control cells or animals.

For activity based assays, a cell or animal is contacted with a compound that modulates GPCR expression, and the level of GPCR biological activity in the cell or animal contacted with the compound is compared to the level in cells or an animal not contacted with the compound. Any increase or decrease in GPCR activity associated with contact with the compound indicates that the compound modulates GPCR activity. In preferred embodiments, a compound that increases GPCR activity results in an at least two-fold, at least three-fold, at least five-fold, or at least ten-fold increase in GPCR biological activity, and a compound that decreases GPCR activity results in GPCR activity level less than 75%, less than 50%, less than 20%, or less than 10% that determined in control cells or animals.

Biological activities of GPCR s that may be altered by a modulator include, but are not limited to, the binding of a natural or an unnatural ligand, as well as any one of the functional activities of GPCRs known in the art. Non-limiting examples of GPCR activities include transmembrane signaling of various forms, which may involve G protein association and/or the exertion of an influence over G protein binding of various guanidylate nucleotides; another exemplary activity of GPCRs is the binding of accessory proteins or polypeptides that differ from known G proteins.

The activity of GPCRs can be determined by, for example, by examining the ability to bind or be activated by chemically synthesized peptide ligands. Alternatively, the activity of GPCR polypeptides can be assayed by examining their ability to bind calcium ions, hormones, chemokines, neuropeptides, neurotransmitters, nucleotides, lipids, odorants, and photons. Alternatively, the activity of the GPCR polypeptides can be determined by examining the activity of effector molecules including, but not limited to, adenylate cyclase, phospholipases and ion channels. Thus, modulators of GPCR polypeptide activity may alter a GPCR receptor function, such as a binding property of a receptor or an activity such as G protein-mediated signal transduction or membrane localization.

In various embodiments of the method, the assay may take the form of an ion flux assay, a yeast growth assay, a non-hydrolyzable GTP assay such as a [35S]-GTPγS assay, a cAMP assay, an inositol triphosphate assay, a diacylglycerol assay, an Aequorin assay, a Luciferase assay, a FLIPR assay for intracellular $Ca^{2+}$ concentration, a mitogenesis assay, a MAP Kinase activity assay, an arachidonic acid release assay (e.g., using [$^3$H]-arachidonic acid), and an assay for extracellular acidification rates, as well as other binding or function-based assays of GPCR activity that are generally known in the art. In several of these embodiments, the invention comprehends the inclusion of any of the G proteins known in the art, such as G 16, G 15, Gs, Gi, Gz, Gq or chimeric G proteins, and the like. SREB activity can be determined by methodologies that are used to assay-for FARP activity, which is well known to those skilled in the art. The assay may take the form of following a change in intracellular localization of the receptor upon binding of a natural or artificial agonist or antagonist. Such cellular trafficking may represent a normal component of a signal transduction pathway, as in "high content screening" (see, e.g., Comley, J. C. W. and Fox, S (2004), Growing market for high content analysis tools, DDW, 5(2):25-34) or may be caused by a receptor modification, as described (O'Dowd, B. F. et al., Dopamine receptor oligomerization visualized in living cells, J. Biol. Chem. (2005), 4:280(44): 37225-35).

Therapeutic Compounds

A large number of GPCRs are found in the brain. Excluding the large family of odor receptors, over 89% of known GPCRs are active in the brain. Of particular importance is that up to 81% of the known GPCRs in the brain are active in the HAP. We hypothesize that the majority of these receptors serve as modulators of behavior, memory, cognition, pain, and instinctive functions. In animal models, defects in brain GPCRs have been found to lead to various disorders, including increased aggression, hyperactivity, learning deficits, and altered pain perception.

GPCRs, especially those in the nervous system, are ideal targets for drug development. Most GPCRs are located in the plasma membranes of cells, where they can be easily accessed by pharmaceutical compounds. There are significant numbers and varieties of GPCRs to provide for a high degree of specificity, a key requirement in the discovery of medicines with few or limited side effects. Given these properties, GPCRs, as a group, have emerged among the most coveted targets for drug development.

The preference for GPCRs as specific drug targets derives, not only from their central role in biological processes, but also from the discriminating ability that these molecules have in recognizing and responding to their signals. Many GPCRs exist in several similar, but subtly distinct subtypes, which are found in different cells in the body. Such variety of sequence and location provides a high degree of selectivity, allowing the discovery of drugs which specifically affect one subtype of receptor, but not another. This selectivity substantially reduces the risk of unwanted side effects. In addition, techniques of medicinal chemistry known in the art can impact the localization of drugs to different compartments within the body. These techniques also contribute to the specificity of drugs.

In the case of the histamine GPCRs, for instance, subtypes are distributed in the central nervous, cardiopulmonary, and gastrointestinal systems. Yet, each subtype of the histamine receptor is a target of a different medicine. Drugs selective for histamine GPCRs subtypes include Tagamet®, Zantac®, Seldane®, and Dramamine®. Each of these drugs is subtly different from the others, and each has a different target site and therapeutic effect.

GPCR polypeptides of the present invention have one or more biological functions that may be of relevance in one or more behavioral disorders, in particular the disorders of the invention herein before mentioned. As the GPCR polypeptides may be expressed in other organs and tissues of the body, they may be of relevance to diseases and disorders that involve those organs and tissues. It is therefore useful to identify compounds that modulate GPCR biological activity, expression level, or stability. Accordingly, in a further aspect, the present invention provides methods of screening candidate compounds to identify those that modulate GPCR biological activity, expression level, or stability. Such methods identify potential modulators that may be employed for therapeutic and prophylactic purposes for treating various disorders, e.g., behavioral disorders as described herein. Compounds may be identified from a variety of sources, for example, cells, cell-free preparations, chemical libraries, collections of chemical compounds, and natural product mixtures. Modulators so identified may be natural or modified ligands, or small molecules. Such small molecules preferably have a molecular weight below 2,000 daltons, more preferably between 300 and 1,000 daltons, and most preferably between 400 and 700 daltons. It is preferred that these small molecules be organic molecules.

The screening method may simply measure the interaction of a candidate compound to the polypeptide, or to cells or membranes bearing the polypeptide, or a fusion protein thereof, by means of a label directly or indirectly associated with the candidate compound, or, alternatively, the polypeptide. Alternatively, the screening method may involve measuring or detecting (qualitatively or quantitatively) the competitive interaction of a candidate compound to the polypeptide against a labeled substrate. Further, these screening methods may test whether the candidate compound activates or inhibits the GPCR polypeptide, using detection systems appropriate to the cells bearing the polypeptide. Further, the screening methods may include the steps of mixing a candidate compound with a solution containing a GPCR polypeptide of the present invention, to form a mixture, measuring GPCR biological activity in the mixture, and comparing the GPCR activity of the mixture to a control mixture that contains no candidate compound.

Polypeptides of the present invention may be employed in conventional low capacity screening methods and also in high-throughput screening (HTS) formats. Such HTS formats include not only the well-established use of 96 and, more recently, 384-well and 1536-well micotiter plates, but also emerging methods such as the nanowell method described by Schullek et al., Anal Biochem., 246, 20-29, (1997).

Fusion proteins and tagged recombinant proteins, such as those made from the $F_c$ portion of an antibody and a GPCR polypeptide or epitope tagged GPCR, can also be used for high-throughput screening (HTS) assays to identify modulators of the GPCR polypeptides of the present invention (see, e.g., Bennett et al., J. Mol. Recognit., 8:52-58, 1995; and Johanson et al., J. Biol. Chem., 270:9459-9471, 1995).

Drug Screening

A GPCR of the invention and its gene or cDNA can be used in screening assays for identification of compounds that modulate its activity and which may therefore be potential drugs. Useful proteins include wild-type and polymorphic GPCRs or fragments thereof (e.g., an extracellular domain, an intracellular domain, or a transmembrane domain), in a recombinant form or endogenously expressed. Drug screens to identify compounds acting on a normally occurring or an exogenously expressed GPCR may employ any functional feature of the protein. In one example, the phosphorylation state or other post-translational modification is monitored as a measure of GPCR biological activity. In addition, drug screening assays may be based upon the ability of the protein to transduce a signal across a membrane or upon the ability to activate a G protein or another molecule. For example, the ability of a G protein to bind GTP may be assayed. Alternatively, a target of the G protein can be used as a measure of GPCR biological activity.

Drug screening assays can also be based upon the ability of a GPCR to interact with other proteins. Such interacting proteins can be identified by a variety of methods known in the art, including, for example, radioimmunoprecipitation, co-immunoprecipitation, co-purification, and yeast two-hybrid screening. Such interactions can be further assayed by means including but not limited to fluorescence polarization or scintillation proximity methods. Drug screens can also be based upon putative functions of a GPCR polypeptide deduced from structure determination (e.g., by x-ray crystallography) of the protein and comparison of its 3-D structure to that of proteins with known functions. Molecular modeling of compounds that bind to the protein using a 3-D structure may also be used to determine drug candidates. Drug screens can be based upon a function or feature apparent upon creation of a transgenic or knock-out mouse, or upon overexpression of the protein or protein fragment in mammalian cells in vitro. Moreover, expression of a mammalian (e.g., human) GPCR in yeast or C. elegans allows for screening of candidate compounds in wild-type and polymorphic backgrounds, as well as screens for polymorphisms that enhance or suppress a GPCR-dependent phenotype. Modifier screens can also be performed in a GPCR transgenic or knock-out mouse.

Additionally, drug screening assays can be based upon GPCR functions deduced upon antisense nucleic acid inhibition or RNA interference (RNAi) with the GPCR's gene function. Intracellular localization of a GPCR, or effects which occur upon a change in intracellular localization of the protein, can also be used as an assay for drug screening. Immunocytochemical methods can be used to determine the exact location of a GPCR protein.

Human and rodent GPCRs or peptides derived from GPCRs can be used as antigens to raise antibodies, including monoclonal antibodies. Such antibodies will be useful for a wide variety of purposes, including but not limited to functional studies and the development of drug screening assays and diagnostics. Monitoring the influence of agents (e.g., drugs, compounds) on the expression or biological activity of a GPCR can be applied not only in basic drug screening, but also in clinical trials. For example, the effectiveness of an agent determined by a screening assay as described herein to increase gene expression, protein levels, or biological activity of a GPCR can be monitored in clinical trials of subjects exhibiting altered gene expression, protein levels, or biological activity of that GPCR. Alternatively, the effectiveness of an agent determined by a screening assay to modulate the gene expression, protein levels, or biological activity of a GPCR can be monitored in clinical trials of subjects exhibiting decreased altered gene expression, protein levels, or biological activity. In such clinical trials, the expression or activity of a GPCR and, preferably, other genes that have been implicated in one or more diseases or disorders can be used to ascertain the effectiveness of a particular drug.

For example, and not by way of limitation, genes that are modulated in cells by treatment with an agent (e.g., compound, drug, or small molecule) that modulates the biological activity of a GPCR polypeptide (e.g., identified in a screening assay as described herein) can be identified. Thus, to study the effect of agents on one or more diseases or disorders in a clinical trial, cells can be isolated and RNA prepared and analyzed for the levels of expression of a GPCR and other genes implicated in the disorder. The levels of gene expression can be quantified by northern blot analysis or RT-PCR, followed by real time PCR, or, alternatively, by measuring the amount of protein produced, by one of a number of methods known in the art, or by measuring the levels of biological activity of a GPCR or other genes. In this way, the expression of a GPCR polypeptide can serve as a marker, indicative of the physiological response of the cells to the agent. Accordingly, this response state may be determined before, and at various points during, treatment of the individual with the agent. For in vivo studies MRI, pet scans etc may be better assays.

In one embodiment, the present invention provides a method for monitoring the effectiveness of treatment of a subject with an agent (e.g., an agonist, antagonist, peptidomimetic, protein, peptide, nucleic acid, small molecule, or other drug candidate identified by the screening assays described herein) including the steps of (i) obtaining a pre-administration sample from a subject prior to administration of the agent; (ii) detecting the level of expression of a GPCR polypeptide, mRNA, or genomic DNA in the preadministration sample; (iii) obtaining one or more post-administration samples from the subject; (iv) detecting the level of expression or activity of a GPCR polypeptide, mRNA, or genomic DNA in the post-administration samples; (v) comparing the level of expression or activity of a GPCR polypeptide, mRNA, or genomic DNA in the pre-administration sample with the polypeptide, mRNA, or genomic DNA in the post administration sample or samples; and (vi) altering the administration of the agent to the subject accordingly. For example, increased administration of the agent may be desirable to increase the expression or activity of a GPCR polypeptide to higher levels than detected, i.e., to increase the effectiveness of the agent. Alternatively, decreased administration of the agent may be desirable to decrease expression or activity of a GPCR polypeptide to lower levels than detected.

A GPCR polynucleotide can be used as a tool to express the GPCR polypeptide in an appropriate cell in vitro or in vivo (gene therapy), or can be cloned into expression vectors that can be used to produce large enough amounts of a GPCR polypeptide for use in in vitro assays for drug screening. Expression systems that may be employed include baculovirus, herpes virus, adenovirus, adeno-associated virus, bacterial systems, and eukaryotic systems such as CHO cells. Naked DNA and DNA-liposome complexes can also be used.

Assays of GPCR activity include binding to intracellular interacting proteins. Furthermore, assays may be based upon the molecular dynamics of macromolecules, metabolites, and ions by means of fluorescent-protein biosensors. Alternatively, the effect of candidate modulators on expression or activity may be measured at the level of GPCR production using the same general approach in combination with standard immunological detection techniques, such as western blotting or immunoprecipitation with a GPCR polypeptide-specific antibody. Again, useful modulators are identified as those that produce a change in GPCR polypeptide production. Modulators may also affect GPCR activity without any effect on expression level.

Candidate modulators may be purified (or substantially purified) molecules or may be one component of a mixture of compounds (e.g., an extract or supernatant obtained from cells). In a mixed compound assay, GPCR expression is tested against progressively smaller subsets of the candidate compound pool (e.g., produced by standard purification techniques, e.g., HPLC or FPLC) until a single compound or minimal compound mixture is demonstrated to modulate GPCR expression. Alternatively, diverse mixtures (i.e., libraries) of test compounds may be assayed in such a way that the pattern of response indicates which compounds in the various mixtures are responsible for the effect (deconvolution).

Agonists, antagonists, or mimetics found to be effective at modulating the level of cellular GPCR expression or activity may be confirmed as useful in animal models (for example, mice, pigs, dogs, or chickens). For example, the compound may increase survival or mitigate distress in animal models of one or more diseases or disorders.

A gene encoding a GPCR polypeptide may have a polymorphism that may be, for example, a causative or risk factor of the diseases and disorders discussed below. Screening methods that identify polymorphisms may be of diagnostic and therapeutic benefit. For example, early detection of a particular polymorphism may enable preventative treatment or prediction of a patient's response (e.g., increased or decreased efficacy or undesirable side effects of treatment). Methods of identifying polymorphisms include PCR, RT-PCR, northern blot (e.g., using clones encompassing discrete regions of cDNA), Southern blot, polymorphic specific probes, sequencing analysis, hybridization assays, restriction endonuclease analysis, and exon-specific amplification.

One method for altering the biological activity of a GPCR polypeptide is to increase or decrease the stabilization of the protein or to prevent its degradation. Thus, it would be useful to identify polymorphisms in a GPCR polypeptide that lead to altered protein stability. These polymorphisms can be incorporated into any protein therapy or gene therapy undertaken for the treatment of any condition resulting from loss of GPCR biological activity. Similarly, compounds that increase the stability of a wild-type GPCR polypeptide or decrease its catabolism may also be useful for the treatment of any condition resulting from loss of GPCR biological activity. Such polymorphisms and compounds can be identified using the methods described herein. In an analogous manner, decreasing stability may be used to decrease the activity of a GPCR.

In one example, cells expressing a GPCR polypeptide having a polymorphism are transiently metabolically labeled during translation and the half-life of the GPCR polypeptide is determined using standard techniques. Polymorphisms that increase the half-life of a GPCR polypeptide are ones that increase GPCR protein stability. These polymorphisms can then be assessed for biological activity. They can also be used to identify proteins that affect the stability of GPCR mRNA or protein. One can then assay for compounds that act on these factors or on the ability of these factors to bind a GPCR.

In another example, cells expressing a wild-type GPCR polypeptide are transiently metabolically labeled during translation, contacted with a candidate compound, and the half-life of the GPCR polypeptide is determined using standard techniques. Compounds that modulate the half-life of a GPCR polypeptide are useful compounds in the present invention.

If desired, treatment with a modulator of a GPCR of the invention may be combined with any other therapy.

A GPCR polypeptide (purified or unpurified) can be used in an assay to determine its ability to bind another protein (including, but not limited to, proteins found to specifically interact with a GPCR). The effect of a compound on that binding is then determined.

Methods of identifying compounds having the foregoing properties can be identified by standard methods known in the art. Exemplary methods for identifying compounds are described herein.

Identification of Molecules that Modulate GPCR Biological Activity

The effect of candidate compounds on GPCR biological activity or cell survival may be measured at the level of translation by using the general approach described above with standard protein detection techniques, such as western blotting, sandwich or competitive immunoassays (both enzyme and radioactive tracer based) or immunoprecipitation with a GPCR-specific antibody as well as with quantitative immunoassays of GPCR regulated molecules.

Modulators include both inhibitors and activators of a GPCR. The invention contemplates at least two different types of inhibitors of GPCRs, including (1) compounds that decrease a functional activity of a GPCR; and (2) compounds that decrease expression levels of a GPCR. An inhibitor of a GPCR is identified as a compound that reduces GPCR activity or expression by at least 10%, at least 25%, at least 50%, at least 75% or 100%.

In general, the invention contemplates two different types of inducers, including (1) compounds that increase the functional activity of a GPCR; and (2) compounds that increase expression levels of a GPCR, including, e.g., a GPCR expression construct. An inducer of a GPCR is identified as a molecule or compound that increases a SREB activity by at least two-fold, at least five-fold, at least ten-fold or more. In the context of overexpression of GPCR s, an inducer is a molecule or compound that increases expression of a GPCR at least two-fold, at least five-fold, at least ten-fold or more.

Compounds that modulate the level of a GPCR may be purified, or substantially purified, or may be one component of a mixture of compounds such as an extract or supernatant obtained from cells (Ausubel et al., supra). In an assay of a mixture of compounds, GPCR expression is measured in cells administered progressively smaller subsets of the compound pool (e.g., produced by standard purification techniques such as HPLC or FPLC) until a single compound or minimal number of effective compounds is demonstrated to affect GPCR expression. Alternatively, diverse mixtures (i.e., libraries) of test compounds may be assayed in such a way that the pattern of response indicates which compounds in the various mixtures are responsible for the effect (deconvolution).

Compounds may also be screened for their ability to modulate GPCR biological activity. In this approach, the degree of GPCR biological activity in the presence of a candidate compound is compared to the degree of activity in its absence, under equivalent conditions. Again, the screen may begin with a pool of candidate compounds, from which one or more useful modulator compounds are isolated in a step-wise fashion. GPCR biological activity may be measured by any standard assay, for example, those described herein.

Another method for detecting compounds that modulate GPCR biological activity is to screen for compounds that interact physically with a GPCR polypeptide. These compounds may be detected, for example, by adapting interaction trap expression systems known in the art. These systems detect protein interactions using a transcriptional activation assay and are generally described by Gyuris et al. (Cell 75:791-803, 1993) and Field et al., (Nature 340:245-246, 1989), and are commercially available. Alternatively, a GPCR polypeptide, or a fragment thereof, can be labeled with a detectable label (e.g., direct $^{125}$I labelling of tyrosines or $^{125}$I Bolton-Hunter reagent; Bolton et al. Biochem. J. 133: 529, 1973). Candidate compounds previously arrayed in the wells of a multi-well plate are incubated with the labeled GPCR polypeptide. Following washing, the wells with bound, labeled GPCR polypeptide are identified. Data obtained using different concentrations of GPCR polypeptides are used to calculate values for the number, affinity, and association of the GPCR polypeptide with the candidate compounds. If desirable, the candidate compounds can be labeled instead of the GPCR polypeptide. Similarly, the GPCR polypeptide may be immobilized, e.g., in wells of a multi-well plate or on a solid support, and soluble compounds are then contacted with the GPCR polypeptide. Upon removal of unbound compound, the identity of bound candidate compounds is ascertained. Compounds that bind are considered to be candidate modulators of GPCR biological activity. Alternatively, interaction of unlabeled GPCR may be detected using direct or indirect antibody labeling.

Another such method comprises the steps of (a) contacting a composition comprising a GPCR polypeptide with a compound suspected of binding GPCR; and (b) measuring binding between the compound and GPCR polypeptide. In one variation, the composition comprises a cell expressing a GPCR polypeptide on its surface. In another variation, an isolated GPCR polypeptide or cell membranes comprising the GPCR polypeptide are employed. The binding may be measured directly, e.g., by using a labeled compound, or may be measured indirectly by several techniques, including measuring intracellular signaling of the GPCR polypeptide induced by the compound (or measuring changes in the level of GPCR signaling). Following steps (a) and (b), compounds identified as binding a GPCR polypeptide can be further tested in other assays including, but not limited to, in vivo models, in order to confirm or quantitate binding to a GPCR polypeptide.

The test compounds of the present invention can be obtained using any of the numerous approaches in combinatorial library methods known in the art, including: biological libraries; spatially addressable parallel solid phase or solution phase libraries; synthetic library methods requiring deconvolution; the 'one-bead one-compound' library method; and synthetic library methods using affinity chromatography selection. The biological library approach is limited to peptide libraries, while the other four approaches are applicable to peptide, non-peptide oligomer or small molecule libraries of compounds (Lam, K. S. (1997) Anticancer Drug Des. 12:145).

Examples of methods for the synthesis of molecular libraries can be found in the art, for example in: DeWitt et al. (1993) Proc. Natl. Acad Sci. USA. 90:6909; Erb et al. (1994) Proc. Natl. Acad Sci. USA 91:11422; Zuckermann et al. (1994) J. Med. Chem. 37:2678; Cho et al. (1993) Science 261:1303; Carrell et al. (1994) Angew. Chem. Int. Ed. Engl. 33:2059; Carell et al. (1994) Angew. Chem. Int. Ed. Engl. 33:2061; and in Gallop et al. (1994) J Med. Chem. 37:1233. Libraries of compounds may be presented in solution (e.g, Houghten (1992) Biotechniques 13:412-421), oron beads (Lam (1991) Nature 354:82-84), chips (Fodor (1993) Nature 364:555-556), bacteria (Ladner U.S. Pat. No. 5,223,409), spores (Ladner U.S. Pat. No. 409), plasmids (Cull et al. (1992) Proc Natl Acad Sci USA 89:1865-1869) or on phage (Scott and Smith (1990) Science 249:386-390); (Devlin (1990) Science 249:404-406); (Cwirla et al. (1990) Proc. Natl. Acad. Sci. 87:6378-6382); (Felici (1991) J. Mol. Biol. 222:301-310).

Specific binding molecules, including natural ligands and synthetic compounds, can be identified or developed using isolated or recombinant GPCR products, GPCR variants, or preferably, cells expressing such products. Binding partners are useful for purifying GPCR products and detection or quantification of GPCR products in fluid and tissue samples using known immunological procedures. Binding molecules are also manifestly useful in modulating (i.e., blocking, inhibiting or stimulating) biological activities of a GPCR polypeptide, especially those activities involved in signal transduction. The DNA and amino acid sequence information provided by the present invention also makes possible identification of binding partner compounds with which a GPCR polypeptide or polynucleotide will interact. Methods to identify binding partner compounds include solution assays, in vitro assays wherein GPCR polypeptides are immobilized, and cell-based assays. Identification of binding partner compounds of GPCR polypeptides provides candidates for therapeutic or prophylactic intervention in pathologies associated with GPCR normal and aberrant biological activity.

The invention includes several assay systems for identifying GPCR polypeptide binding partners. In solution assays, methods of the invention comprise the steps of (a) contacting a GPCR polypeptide with one or more candidate binding partner compounds and (b) identifying the compounds that bind to the GPCR polypeptide. Identification of the compounds that bind the GPCR polypeptide can be achieved by isolating the GPCR polypeptide/binding partner complex, and separating the binding partner compound from the GPCR polypeptide.

An additional step of characterizing the physical, biological, and/or biochemical properties of the binding partner compound is also comprehended in another embodiment of the invention, wherein compounds identified as binding GPCR can be further tested in other assays including, but not limited to, in vivo models, in order to confirm or quantitate binding to GPCR. In one aspect, the GPCR polypeptide/binding partner complex is isolated using an antibody immunospecific for either the GPCR polypeptide or the candidate binding partner compound.

In still other embodiments, either the GPCR polypeptide or the candidate binding partner compound comprises a label or tag that facilitates its isolation, and methods of the invention to identify binding partner compounds include a step of isolating the GPCR polypeptide/binding partner complex through interaction with the label or tag. An exemplary tag of this type is a poly-histidine sequence, generally around six histidine residues, that permits isolation of a compound so labeled using nickel chelation. Other labels and tags, such as the FLAG tag (Eastman Kodak, Rochester, N.Y.), well known and routinely used in the art, are embraced by the invention.

In one variation of an in vitro assay, the invention provides a method comprising the steps of (a) contacting an immobilized GPCR polypeptide with a candidate binding partner compound and (b) detecting binding of the candidate compound to the GPCR polypeptide. In an alternative embodiment, the candidate binding partner compound is immobilized and binding of GPCR is detected. Immobilization is accomplished using any of the methods well known in the art, including covalent bonding to a support, a bead, or a chromatographic resin, as well as non-covalent, high affinity interactions such as antibody binding, or use of streptavidin/biotin binding wherein the immobilized compound includes a biotin moiety. Detection of binding can be accomplished (i) using a radioactive label on the compound that is not immobilized, (ii) using of a fluorescent label on the non-immobilized compound, (iii) using an antibody immunospecific, for the non-immobilized compound, (iv) using a label on the non-immobilized compound that excites a fluorescent support to which the immobilized compound is attached, as well as other techniques well known and routinely practiced in the art.

The invention also provides cell-based assays to identify binding partner compounds of a GPCR polypeptide. In one embodiment, the invention provides a method comprising the steps of contacting a GPCR polypeptide expressed on the surface of a cell with a candidate binding partner compound and detecting binding of the candidate binding partner compound to the GPCR polypeptide. In a preferred embodiment, the detection comprises detecting a calcium flux or other physiological event in the cell caused by the binding of the molecule.

Another aspect of the present invention is directed to methods of identifying compounds that bind to either a GPCR polypeptide or nucleic acid molecules encoding a GPCR polypeptide, comprising contacting GPCR polypeptide, or a nucleic acid molecule encoding the same, with a compound, and determining whether the compound binds the GPCR polypeptide or a nucleic acid molecule encoding the same. Binding can be determined by binding assays which are well known to the skilled artisan, including, but not limited to, gel-shift assays, Western blots, radiolabeled competition assay, phage-based expression cloning, co-fractionation by chromatography, co-precipitation, cross linking, interaction trap/two-hybrid analysis, southwestern analysis, ELISA, and the like, which are described in, for example, Current Protocols in Molecular Biology, 1999, John Wiley & Sons, NY, which is incorporated herein by reference in its entirety. The compounds to be screened include (which may include compounds which are suspected to bind GPCR polypeptides, or a nucleic acid molecule encoding the same), but are not limited to, extracellular, intracellular, biologic or chemical origin. The methods of the invention also embrace ligands, especially neuropeptides, that are attached to a label, such as a radiolabel (e.g., 125I, 35S, 32P, 33P, 3H), a fluorescence label, a chemiluminescent label, an enzymic label and an immunogenic label.

Modulators falling within the scope of the invention include, but are not limited to, non-peptide molecules such as non-peptide mimetics, non-peptide allosteric effectors, and peptides. The GPCR polypeptide or polynucleotide employed in such a test may either be free in solution, attached to a solid support, borne on a cell surface or located intracellularly or associated with a portion of a cell. One skilled in the art can, for example, measure the formation of complexes between the GPCR polypeptide and the compound being tested. Alternatively, one skilled in the art can examine the diminution in complex formation between a GPCR polypeptide and its substrate caused by the compound being tested.

In another embodiment of the invention, high throughput screening for compounds having suitable binding affinity to a GPCR polypeptide is employed. Briefly, large numbers of different test compounds are synthesized on a solid substrate. The peptide test compounds are contacted with a GPCR polypeptide and washed. Bound GPCR is then detected by methods well known in the art. Purified polypeptides of the invention can also be coated directly onto plates for use in the aforementioned drug screening techniques. In addition, non-neutralizing antibodies can be used to capture the protein and immobilize it on the solid support.

Generally, an expressed GPCR polypeptide can be used for HTS binding assays in conjunction with its defined ligand, in this case the corresponding neuropeptide that activates it. The identified peptide is labeled with a suitable radioisotope, including, but not limited to, 125I, 3H, 35S or 32P, by methods that are well known to those skilled in the art. Alternatively, the peptides may be labeled by well-known methods with a suitable fluorescent derivative (Baindur et al., Drug Dev. Res., 1994, 33, 373-398; Rogers, Drug Discovery Today, 1997, 2, 156-160).

Radioactive ligand specifically bound to the receptor in membrane preparations made from the cell line expressing the recombinant protein can be detected in HTS assays in one of several standard ways, including filtration of the receptor-ligand complex to separate bound ligand from unbound ligand (Williams, Med. Res. Rev., 1991, 11, 147-184; Sweetnam. et al., J Natural Products, 1993, 56, 441-455). Alternative methods include a scintillation proximity assay (SPA) or a FlashPlate format in which such separation is unnecessary (Nakayama, Cur. Opinion Drug Disc. Dev., 1998, 1, 85-91; Boss et al., J Biomolecular Screening, 1998, 3, 285-292). Binding of fluorescent ligands can be detected in various ways, including fluorescence energy transfer (FRET), direct spectrophotofluorometric analysis of bound ligand, or fluorescence polarization (Rogers, Drug Discovery Today, 1997, 2, 156-160; Hill, Cur. Opinion Drug Disc. Dev., 1998, 1, 92-97).

Other assays may be used to identify specific ligands of a GPCR receptor, including assays that identify ligands of the target protein through measuring direct binding of test ligands to the target protein, as well as assays that identify ligands of target proteins through affinity ultrafiltration with ion spray mass spectroscopy/HPLC methods or other physical and analytical methods. Alternatively, such binding interactions are evaluated indirectly using the yeast two hybrid system described in Fields et al., Nature, 340:245-246 (1989), and Fields et al., Trends in Genetics, 10:286-292 (1994), both of which are incorporated herein by reference in its entirety.

The two-hybrid system is a genetic assay for detecting interactions between two proteins or polypeptides. It can be used to identify proteins that bind to a known protein of interest, or to delineate domains or residues critical for an interaction. Variations on this methodology have been developed to clone genes that encode DNA binding proteins, to identify peptides that bind to a protein, and to screen for drugs. The two-hybrid system exploits the ability of a pair of interacting proteins to bring a transcription activation domain into close proximity with a DNA binding domain that binds to an upstream activation sequence (UAS) of a reporter gene, and is generally performed in yeast. The assay requires the construction of two hybrid genes encoding (1) a DNA-binding domain that is fused to a first protein and (2) an activation domain fused to a second protein. The DNA-binding domain targets the first hybrid protein to the UAS of the reporter gene; however, because most proteins lack an activation domain, this DNA-binding hybrid protein does not activate transcription of the reporter gene. The second hybrid protein, which contains the activation domain, cannot by itself activate expression of the reporter gene because it does not bind the UAS. However, when both hybrid proteins are present, the noncovalent interaction of the first and second proteins tethers the activation domain to the UAS, activating transcription of the reporter gene. For example, when the first protein is a GPCR gene product, or fragment thereof, that is known to interact with another protein or nucleic acid, this assay can be used to detect agents that interfere with the binding interaction. Expression of the reporter gene is monitored as different test agents are added to the system. The presence of an inhibitory agent results in lack of a reporter signal.

The yeast two-hybrid assay can also be used to identify proteins that bind to the gene product. In an assay to identify proteins that bind to a GPCR receptor, or fragment thereof, a fusion polynucleotide encoding both a GPCR receptor (or fragment) and a UAS binding domain (i.e., a first protein) may be used. In addition, a large number of hybrid genes each encoding a different second protein fused to an activation domain are produced and screened in the assay. Typically, the second protein is encoded by one or more members of a total cDNA or genomic DNA fusion library, with each second protein-coding region being fused to the activation domain. This system is applicable to a wide variety of proteins, and it is not even necessary to know the identity or function of the second binding protein. The system is highly sensitive and can detect interactions not revealed by other methods; even transient interactions may trigger transcription to produce a stable mRNA that can be repeatedly translated to yield the reporter protein.

Other assays may be used to search for agents that bind to the target protein. One such screening method to identify direct binding of test ligands to a target protein relies on the principle that proteins generally exist as a mixture of folded and unfolded states, and continually alternate between the two states. When a test ligand binds to the folded form of a target protein (i.e., when the test ligand is a ligand of the target protein), the target protein molecule bound by the ligand remains in its folded state. Thus, the folded target protein is present to a greater extent in the presence of a test ligand which binds the target protein, than in the absence of a ligand. Binding of the ligand to the target protein can be determined by any method that distinguishes between the folded and unfolded states of the target protein. The function of the target protein need not be known in order for this assay to be performed. Virtually any agent can be assessed by this method as a test ligand, including, but not limited to, metals, polypeptides, proteins, lipids, polysaccharides, polynucleotides and small organic molecules.

Another method for identifying ligands of a target protein is described in Wieboldt et al., Anal. Chem., 69:1683-1691 (1997), incorporated herein by reference in its entirety. This technique screens combinatorial libraries of 20-30 agents at a time in solution phase for binding to the target protein. Agents that bind to the target protein are separated from other library components by simple membrane washing. The specifically selected molecules that are retained on the filter are subsequently liberated from the target protein and analyzed by HPLC and pneumatically assisted electrospray (ion spray) ionization mass spectroscopy. This procedure selects library components with the greatest affinity for the target protein, and is particularly useful for small molecule libraries.

Determining whether a test compound binds to a GPCR polypeptide can also be accomplished by measuring the intrinsic fluorescence of the GPCR polypeptide and determining whether the intrinsic fluorescence is modulated in the presence of the test compound. Preferably, the intrinsic fluorescence of GPCR polypeptide is measured as a function of the tryptophan residue(s) of the GPCR. Preferably, fluorescence of the GPCR polypeptide is measured and compared to the fluorescence intensity of the GPCR polypeptide in the presence of the test compound, wherein a decrease in fluorescence intensity indicates binding of the test compound to a GPCR. Preferred methodology is set forth in "Principles of Fluorescence Spectroscopy" by Joseph R. Lakowicz, New York, Plenum Press, 1983 (ISBN 0306412853) and "Spectrophotometry And Spectrofluorometry" by C. L. Bashford and D. A. Harris Oxford, Washington D.C., IRL Press, 1987, each of which is incorporated herein by reference in its entirety.

Other embodiments of the invention comprise using competitive screening assays in which neutralizing antibodies capable of binding a polypeptide of the invention specifically compete with a test compound for binding to the polypeptide. In this manner, the antibodies can be used to detect the presence of any peptide that shares one or more antigenic determinants with a GPCR polypeptide. Radiolabeled competitive binding studies are described in A. H. Lin et al. Antimicrobial Agents and Chemotherapy, 1997, vol. 41, no. 10. pp. 2127-2131, the disclosure of which is incorporated herein by reference in its entirety.

Another aspect of the present invention relates to methods of identifying a compound that binds to or modulates a GPCR polypeptide. The methods comprise contacting a composition comprising a GPCR and Peptide A with a test compound, or a plurality of test compounds, and determining whether the test compound competes with Peptide A for binding to the GPCR polypeptide.

A decrease in the amount of the complex between Peptide A, or a protein homologous thereto, and the GPCR polypeptide in the presence of a test compound or compounds confirms that the compound or compounds binds to the GPCR polypeptide. In some embodiments, the affinity or displacement of Peptide A is measured, wherein a low affinity indicates that the test compound interacts with the GPCR polypeptide. In these methods, the composition that comprises a GPCR polypeptide and Peptide A can be cells. Compounds identified as binding to a GPCR polypeptide are also expected to modulate GPCR activity. Binding of a test compound to a GPCR polypeptide can be determined by any of the binding assays described above.

The invention also provides methods for identifying a modulator of binding between a GPCR polypeptide and a GPCR binding partner, comprising the steps of (a) contacting a GPCR binding partner and a composition comprising a GPCR polypeptide in the presence and in the absence of a putative modulator compound; (b) detecting binding between the binding partner and the GPCR polypeptide; and (c) identifying a putative modulator compound or a modulator compound in view of decreased or increased binding between the binding partner and the GPCR polypeptide in the presence of the putative modulator, as compared to binding in the absence of the putative modulator.

Following steps (a) and (b), compounds identified as modulating binding between GPCR and a GPCR binding partner can be further tested in other assays including, but not limited to, in vivo models, in order to confirm or quantitate modulation of binding to a GPCR polypeptide.

GPCR binding partners that stimulate GPCR activity are useful as agonists in disease states or conditions characterized by insufficient GPCR signaling (e.g., as a result of insufficient activity of a GPCR ligand). GPCR binding partners that block ligand-mediated GPCR signaling are useful as GPCR antagonists to treat disease states or conditions characterized by excessive GPCR signaling. In addition, GPCR modulators in general, as well as GPCR polynucleotides and polypeptides, are useful in diagnostic assays for such diseases or conditions.

In another aspect, the invention provides methods for treating a disease or abnormal condition by administering to a patient in need of such treatment a substance that modulates the activity or expression of a polypeptide having sequences selected from the group consisting of sequences listed in Table 1.

Agents that modulate (i.e., increase, decrease, or block) GPCR activity or expression may be identified by incubating a putative modulator with a cell containing a GPCR polypeptide or polynucleotide and determining the effect of the putative modulator on GPCR activity or expression. The selectivity of a compound that modulates the activity of GPCR can be evaluated by comparing its effects on GPCR to its effect on other GPCR compounds.

Methods of the invention to identify modulators include variations on any of the methods described above to identify binding partner compounds, the variations including techniques wherein a binding partner compound has been identified and the binding assay is carried out in the presence and absence of a candidate modulator. A modulator is identified in those instances where binding between the GPCR polypeptide and the binding partner compound changes in the presence of the candidate modulator compared to binding in the absence of the candidate modulator compound. A modulator that increases binding between the GPCR polypeptide and the binding partner compound is described as an enhancer or activator, and a modulator that decreases binding between the GPCR polypeptide and the binding partner compound is described as an inhibitor. Following identification of modulators, such compounds can be further tested in other assays including, but not limited to, in vivo models, in order to confirm or quantitate their activity as modulators.

The invention also comprehends high-throughput screening (HTS) assays to identify compounds that interact with or inhibit biological activity (i.e., affect enzymatic activity, binding activity, etc.) of a GPCR polypeptide. HTS assays permit screening of large numbers of compounds in an efficient manner. Cell-based HTS systems are contemplated to investigate GPCR receptor-ligand interaction. HTS assays are designed to identify "hits" or "lead compounds" having the desired property, from which modifications can be designed to improve the desired property. Chemical modification of the "hit" or "lead compound" is often based on an identifiable structure/activity relationship between the "hit" and the GPCR polypeptide.

Another aspect of the present invention is directed to methods of identifying compounds which modulate (i.e., increase or decrease) activity of GPCR comprising contacting a GPCR polypeptide with a compound, and determining whether the compound modifies activity of the GPCR. The activity in the presence of the test compared is measured to the activity in the absence of the test compound. Where the activity of the sample containing the test compound is higher than the activity in the sample lacking the test compound, the compound will have increased activity. Similarly, where the activity of the sample containing the test compound is lower than the activity in the sample lacking the test compound, the compound will have inhibited activity.

The present invention is particularly useful for screening compounds by using GPCR in any of a variety of drug screening techniques. The compounds to be screened include (which may include compounds which are suspected to modulate GPCR activity), but are not limited to, extracellular, intracellular, biologic or chemical origin. The GPCR polypeptide employed in such a test may be in any form, preferably, free in solution, attached to a solid support, on a cell surface or located intracellularly. One skilled in the art can, for example, measure the formation of complexes between GPCR and the compound being tested. Alternatively, one skilled in the art can examine the diminution in complex formation between GPCR and its substrate caused by the compound being tested.

The activity of GPCR polypeptides of the invention can be determined by, for example, examining the ability to bind or be activated by chemically synthesized peptide ligands. Alternatively, the activity of GPCR polypeptides can be assayed by examining their ability to bind calcium ions, hormones, chemokines, neuropeptides, neurotransmitters, nucleotides, lipids, odorants, and photons. Alternatively, the activity of the GPCR polypeptides can be determined by examining the activity of effector molecules including, but not limited to, adenylate cyclase, phospholipases and ion channels. Thus, modulators of GPCR polypeptide activity may alter a GPCR receptor function, such as a binding property of a receptor or an activity such as G protein-mediated signal transduction or membrane localization. In various embodiments of the method, the assay may take the form of an ion flux assay, a yeast growth assay, a non-hydrolyzable GTP assay such as a [35S]-GTPγS assay, a cAMP assay, an inositol triphosphate assay, a diacylglycerol assay, an Aequorin assay, a Luciferase assay, a FLIPR assay for intracellular Ca2+ concentration, a mitogenesis assay, a MAP Kinase activity assay, an arachidonic acid release assay (e.g., using [3H]-arachidonic acid), and an assay for extracellular acidification rates, as well as other binding or function-based assays of GPCR activity that are generally known in the art. In several of these embodiments, the invention comprehends the inclusion of any of the G proteins known in the art, such as G 16, G 15, Gs, Gi, Gz, Gq or chimeric G proteins, and the like. GPCR activity can be determined by methodologies that are used to assay-for FARP activity, which is well known to those skilled in the art. Biological activities of GPCR receptors according to the invention include, but are not limited to, the binding of a natural or an unnatural ligand, as well as any one of the functional activities of GPCRs known in the art. Non-limiting examples of GPCR activities include transmembrane signaling of various forms, which may involve G protein association and/or the exertion of an influence over G protein binding of various guanidylate nucleotides; another exemplary activity of GPCRs is the binding of accessory proteins or polypeptides that differ from known G proteins.

The modulators of the invention exhibit a variety of chemical structures, which can be generally grouped into non-peptide mimetics of natural GPCR receptor ligands, peptide and non-peptide allosteric effectors of GPCR receptors, and peptides that may function as activators or inhibitors (competitive, uncompetitive and non-competitive) (e.g., antibody products) of GPCR receptors. The invention does not restrict the sources for suitable modulators, which may be obtained from natural sources such as plant, animal or mineral extracts, or non-natural sources such as small molecule libraries, including the products of combinatorial chemical approaches to library construction, and peptide libraries. Examples of peptide modulators of GPCR receptors exhibit the following primary structures: GLGPRPLRFamide, GNSFLRFamide, GGPQGPLRFamide, GPSGPLRFamide, PDVDHVFLRFamide, and pyro-EDVDHVFLRFamide.

Other assays can be used to examine enzymatic activity including, but not limited to, photometric, radiometric, BPLC, electrochemical, and the like, which are described in, for example, Enzyme Assays: A Practical Approach, eds. R. Eisenthal and M. J. Danson, 1992, Oxford University Press, which is incorporated herein by reference in its entirety.

The use of cDNAs encoding GPCRs in drug discovery programs is well-known; assays capable of testing thousands of unknown compounds per day in high-throughput screens (HTSs) are thoroughly documented. The literature is replete with examples of the use of radiolabelled ligands in HTS binding assays for drug discovery (see Williams, Medicinal Research Reviews, 1991, 11, 147-184; Sweetnam, et al., J Natural Products, 1993, 56, 441-455 for review).

Recombinant receptors are preferred for binding assay HTS because they allow for better specificity (higher relative purity), provide the ability to generate large amounts of receptor material, and can be used in a broad variety of formats (see Hodgson, Bio/Technology, 1992, 10, 973-980; each of which is incorporated herein by reference in its entirety).

A variety of heterologous systems is available for functional expression of recombinant receptors that are well known to those skilled in the art. Such systems include bacteria (Strosberg, et al., Trends in Pharmacological Sciences, 1992, 13, 95-98), yeast (Pausch, Trends in Biotechnology, 1997, 15, 487-494), several kinds of insect cells (Vanden Broeck, Int. Rev. Cytology, 1996, 164, 189-268), amphibian cells (Jayawickreme et al., Current Opinion in Biotechnology, 1997, 8, 629-634) and several mammalian cell lines (CHO, HEK293, COS, etc.; see Gerhardt, et al., Eur. J. Pharmacology, 1997, 334, 1-23). These examples do not preclude the use of other possible cell expression systems, including cell lines obtained from nematodes.

In preferred embodiments of the invention, methods of screening for compounds that modulate GPCR activity comprise contacting test compounds with GPCR and assaying for the presence of a complex between the compound and GPCR. In such assays, the ligand is typically labeled. After suitable incubation, free ligand is separated from that present in bound form, and the amount of free or uncomplexed label is a measure of the ability of the particular compound to bind to GPCR.

It is well known that activation of heterologous receptors expressed in recombinant systems results in a variety of biological responses, which are mediated by G proteins expressed in the host cells. Occupation of a GPCR by an agonist results in exchange of bound GDP for GTP at a binding site on the G alpha subunit; one can use a radioactive, non-hydrolyzable derivative of GTP, GTPγ[35S], to measure binding of an agonist to the receptor (Sim et al., Neuroreport, 1996, 7, 729-733). One can also use this binding to measure the ability of antagonists to bind to the receptor by decreasing binding of GTPγ[35S] in the presence of a known agonist.

The G proteins can be intact or chimeric. Often, a nearly universally competent G protein (e.g., G16) is used to couple any given receptor to a detectable response pathway. G protein activation results in the stimulation or inhibition of other native proteins, events that can be linked to a measurable response. Examples of such biological responses include, but are not limited to, the following: the ability to survive in the absence of a limiting nutrient in specifically engineered yeast cells (Pausch, Trends in Biotechnology, 1997, 15, 487-494); changes in intracellular Ca2+ concentration as measured by fluorescent dyes (Murphy, et al., Cur. Opinion Drug Disc. Dev., 1998, 1, 192-199). Fluorescence changes can also be used to monitor ligand-induced changes in membrane potential or intracellular pH; an automated system suitable for HTS has been described for these purposes (Schroeder, et al., J Biomolecular Screening, 1996, 1, 75-80).

Melanophores prepared from *Xenopus laevis* show a ligand-dependent change in pigment organization in response to heterologous GPCR activation; this response is adaptable to HTS formats (Jayawickreme et al., Cur. Opinion Biotechnology, 1997, 8, 629-634). Assays are also available for the measurement of common second messengers, including cAMP, phosphoinositides and arachidonic acid, but these are not generally preferred for HTS.

Preferred methods of HTS employing these receptors include permanently transfected CHO cells, in which agonists and antagonists can be identified by the ability to specifically alter the binding of GTPγ[35S] in membranes prepared from these cells. In another embodiment of the invention, permanently transfected CHO cells could be used for the preparation of membranes which contain significant amounts of the recombinant receptor proteins; these membrane preparations would then be used in receptor binding assays, employing the radiolabelled ligand specific for the particular receptor. Alternatively, a functional assay, such as fluorescent monitoring of ligand-induced changes in internal calcium concentration or membrane potential in permanently transfected CHO cells containing each of these receptors individually or in combination would be preferred for HTS. Equally preferred would be an alternative type of mammalian cell, such as HEK293 or COS cells, in similar formats. More preferred would be permanently transfected insect cell lines, such as *Drosophila* S2 cells. Even more preferred would be recombinant yeast cells expressing the *Drosophila melanogaster* receptors in HTS formats well known to those skilled in the art (e.g., Pausch, Trends in Biotechnology, 1997, 15, 487-494).

The invention contemplates a multitude of assays to screen and identify inhibitors of ligand binding to GPCR receptors. In one example, the GPCR receptor is immobilized and interaction with a binding partner is assessed in the presence and absence of a candidate modulator such as an inhibitor compound. In another example, interaction between the GPCR receptor and its binding partner is assessed in a solution assay, both in the presence and absence of a candidate inhibitor compound. In either assay, an inhibitor is identified as a compound that decreases binding between the GPCR receptor and its binding partner.

Still other candidate inhibitors contemplated by the invention can be designed and include soluble forms of binding partners, as well as such binding partners as chimeric, or fusion, proteins. A "binding partner" as used herein broadly encompasses non-peptide modulators, as well as such peptide modulators as neuropeptides other than natural ligands, antibodies, antibody fragments, and modified compounds comprising antibody domains that are immunospecific for the expression product of the identified GPCR gene.

Compounds may be identified which exhibit similar properties to the ligand for the GPCR of the invention, but which are smaller and exhibit a longer half time than the endogenous ligand in a human or animal body. When an organic compound is designed, a molecule according to the invention is used as a "lead" compound. The design of mimetics to known pharmaceutically active compounds is a well-known approach in the development of pharmaceuticals based on such "lead" compounds. Mimetic design, synthesis and testing are generally used to avoid randomly screening a large number of molecules for a target property.

Furthermore, structural data deriving from the analysis of the deduced amino acid sequences encoded by the DNAs of the present invention are useful to design new drugs, more specific and therefore with a higher pharmacological potency.

The present invention also encompasses a method of agonizing (stimulating) or antagonizing a GPCR natural binding partner associated activity in a mammal comprising administering to said mammal an agonist or antagonist to one of the above disclosed polypeptides in an amount sufficient to effect said agonism or antagonism. One embodiment of the present invention, then, is a method of treating diseases in a mammal with an agonist or antagonist of the protein of the present invention comprises administering the agonist or antagonist to a mammal in an amount sufficient to agonize or antagonize GPCR-associated functions.

In certain embodiments, the present invention provides methods of identifying and producing compounds useful in the treatment or prevention of neurological or metabolic diseases and disorders, including, e.g., compounds that modulate an SREB for the treatment or prevention of a neurological or metabolic disease or disorder, and compounds that modulate GPR88 or GPR22 for the treatment or prevention of a neurological disease or disorder. These compounds include modulators (i.e., inhibitors and inducers, including antagonists and agonists) of GPCR, e.g., SREB1, SREB2, SREB3, GPR22, and/or GPR88, expression and/or activity.

Set forth below are several nonlimiting methods for identifying modulators (agonists and antagonists) of GPCR activity. Among the modulators that can be identified by these assays are natural ligand compounds of the receptor; synthetic analogs and derivatives of natural ligands; antibodies, antibody fragments, and/or antibody-like compounds derived from natural antibodies or from antibody-like combinatorial libraries; and/or synthetic compounds identified by high-throughput screening of libraries; and the like. All modulators that bind GPCRs are useful for identifying GPCRs in tissue samples (e.g., for diagnostic purposes, pathological purposes, and the like). Agonist and antagonist modulators are useful for up-regulating and down-regulating GPCR activity, respectively, to treat disease states characterized by abnormal levels of GPCR activity. The assays may be performed using single putative modulators, and/or may be performed using a known agonist in combination with candidate antagonists (or visa versa).

A. cAMP Assays

In one type of assay, levels of cyclic adenosine monophosphate (cAMP) are measured in GPCR-transfected cells that have been exposed to candidate modulator compounds. Protocols for cAMP assays have been described in the literature (See, e.g., Sutherland et aL, Circulation 37: 279 (1968); Frandsen et aL, Life Sciences 18: 529-541 (1976); Dooley et aL, Journal of Pharmacology and Experimental Therapeutics 283 (2): 735-41 (1997); and George et aL, Journal of Biomolecular Screening 2 (4): 235-40 (1997)). An exemplary protocol for such an assay, using an Adenylyl Cyclase Activation FlashPlate Assay from NEN™ Life Science Products, is set forth below.

Briefly, the GPCR coding sequence (e.g., a cDNA or intronless genomic DNA) selected from the group consisting of sequences listed in Table 1, is subcloned into a commercial expression vector, such as pzeoSV2 (Invitrogen), and transiently transfected into Chinese Hamster Ovary (CHO) cells using known methods, such as the transfection protocol provided by Boehringer-Mannheim when supplying the FuGENE 6 transfection reagent. Transfected CHO cells are seeded into 96-well microplates from the FlashPlate (which are coated with solid scintillant to which antisera to cAMP has been bound). For a control, some wells are seeded with wild type (untransfected) CHO cells. Other wells in the plate receive various amounts of a cAMP standard solution for use in creating a standard curve.

One or more test compounds (i.e., candidate modulators) are added to the cells in each well, with water and/or compound-free medium/diluent serving as a control or controls. After treatment, cAMP is allowed to accumulate in the cells for exactly 15 minutes at room temperature. The assay is terminated by the addition of lysis buffer containing labeled cAMP, and the plate is counted using a Packard Topcount™ 96-well microplate scintillation counter. Unlabeled cAMP from the lysed cells (or from standards) and fixed amounts of cAMP compete for antibody bound to the plate. A standard curve is constructed, and cAMP values for the unknowns are obtained by interpolation. Changes in intracellular cAMP levels of cells in response to exposure to a test compound are indicative of GPCR modulating activity.

Modulators that act as agonists of receptors which couple to certain G proteins will stimulate production of cAMP, leading to a measurable 3-10 fold increase in cAMP levels.

Agonists of receptors which couple to the Gi/z subtype of G proteins will inhibit forskolin stimulated cAMP production, leading to a measurable decrease in cAMP levels of 50-100%. Modulators that act as inverse agonists will reverse these effects at receptors that are either constitutively active or activated by known agonists.

GPCR modulators that act as agonists at receptors which couple to the Gs subtype of G proteins will activate adenyly cyclase leading to a 3-10 fold increase in cyclic adenosine monophosphate (cAMP). Compounds to be tested for the ability to activate GPCR were assayed for cAMP using an Adenylyl Cyclase Activation FlashPlate@ Assay from NEN™ Life Science Products.

In a similar assay to measure cAMP release, a GPCR cDNA is subcloned into the commercial expression vector pCMVSport (Gibco/Life Technologies) and transiently transfected into CHO or COS 7 cells using the transfection reagent FuGENE 6 (Boehringer-Mannheim) and the transfection protocol provided in the product insert. 24 hours post transfection the cells are harvested by dislodging from the culture flask using Versene (Gibco/BRL). The cells are counted and prepared as a suspension in a buffer included in the assay kit that contains the phophodiesterase inhibitor isobutyhnethylxanthine. The assay is conducted in a special 96 well microplate included in the kit which is coated with solid scintillant to which antisera to cAMP has been bound. Dilutions of test compounds to be tested for activation of GPCR are added to assay wells. Several wells on the plate receive various amounts of cAMP standard solution. After the addition of cells transiently expressing GPCR, cAMP is allowed to accumulate for exactly 15 minutes at room temperature. The assay is terminated by the addition of lysis buffer containing labelled cAMP, and the plate is covered and allowed to incubate at room temperature for 2-24 hours. The plate is then counted using a Packard Topcount™ 96-well microplate scintillation counter.

Unlabelled cAMP from cells (or standards) competes with fixed amounts of labelled cAMP for antibody bound to the plate. A standard curve is constructed and CAMP values for the unknowns are obtained by interpolation. Data were analyzed using GraphPad Prism (San Diego, Calif.).

B. Aequorin Assays

In another assay, cells (e.g., CHO cells) are transiently co-transfected with both a GPCR expression construct and a construct that encodes the photoprotein apoaquorin. In the presence of the cofactor coelenterazine, apoaquorin will emit a measurable luminescence that is proportional to the amount of intracellular (cytoplasmic) free calcium (Cobbold, et al. "Acquorin measurements of cytoplasmic free calcium," In: McCormack J. G. and Cobbold P. H., eds., Cellular Calcium: A Practical Approach. Oxford: IRL Press (1991); Stables et al., Analytical Biochemistry 252: 115-26 (1997); and Haugland, Handbook of Fluorescent Probes and Research Chemicals, Sixth edition. Eugene Oreg.: Molecular Probes (1996)). In one exemplary assay, GPCR is subcloned into the commercial expression vector pzeoSV2 (Invitrogen) and transiently co-transfected along with a construct that encodes the photoprotein apoaquorin (Molecular Probes, Eugene, Oreg.) into CHO cells using the transfection reagent FuGENE 6 (Boehringer-Mannheim) and the transfection protocol provided in the product insert.

The cells are cultured for 24 hours at 37 C in MEM (Gibco/BRL, Gaithersburg, Md.) supplemented with 10% fetal bovine serum, 2 mM glutainine, 10 U/ml penicillin and 10 µg/ml streptomycin, at which time the medium is changed to serum-free MEM containing coelenterazine (Molecular Probes, Eugene, Oreg.). Culturing is then continued for two additional hours at 37 C. Subsequently, cells are detached from the plate using VERSEN (Gibco/BRL), washed, and resuspended at 200,000 cells/ml in serum free MEM.

Dilutions of candidate GPCR modulator compounds are prepared in serum free MEM and dispensed into wells of an opaque 96-well assay plate. Plates are then loaded onto an MLX microtiter plate luminometer (Dynex Technologies, Inc., Chantilly, Va.). The instrument is programmed to dispense cell suspensions into each well, one well at a time, and immediately read luminescence for 15 seconds. Dose-response curves for the candidate modulators are constructed using the area under the curve for each light signal peak. Data are analyzed with SlideWrite, using the equation for a one-site ligand, and EC50 values are obtained. Changes in luminescence caused by the compounds are considered indicative of modulatory activity. Modulators that act as agonists at receptors which couple to the Gq subtype of G proteins give an increase in luminescence of up to 100 fold. Modulators that act as inverse agonists will reverse this effect at receptors that are either constitutively active or activated by known agonists. GPCR agonist activation of receptors that couple to the Gq subtype of G proteins will lead to the release of intracellular calcium. The photoprotein aequorin emits a characteristic luminescence in the presence of calcium and may be expressed in cells along with the receptor of interest in order to report agonist signalling.

Briefly, GPCR cDNA selected from the group consisting of sequences listed in Table 1, is subcloned into the commercial expression vector pCMVSport (Gibco/Life Technologies) and transiently transfected along with an Aequorin expression construct (Molecular Probes, Eugene, Oreg.) into COS 7 cells using the transfection reagent FuGENE 6 (Boehringer-Mannheim) and the transfection protocol provided in the product insert. 24 hours post transfection the cells are harvested by dislodging from the culture flask using Versene (Gibco/BRL) and prepared as a suspension in assay buffer (Dulbecco's Modified Eagle's Medium with high glucose, pyridoxine HCl, L-glutamine, sodium pyruvate, and 0.1% fetal bovine serum (Gibco/BRL)) and containing the cofactor coelenterazine (Molecular Probes). The cell suspension is incubated for 4 hours at room temperature with gentle stirring. After the coelenterazine loading incubation, the cells are counted and diluted to 1,000,000 cells/ml in assay buffer. Dilutions of test compound are prepared in assay buffer and pipetted into wells of an opaque 96-well assay plate. Plates are loaded onto an MLX microtiter plate luminometer (Dynex Technologies, Chantilly, Va.). The instrument is programmed to dispense cell suspension into each well, one well at a time, and immediately read luminescence for 20 seconds. Dose response curves are constructed using the area under the curve for each light signal peak Luciferase Reporter Gene Assay The photoprotein luciferase provides another useful tool for assaying for modulators of GPCR activity. Cells (e.g., CHO cells or COS 7 cells) are transiently co-transfected with both a GPCR expression construct (e.g., GPCR in pzeoSV2) and a reporter construct which includes a gene for the luciferase protein downstream from a transcription factor binding site, such as the cAMP-response element (CRE), AP-1, or NF-kappa B. Agonist binding to receptors coupled to the G, subtype of G proteins leads to increases in cAMP, thereby activating the CRE transcription factor and resulting in expression of the luciferase gene. Agonist binding to receptors coupled to the Gq subtype of G protein leads to production of diacylglycerol that activates protein kinase C, which activates the AP-1 or NF-kappa B transcription factors, in turn resulting in expression of the luciferase gene. Expression levels of luciferase reflect the activation status of the signaling events (George et al., Journal of Biomolecular Screening, 2(4): 235-240 (1997); and Stratowa et al., Current Opinion in Biotechnology 6: 574-581 (1995)). Luciferase activity may be quantitatively measured using, e.g., luciferase assay reagents that are commercially available from Promega (Madison, Wis.).

In one exemplary assay, CHO cells are plated in 24-well culture dishes at a density of 100,000 cells/well one day prior to transfection and cultured at 37° C. in MEM (Gibco/13RL) supplemented with 10% fetal bovine serum, 2 mM glutamine, 10 U/ml penicillin and 10 Lg/ml streptomycin. Cells are transiently co-transfected with both a GPCR expression construct and a reporter construct containing the luciferase gene. The reporter plasmids CRE-luciferase, AP1-luciferase and NF-kappaB-luciferase may be purchased from Stratagene (LaJolla, Calif.).

Transfections are performed using the FuGENE 6 transfection reagent (Boehringer-Mannheim) according to the supplier's instructions. Cells transfected with the reporter construct alone are used as a control. Twenty-four hours after transfection, cells are washed once with PBS pre-warmed to 37° C. Serum-free MEM is then added to the cells either alone (control) or with one or more candidate modulators and the cells are incubated at 37° C. for five hours. Thereafter, cells are washed once with ice-cold PBS and lysed by the addition of lysis buffer from the luciferase assay kit supplied by Promega. After incubation for 15 minutes at room temperature, lysate is mixed with substrate solution (Promega) in an opaque-white, 96-well plate, and the luminescence is read immediately on a Wallace model 1450 MicroBeta scintillation and luminescence counter (Wallace Instruments, Gaithersburg, Md.). Differences in luminescence in the presence versus the absence of a candidate modulator compound are indicative of modulatory activity. Receptors that are either constitutively active or activated by agonists typically give a 3 to 20-fold stimulation of luminescence compared to cells transfected with the reporter gene alone. Modulators that act as inverse agonists will reverse this effect.

C. Intracellular Calcium Measurement Using FLIPR

Changes in intracellular calcium levels are another recognized indicator of G protein-coupled receptor activity, and such assays can be employed to screen for modulators of GPCR activity. For example, CHO cells stably transfected with a GPCR expression vector are plated at a density of 40,000 cells/well in 96-well plates specially designed to discriminate fluorescence signals emanating from the various wells on the plate. The cells are incubated for 60 minutes at 37° C. in modified Dulbecco's PBS containing pyruvate and 1 g/L glucose with the addition of 1% fetal bovine serum and one of four calcium indicator dyes (Fluo-3™ AM, Fluo-4™ AM, Calcium Green™-1 AM, or Oregon Green™ BAPTA-1 AM). Plates are washed once with modified Dulbecco's PBS without 1% fetal bovine serum and incubated for 10 minutes at 37° C. to remove residual dye from the cellular membrane. In addition, a series of washes with modified Dulbecco's PBS without fetal bovine serum is performed immediately prior to activation of the calcium response. A calcium response is initiated by the addition of one or more candidate receptor agonist compounds, calcium ionophore A23187 (positive control), or ATP (positive control). Fluorescence is measured by Molecular Device's FLIPR with an argon laser (excitation 144 at 488 mn) (Kuntzweiler et al., Drug Development Research, 44(1):14-20 (1998)).

Basal fluorescence of cells was measured for 20 seconds prior to addition of candidate agonist, ATP, or A23187, and the basal fluorescence level was subtracted from the response signal. The calcium signal is measured for approximately 200 seconds, taking readings every two seconds. Calcium ionophore A23187 and ATP increase the calcium signal 200% above baseline levels. In general, activated GPCRs increase the calcium signal. approximately 10-15% above baseline signal.

GPCR HEK293 cells were transiently transfected with an expression vector containing the nucleic acid of a GPCR selected from the group consisting of sequences listed in Table 1 and empty vector using Lipofectamine plus (Gibco) according to the manufacturer's instructions. The next day, the cells were seeded into 96-well plates at 25,000 cells per well. The following day, cells were loaded with 1 uM Fluo-4-acetoxymethyl fluorescent indicator dye (Molecular Probes) in MEM (minimal essential media) containing 0.1% bovine serum albumin, 0.04% pluronic acid and 2.5 mM probenecid for 30 minutes at 37° C. The cells were washed with pre-warmed (37° C.) assay buffer (Hanks buffer containing 15 mM HEPES, 2.5 mM probenecid and 0.1% bovine serum albumin). Assay buffer (100 ul) was added to each well and plates were incubated at 37° C. for 15 minutes. Various concentrations (0.03 pM-10 nM) of human Peptide A or salmon Peptide B were added and fluorescence produced by fluo-4 (a calcium sensitive dye) was measured every second for 150 seconds on a fluorometric imaging plate reader (FLIPR; Molecular Devices).

E. Mitogenesis Assay

In a mitogenesis assay, the ability of candidate modulators to induce or inhibit GPCR mediated cell division is determined (See, e.g., Lajiness et al., Journal of Pharmacology and Experimental Therapeutics 267(3): 1573-1581-(1-993)). For example, CHO cells stably expressing GPCR are seeded into 96-well plates at a density of 5000 cells/well and grown in MEM with 10% fetal calf serum for 48 hours, at which time the cells are rinsed twice with serum-free MEM. After rinsing, fresh MEM, or MEM containing a known mitogen, is added along with MEM containing varying concentrations of one or more candidate modulators or test compounds diluted in serum-free medium. As controls, some wells on each plate receive serum-free medium alone, and some receive medium containing 10% fetal bovine serum. Untransfected cells or cells transfected with vector alone also may serve as controls. After culture for 16-18 hours, [3H]-thymidine is added to the wells and cells are incubated for an additional 2 hours at 37° C. The cells are trypsinized and collected on filter mats with a cell harvester, the filters are then counted in a Betaplate counter. The incorporation of [3H]-thymidine in serum-free test wells is compared to the results achieved in cells stimulated with serum (positive control). Use of multiple concentrations of test compounds permits creation and analysis of dose-response curves using the non-linear, least squares fit equation: A=B×[C/(D+Q+G where A is the percent of serum stimulation; B is the maximal effect minus baseline; C is the EC50; D is the concentration of the compound; and G is the maximal effect. Parameters B, C and G are determined by Simplex optimization. Agonists that bind to the receptor are expected to increase [3H]-thymidine incorporation into cells, showing up to 80% of the response to serum. Antagonists that bind to the receptor will inhibit the stimulation seen with a known agonist by up to 100%.

D. GTPγS Binding Assay

Because G protein-coupled receptors signal through intracellular G proteins whose activity involves GTP binding and hydrolysis to yield bound GDP, measurement of binding of the non-hydrolyzable GTP analog [35S]-GTPγS in the presence and absence of candidate modulators provides another assay for modulator activity (See, e.g., Kowal et al., Neuropharmacology 37:179-187 (1998)). In one exemplary assay, cells stably transfected with a GPCR expression vector are grown in 10 cm tissue culture dishes to subconfluence, rinsed once with 5 ml of ice-cold Ca2+/Mg2+-free phosphate-buffered saline, and scraped into 5 ml of the same buffer. Cells are pelleted by centrifugation (500×g, 5 minutes), resuspended in TEE buffer (25 mM Tris, pH 7.5, 5 mM EDTA, 5 mM EGTA), and frozen in liquid nitrogen. After thawing, the cells are homogenized using a Dounce homogenizer (one ml TEE per plate of cells), and centrifuged at 1,000×g for 5 minutes to remove nuclei and unbroken cells.

The homogenate supernatant is centrifuged at 20,000×g for 20 minutes to isolate the membrane fraction, and the membrane pellet is washed once with TEE and resuspended in binding buffer (20 mM HEPES, pH 7.5, 150 mM NaCl, 10 mm MgCl2, 1 mM EDTA). The resuspended membranes can be frozen in liquid nitrogen and stored at −70° C. until use. Aliquots of cell membranes prepared as described above and stored at −70° C. are thawed, homogenized, and diluted. Final homogenates are incubated with varying concentrations of candidate modulator compounds or GTP for 30 minutes at 30° C. and then placed on ice. To each sample, guanosine 5'-0-(3 [35S thio)triphosphate (NEN, 1200 Ci/mmol; [35S]-GTPγS), was added to a final concentration of 100-200 pM. Samples are incubated at 30 C for an additional 30 minutes, 1 ml of 10 mM HEPES, pH 7.4, 10 mM MgCl2, at 4 C is added and the reaction is stopped by filtration.

Samples are filtered over Whatman GF/B filters and the filters are washed with 20 ml ice-cold 10 mM HEPES, pH 7.4, 10 mM MgCl2. Filters are counted by liquid scintillation spectroscopy. Nonspecific binding of [35S]-GTPγS is measured in the presence of GTP and subtracted from the total. Compounds are selected that modulate the amount of [35S]-GTPγS binding in the cells, compared to untransfected control cells. Activation of receptors by agonists gives up to a five-fold increase in [35S] GTPγS binding. This response is blocked by antagonists.

E. MAP Kinase Activity Assay

Evaluation of MAP kinase activity in cells expressing a GPCR provides another assay to identify modulators of GPCR activity (Lajiness et al., Journal of Pharmacology and Experimental Therapeutics 267(3):1573-1581 (1993) and Boulton et al., Cell 65: 663-675 (1991)). In one embodiment, CHO cells stably transfected with GPCR are seeded into 6-well plates at a density of 70,000 cells/well 48 hours prior to the assay. During this 48-hour period, the cells are cultured at 37 C in MEM medium supplemented with 10% fetal bovine serum, 2 mM glutamine, 10 U/ml penicillin and streptomycin. The cells are serum-starved for 1-2 hours prior to the addition of stimulants.

For the assay, the cells are treated with medium alone or medium containing either a candidate agonist or 200 nM Phorbol ester-myristoyl acetate (i.e., PMA, a positive control), and the cells are incubated at 37 C for varying times. To stop the reaction, the plates are placed on ice, the medium is aspirated, and the cells are rinsed with 1 ml of ice-cold PBS containing EDTA. Thereafter, cell lysis buffer is added to the cells. The cells are scraped from the plates and homogenized by 10 passages through a 23 G needle, and the cytosol fraction is prepared by centrifugation at 20,000×g for 15 minutes. Aliquots of cytosol are mixed with MAPK Substrate Peptide (APRTPGGRR, Upstate Biotechnology, Inc., N.Y.) and [γ-32 P] ATP (NEN, 3000 Ci/mmol), diluted to a final specific activity of 2000 cpm/pmol. The samples are incubated for 5 minutes at 30 C, and reactions are stopped by spotting on Whatman P81 phosphocellulose paper. The filter squares are washed and are subjected to liquid scintillation spectroscopy to quantitate bound label. Equivalent cytosolic extracts are incubated without MAPK substrate peptide, and the bound label from these samples are subtracted from the matched samples with the substrate peptide. The cytosolic extract from each well is used as a separate point. Protein concentrations are determined by a dye binding protein assay (Bio-Rad Laboratories). Agonist activation of the receptor is expected to result in up to a five-fold increase in MAPK enzyme activity. This increase is blocked by antagonists.

F. Arachidonic Acid Release

The activation of GPCRs also has been observed to potentiate arachidonic acid release in cells, providing yet another useful assay for modulators of GPCR activity (Kanterman et al., Molecular Pharmacology 3 9:3 64-3 69 (1991)). For example, CHO cells that are stably transfected with a GPCR expression vector are plated in 24 well plates at a density of 15,000 cells/well and grown in MEM medium supplemented with 10% fetal bovine serum, 2 mM glutamine, 10 U/ml penicillin and streptomycin for 48 hours at 37 C before use. Cells of each well are labeled by incubation with [3H]-arachidonic acid (Amersham Corp., 210 Ci/mmol) for 2 hours at 37 C. The cells are then washed twice with 1 ml of buffer. Candidate modulator compounds are added in 1 ml of the same buffer, either alone or with ATP and the cells are incubated at 37 C for 30 minutes. Buffer alone and mock transfected cells are used as controls. Samples (0.5 ml) from each well are counted by liquid scintillation spectroscopy. Agonists which activate the receptor will lead to potentiation of the ATP-stimulated release of [3H]-arachidonic acid. This potentiation is blocked by antagonists.

G. Extracellular Acidification Rate

In yet another assay, the effects of candidate modulators of GPCR activity are assayed by monitoring extracellular changes in pH induced by the test compounds (See, e.g., Dunlop et al., Journal of Pharmacological and Toxicological Methods 40(1):47-55 (1998)). In one embodiment, CHO cells transfected with a GPCR selected from the group consisting of sequences listed in Table 1 in an expression vector are seeded into 12 min capsule cups (Molecular Devices Corp.) at 400,000 cells/cup in MEM supplemented with 10% fetal bovine serum, 2 mM L-glutamine, 10 U/ml penicillin, and 10 µg/ml streptomycin. The cells are incubated in this medium at 37 C in 5% CO2 for 24 hours. Extracellular acidification rates are measured using a Cytosensor microphysiometer (Molecular Devices Corp.). Candidate agonists or other agents are diluted into the running buffer and perfused through a second fluid path. The pH of the running buffer in the sensor chamber is recorded during the cycle from 43-58 seconds, and the pump is re-started at 60 seconds to start the next cycle. The rate of acidification of the running buffer during the recording time is calculated by the Cytosoft program. Changes in the rate of acidification are calculated by subtracting the baseline value (the average of 4 rate measurements immediately before addition of a modulator candidate) from the highest rate measurement obtained after addition of a modulator candidate. Modulators that act as agonists of the receptor result in an increase in the rate of extracellular acidification compared to the rate in the absence of agonist. This response is blocked by modulators which act as antagonists of the receptor.

H. Radio Ligand Binding Assay

HEK 293 or COS7 cells transiently expressing or CHO K-1 cells stably expressing a GPCR selected from the group consisting of sequences listed in Table 1, were grown to sub-confluence, harvested from flasks in Dulbecco's PBS and pelleted. Cell pellets were homogenized in 10 ml tissue buffer using a dounce, 10 strokes. Homogenate was centrifuged at 47,000×g for 15 minutes. Membrane pellet was resuspended in 1 ml tissue buffer using the dounce, 10 strokes. An aliquot of the membrane preparation was used to determine protein concentration. For measurement of saturation binding, Cell membranes were incubated with various concentrations of labelled agonist Peptide (iodinated by routine procedures via the Tyr residue) in binding assay buffer for 90 minutes at room temperature in 96-well plates. Non-specific binding was defined by the inclusion of unlabeled agonist Peptide. After the binding incubation, plates were harvested onto GF/C filters presoaked in 0.3% non-fat dry milk. Filters were dried, and counted in a 96-well microplate scintillation counter. Data were analyzed using GraphPad Prism (San Diego, Calif.) and Kd values were calculated.

Identification of Natural GPCR Ligands

Isolated GPCRs can be used to isolate novel or known ligands (Saito et al., Nature, 400: 265-269, 1999). The cDNAs that encode the isolated GPCR selected from the group consisting of sequences listed in Table 1, can be cloned into mammalian expression vectors and used to stably or transiently transfect mammalian cells including CHO, Cos or HEK293 cells. Receptor expression can be determined by Northern blot analysis of transfected cells and identification of an appropriately sized mRNA band (predicted size from the cDNA) or PCR. Tissues shown by mRNA analysis to express each of the GPCR proteins could be processed for ligand extraction using any of several protocols ((Reinsheidk R. K. et al., Science 270: 243-247, 1996; Sakurai, T., et al., Cell 92; 573-585, 1998; Hinuma, S., et al., Nature 393: 272-276, 1998). Chromotographic fractions of brain extracts could be tested for ability to activate GPCR proteins by measuring second messenger production such as changes in cAMP production in the presence or absence of forskolin, changes in inositol 3-phosphate levels, changes in intracellular calcium levels or by indirect measures of receptor activation including receptor stimulated mitogenesis, receptor mediated changes in extracellular acidification or receptor mediated changes in reporter gene activation in response to cAMP or calcium (these methods are referenced in other sections of the patent). Receptor activation could also be monitored by co-transfecting cells with a chimeric Gq/i3 to force receptor coupling to a calcium stimulating pathway (Conklin et al., Nature 363; 274-276, 1993). Ligand mediated activation of receptors could also be monitored by measuring changes in [35S]-GTPγS binding in membrane fractions prepared from transfected mammalian cells. This assay could also be performed using baculoviruses containing GPCR proteins infected into SF9 insect cells.

The ligand which activates GPCR proteins can be purified to homogeneity through successive rounds of purification using GPCR proteins activation as a measurement of neurotransmitter activity. The composition of the ligand can be determined by mass spectrometry and other methods. Ligands isolated in this manner will be bioactive materials which will affect physiological processes.

Protein Interaction Assays

Protein interaction assays may also be utilized to identify GPCR modulator compounds. To carry out such an assay, a GPCR polypeptide of the invention (or a polypeptide fragment thereof or an epitope-tagged form or fragment thereof) is harvested from a suitable source (e.g., from a prokaryotic expression system, eukaryotic cells, a cell-free system, or by immunoprecipitation from GPCR polypeptide-expressing cells). The GPCR polypeptide is then bound to a suitable support (e.g., nitrocellulose or an antibody or a metal agarose column in the case of, for example, a his-tagged form of a GPCR polypeptide). Binding to the support is preferably done under conditions that allow polypeptides associated with a GPCR polypeptide to remain associated with it. Such conditions may include use of buffers that minimize interference with protein-protein interactions. The binding step can be done in the presence and absence of compounds being tested for their ability to interfere with interactions between a GPCR polypeptide of the invention and other molecules. If desired, other proteins (e.g., a cell lysate) are added, and allowed time to associate with the polypeptide. The immobilized GPCR polypeptide is then washed to remove proteins or other cell constituents that may be non-specifically associated with the polypeptide or the support. The immobilized GPCR polypeptide is then dissociated from its support, and so that proteins bound to it are released (for example, by heating), or alternatively, associated proteins are released from the GPCR polypeptide without releasing the GPCR polypeptide from the support. The released proteins and other cell constituents can be analyzed, for example, by SDS-PAGE gel electrophoresis, western blotting and detection with specific antibodies, phosphoamino acid analysis, protease digestion, protein sequencing, or isoelectric focusing. Normal and polymorphic (or mutagenized) forms of a GPCR polypeptide of the invention can be employed in these assays to gain additional information about the part of a GPCR polypeptide to which a given factor binds. In addition, when incompletely purified polypeptide is employed, comparison of the normal and polymorphic forms of the polypeptide can be used to help distinguish true binding proteins.

The proceeding assay can be performed using a purified or semipurified protein or other molecule that is known to interact with a GPCR polypeptide of the invention. This assay may include the following steps.

1. Harvest a GPCR polypeptide of the invention and couple a suitable fluorescent label to it;

2. Label an interacting polypeptide (or other molecule) with a second, different fluorescent label. Use dyes that will produce different quenching patterns when they are in close proximity to each other vs. when they are physically separated (i.e., dyes that quench each other when they are close together but fluoresce when they are not in close proximity);

3. Expose the interacting molecule to the immobilized GPCR polypeptide in the presence or absence of a compound being tested for its ability to interfere with an interaction between the two; and 4. Collect fluorescent readout data.

Another assay includes a Fluorescent Resonance Energy Transfer (FRET) assay. This assay can be performed as follows.

1. Provide a GPCR polypeptide of the invention or a suitable polypeptide fragment thereof and couple a suitable FRET donor (e.g., nitro-benzoxadiazole (NBD)) to it;

2. Label an interacting polypeptide (or other molecule) with a FRET acceptor (e.g., rhodamine);

3. Expose the acceptor-labeled interacting molecule to the donor-labeled GPCR polypeptide in the presence or absence of a compound being tested for its ability to interfere with an interaction between the two; and 4. Measure fluorescence resonance energy transfer.

Quenching and FRET assays are related. Either one can be applied in a given case, depending on which pair of fluorophores is used in the assay.

Interaction Trap/Two-Hybrid System

In order to assay for GPCR-interacting proteins, the interaction trap/two-hybrid library screening method can be used. This assay was first described in Fields et al., Nature, 1989, 340, 245, which is incorporated herein by reference in its entirety. A protocol is published in Current Protocols in Molecular Biology 1999, John Wiley & Sons, NY, and Ausubel, F. M. et 132 al. 1992, Short protocols in molecular biology, Fourth edition, Greene and Wiley-interscience, NY, each of which is incorporated herein by reference in its entirety. Kits are available from Clontech, Palo Alto, Calif. (Matchmaker Two-Hybrid System).

A fusion of the nucleotide sequences encoding all or partial GPCR and the yeast transcription factor GAL4 DNA-binding domain (DNA-BD) is constructed in an appropriate plasmid (i.e., pGBKT7) using standard subcloning techniques. Similarly, a GAL4 active domain (AD) fusion library is constructed in a second plasmid (i.e., p GADT7) from cDNA of potential GPCR-binding proteins (for protocols on forming cDNA libraries, see Sambrook et al. 1989, Molecular cloning: a laboratory manual, second edition, Cold Spring Harbor Press, Cold Spring Harbor, N.Y.), which is incorporated herein by reference in its entirety. The DNA-BD/GPCR fusion construct is verified by sequencing, and tested for autonomous reporter gene activation and cell toxicity, both of which would prevent a successful two-hybrid analysis. Similar controls are performed with the AD/library fusion construct to ensure expression in host cells and lack of transcriptional activity. Yeast cells are transformed with both the GPCR and library fusion plasmids according to standard procedures (Ausubel et al., 1992, Short protocols in molecular biology, fourth edition, Greene and Wiley-interscience, NY, which is incorporated herein by reference in its entirety). In vivo binding of DNA-BD/GPCR with AD/library proteins results in transcription of specific yeast plasmid reporter genes (i.e., lacZ, HIS3, ADE2, LEU2). Yeast cells are plated on nutrient-deficient media to screen for expression of reporter genes. Colonies are dually assayed for β-galactosidase activity upon growth in Xgal (5-bromo-4-chloro-3-indolyl-p-D-galactoside) supplemented media (filter assay for P-galactosidase activity is described in Breeden et al., Cold Spring Harb. Symp. Quant. Biol., 1985, 50, 643, which is incorporated herein in its entirety). Positive AD library plasmids are rescued from transformants and reintroduced into the original yeast strain as well as other strains containing unrelated DNA-BD fusion proteins to confirm specific GPCR/library protein interactions. Insert DNA is sequenced to verify the presence of an open reading frame fused to GAL4 AD and to determine the identity of the GPCR-binding protein.

Nucleic Acid-Based Assays

Polynucleotides encoding a GPCR polypeptide of the invention may be used in an assay based on the interaction of factors necessary for GPCR gene transcription. The association between the DNA and the binding factor may be assessed by means of any system that discriminates between protein-bound and non-protein-bound DNA (e.g., a gel retardation assay). The effect of a compound on the interaction of a factor to DNA is assessed by means of such an assay. In addition to in vitro binding assays, in vivo assays in which the regulatory regions of a GPCR polynucleotide are linked to reporter systems can also be performed.

Assays Measuring the Stability of a GPCR Polypeptide

A cell-based or cell-free system can be used to screen for compounds based on their effect on the half-life of GPCR mRNA or polypeptide (Belasco, J. and G. Brawerman. 1993, Control of messenger RNA stability (New York: Academic Press); Ross, J. 1996. Trends in Genetics 12, 171-175; Jacobson, A and S. W. Peltz, 1996. Annu. Rev. Biochem 65, 693-739). The assay may employ labeled mRNA or polypeptide. Alternatively, GPCR mRNA may be detected by means of specifically hybridizing probes or a quantitative PCR assay. Protein can be quantified, for example, by fluorescent or radioactively labeled antibody-based methods. The following represent exemplary assays:

In Vitro mRNA Stability Assay

1. Isolate or produce, by in vitro transcription, a suitable quantity of GPCR mRNA;
2. Label the GPCR mRNA;
3. Expose aliquots of the mRNA to a cell lysate in the presence or absence of a compound being tested for its ability to modulate GPCR mRNA stability; and
4. Assess intactness of the remaining mRNA at suitable time points.

In Vitro Protein Stability Assay

1. Express a suitable amount of a GPCR polypeptide of the invention;
2. Label the polypeptide;
3. Expose aliquots of the labeled polypeptide to a cell lysate in the presence or absence of a compound being tested for its ability to modulate GPCR polypeptide stability; and
4. Assess intactness of the remaining polypeptide at suitable time points.

In Vivo mRNA or Polypeptide Stability Assay

1. Incubate cells expressing GPCR mRNA or polypeptide with a tracer (radiolabeled ribonucleotide or radiolabeled amino acid, respectively) for a very brief time period (e.g., five minutes) in the presence or absence of a compound being tested for its effect on mRNA or polypeptide stability;
2. Incubate with unlabeled ribonucleotide or amino acid; and
3. Quantify the GPCR mRNA or protein radioactivity at time intervals beginning with the start of step 2 and extending to the time when the radioactivity in GPCR mRNA or protein has declined by approximately 80%. It is preferable to separate the intact or mostly intact mRNA or protein from its radioactive breakdown products by a means such as hybridization, antibody precipitation, and/or gel electrophoresis in order to quantify the mRNA or protein.

Assays Measuring Inhibition of Dominant Negative Activity

Polymorphic GPCR polypeptides may have dominant negative activity (i.e., activity that interferes with the function of a wild-type GPCR). An assay for a compound that can interfere with such a polymorph may be based on any method of quantifying the normal activity of a GPCR in the presence of the polymorph. For example, a normal GPCR facilitates substrate transport, and a dominant negative polymorph would interfere with this effect. Measurement of the ability of a compound to counteract the effect of a dominant negative polymorph may be based on substrate transport, or on any other normal activity of a wild-type GPCR that was inhibited in the polymorph.

Assays Measuring Phosphorylation

The effect of a compound on phosphorylation of a GPCR polypeptide of the invention can be assayed by methods that quantify phosphates on proteins or that assess the phosphorylation state of a specific residue of a GPCR. Such methods include but are not limited to $^{32}P$ and $^{33}P$ labeling and immunoprecipitation, detection with antiphosphoamino acid antibodies (e.g., antiphosphoserine antibodies), phosphoamino acid analysis on 2-dimensional TLC plates, techniques involving mass spectroscopy of fragmented or digested GPCRs (eg. MALDI-TOF), and protease digestion fingerprinting of proteins followed by detection of $^{32}P$- or $^{33}P$-labeled fragments (Clark W A, Izotova L, Philipova D, Wu W, Lin L, Pestka S. Biotechniques. October 2002; Suppl:76-8, 80-7; Boutin J A. J. Chromatogr B Biomed Appl. Sep. 20, 1996; 684(1-2): 179-99.; Bleesing J J, Fleisher T A. Cell function-based flow cytometry. Semin Hematol. April 2001; 38(2):169-78.; Wooten M W. Sci STKE. Oct. 8, 2002; 2002 (153)).

Assays Measuring Other Post-Translational Modifications

The effect of a compound on the post-translational modification of a GPCR polypeptide of the invention may be based on any method capable of quantifying that particular modification. For example, effects of compounds on glycosylation may be assayed by treating a GPCR polypeptide with glycosylase and quantifying the amount and nature of carbohydrate released (Adam G C, Sorensen E J, Cravatt B F. Mol Cell Proteomics, October 2002; 1(10):781-90; Van Noorden C J, Jonges G N. Histochem J. February 1995; 27(2):101-18).

Animal Model Systems

Compounds identified as having activity in any of the above-described assays may be subsequently screened in any available animal model system, including, but not limited to, mice, pigs, and dogs. Test compounds are administered to these animals according to standard methods. Test compounds may also be tested in mice bearing mutations in a gene encoding a GPCR polypeptide. Additionally, compounds may be screened for their ability to modulate the activity of a GPCR polypeptide of the invention and its substrate.

In particular embodiments, modulators are administered to animal models of human neurological or metabolic disease. In particular embodiments, modulators are tested in animals bearing a mutation in a gene encoding a GPCR polypeptide, such as an animal having a mutation in one or more GPCR genes, e.g., SREB1, SREB2, SREB3, GPR22, or GRP88.

As demonstrated in the Examples, GPR88, GPR22, and SREB knockout mice display altered neurological behaviors. In addition, SREB knockout mice display altered metabolic characteristics. Accordingly, GPCR knockout animals may be used to confirm the therapeutic activity of modulators of GPCRs. Accordingly, the present invention provides methods of identifying a compound for the treatment or prevention of a neurological or metabolic disease or disorder, comprising administering a modulator of a GPCR to an animal having one or both GPR88, GPR22, SREB1, SREB2, or SREB3 gene alleles inactivated, and determining whether behavioral aberrations associated with down-regulation of the GPCR are alleviated. In certain embodiments, such screens are performed in animals having double or triple knockouts of various SREB genes.

Knock-Out Mice

An animal, such as a mouse, that has had one or both alleles of a GPCR polypeptide of the invention inactivated (e.g., by homologous recombination or by insertional mutagenesis) is a preferred animal model for screening for compounds that alleviate aberrant behavior or symptoms from a disease or disorder associated with loss of a GPCR activity. The availability of inbred strains of genetically identical mice is of immense value in studying disease. For example, uniformity of mice in an inbred strain permits the assessment of subtle differences in the expression of behavioral traits. As a result, mice can be altered genetically, or bred in different combinations, to study specific behavioral characteristics.

In the mouse, it is possible to perform targeted changes in a gene, such that the altered gene can be passed from one generation to the next. This is accomplished by the use of mouse embryonic stem (ES) cells. These cells can be genetically modified in vitro and then implanted into a foster mother, where they develop into embryos and are brought to term. The resulting offspring are derived from the altered ES cells and carry the introduced genetic modification in their genome.

The most common laboratory procedure performed in ES cells is the elimination, or knock-out (KO), of a specific gene. For this purpose, a mutation inactivating a target gene is introduced into ES cells. These cells are then used to produce mice containing the faulty gene. Since mice, like humans, contain two copies of every gene, one from each parent, the first generation of mice reared from the modified ES cells contains one copy of the mutant gene and one healthy variety. A single round of interbreeding leads to mice with two copies of the mutant gene and the full manifestation of the introduced mutation (knock out mice) or mice born by foster mothers are bred with wild type mice to produce heterozygotes, and these heterozygotes are interbred to produce knock out mice.

Knock-In Mice

Instead of deleting a polynucleotide sequence from the mouse genome, it may be desirable to insert a polynucleotide sequence into the mouse genome. This technique, commonly referred to as "knocking in," can be accomplished using many of the methods described for the production of knock-out mice. In some instances, it maybe desirable to "knock in" a polynucleotide encoding a human GPCR polypeptide of the invention to replace the polynucleotide encoding the orthologous mouse GPCR polypeptide. The knocked-in polynucleotide may be expressed under the control of the endogenous mouse regulatory sequence, or may have exogenous regulatory sequences.

ES Library, Screening, and Isolation

The methods used to generate a library of ES cells with random gene disruptions and the screening and isolation of ES clones containing a GPCR disruption may be carried out essentially as described in U.S. Pat. No. 6,228,639. In brief, to generate a library of ES cells with random gene disruptions, we infected ES cells with a retroviral vector. The vector is designed to inactivate genes in which it gets inserted. The ES cell insertional library is organized in a 3-D matrix of tubes. One copy of the library is stored as viable cells and the other copy is used to isolate DNA. DNA from the library pools is screened by PCR for the insertions in the genes of interest. The same insertion found by PCR in pools corresponding to the other dimensions of the library matrix determines the 3-D address of the ES clone containing the disrupted gene.

Other methods are known in the art to generate gene disruptions in animals, including homologous recombination, chemical, radiation, and other mutational methods (Shastry, Mol. Cell Biochem. 181:163-179, 1998; Shastry, Experientia 51:1028-1039, 1995; Zheng et al., Nucleic Acids Res. 27:2354-2360, 1999; Knock outda et al., Hokkaido Igaku Zasshi 77:151-156, 2002; Babinet et al., Ann. Acad. Bras. Cienc. 73:577-580, 2001; Williams, J. Appl. Physiol. 88:1119-1126, 2000).

In one embodiment, mice having mutations in a gene encoding a GPCR polypeptide of the present invention are made using homologous recombination. Suitable methods and reagents are described, for example, in U.S. Pat. Nos. 5,464,764, 5,487,992, 5,612,205, 5,627,059, 5,789,215, and 6,204,061.

Generation of Knock-Out and Knock-In Mice

Knock-out and knock-in mice are produced according to methods well known in the art (see, e.g., Manipulating the Mouse Embryo. A Laboratory Manual, 2nd ed. B. Hogan, R. Beddington, F. Constantini, E. Lacy, Cold Spring Harbor Laboratory Press, 1984). In brief, ES cells containing a disrupted GPCR gene are injected into mice blastocysts. These blastocysts are then transferred into uteri of pseudopregnant female mice. Pups born are scored for fur color, and chimeric mice (black and agouti color) with high contribution of agouti fur (50% or more) are tested for germ line transmission by breeding with C57B6/J mice. Presence of agouti progeny indicates germ line transmission, and the same chimera mice are then bred to generate knock-out mice on an inbred background. Alternatively, the chimeric mice are bred directly to 129 mice, and germ line transmission determined by PCR, Southern blotting, or other methods known in the art. The resulting heterozygous mice are then bred to generate knock-out mice on an inbred background.

To generate mice heterozygous for the disrupted GPCR gene (heterozygous knock outs), the chimera mice are mated with other mice. The progeny from these matings are genotyped by PCR, Southern blotting, or other methods known in the art for the presence of the knocked out copy of GPCR gene. Knock-out mice homozygous for disruption of the GPCR gene are generated by intercrossing heterozygous mice and genotyping progeny from these crosses.

Mice Having Altered Behavior

Behavioral tests may be used to determine the behavioral phenotype of animals (e.g., mice in which one or more GPCR gene of the present invention has been deleted or otherwise modified, and mice overexpressing one or more GPCR polypeptides of the present invention). Suitable tests include, but are not limited to, those that measure behaviors related to anxiety, hyperactivity, hypoactivity, appetite, eating habits, attention, drug abuse, drug addiction, learning and memory, mood, depression, schizophrenia, pain, sleep, arousal, sexuality, and social dominance.

The functional observational battery (FOB) is a series of tests applied to an animal to determine gross sensory and motor deficits. In general, short-duration, non-harmful tactile, olfactory, and visual stimuli are applied to the animal to determine its ability to detect and respond normally to the stimuli. The FOB also provides an opportunity for an investigator to closely observe each animal for skeletal and spontaneous neurological deficits (Crawley et al., Hormones Behav. 31:197-211, 1997).

General observational tests include, for example, swim tests, the auditory click test, measurement of body temperature or body weight, the Irwin Observational Test Battery, the olfactory acuity test, and the visual cliff test One means for measuring animal activity is the home cage activity test. Infrared photobeams provide information of when an animal is moving in its home cage. Animals in their home cages are placed in the photobeam boxes, and data are generated that provide insight into the animal's circadian rhythms activity, as well as general traits of activity (e.g., hypoactivity or hyperactivity) during the testing period.

Another test assays open field activity. Locomotor activity is detected by photobeam breaks as the animal crosses each beam. Measurements used to assess locomotor activity include, for example, total distance traveled, total number of rearing events (animal raises up on hindlimbs), and distance traveled in the center compared to total distance traveled (center: total distance ratio). Typically, mice are placed in the center of the field. Mice will normally explore the edges/walls first and then, over time, spend more time in the center as they become familiar with the environment. Open field activity determination provides data on the general activity level of mice (i.e. hypo- or hyper-active), as well as an indication of the animal's anxiety-related behaviors in an open-space.

Other means for measuring animal activity include measurement of circadian activity, elctroencephalography, electromyography, locomotor activity, novel object exploration, sleep deprivation and sleep rebound after deprivation, susceptibility to acute administration of phannacological agents in activity and sleep-related tests, susceptibility to chronic administration of pharmacological agents in activity and sleep-related tests, and wheel running activity.

The study of sleep is carried out with the use of the electroencephalograph (EEG) and/or electromyography (EMG). Stereotaxic placement of electrodes onto the cortex for EEG recording and bilateral placement of electrodes into the trapezius muscle in the neck (EMG) allow the different stages of wake and sleep to be analyzed. Animals that display disrupted or altered sleep pattern may serve as models for screening for drugs that treat sleep disorders such as dysomnias and parasomnias.

Tests for determining whether a mouse has altered coordination or movement include the Balance Beam test, Bilateral Tactile Stimulation test, Circling Behavior test, Disengage test, Grip Strength test, Holeboard test, Paw Reaching test, Parallel Bar Walking test, Ring Catalepsy test, Rotorod test, Sterotypy Behavior test, or Vertical Pole test. Coordination and movement can also be assessed by assessment of exercise capacity, footprint pattern, forelimb asymmetry, posture, and gait.

In one example, motor coordination and skill learning is assessed using the rotarod assay, which measures the ability of an animal to maintain balance on an accelerating rotating rod. The mice must walk continuously to avoid falling off (see Crawley et al., Hormones Behav. 31:197-211, 1997). Animals are generally given multiple trials spaced at least 20 minutes apart to allow for recovery from any fatigue testing may cause. In general, the time the animal spends walking on top of the rotating rod increases over the trials, thus demonstrating motor coordination and the ability to learn a rudimentary skill. This test relates to coordination and balance deficiencies.

Feeding and ingestive behaviors can be examined, for example, by monitoring 24 hour food consumption, 24 hour water consumption, body weight during development, circadian feeding patterns, conditioned taste aversion, conditioned taste preference, fasting studies (e.g., weight loss during fasting, weight gain after fasting, feeding response after fasting), liquid intake, macronutrient choice, novel food preference, rebound food consumption response after restricted daily access to food, response to specialized diets (e.g., cafeteria diet, high or low protein diet, high or low fat diet, and high or low carbohydrate diet), susceptibility to acute administration of pharmacological agents in feeding paradigms, and susceptibility to chronic administration of pharmacological agents in feeding paradigms. Food consumption over consecutive days may be determined, e.g., during the monitoring of home cage activity. The amount of consumed food and the body weight of the mouse are determined at various timepoints. If desired, the frequency and duration of eating may also be determined. This assay provides insight into the appetite and eating habits that might relate to eating conditions or disorders.

Sexual responsiveness can be tested, e.g., in a clear chamber with video recording. Male mice are tested to determine if they respond normally to a female mouse. Measurements used to assess normal male responsiveness include, but not limited to, mount latency, mount frequency, pelvic thrusts, intromissions, and ejaculation. Female mice are also tested to determine their sexual receptivity to a male. Measurements used to assess normal female receptivity involve assessing the degree and frequency of lordosis behavior. Sexual behaviors can also be measured by examining sexual motivation, ethologically relevant behaviors (e.g., anogenital investigation) as part of normal social interactions, susceptibility to acute administration of pharmacological agents in sexual responsiveness assays, and susceptibility to chonic administration of pharmacological agents in sexual responsiveness assays. These assays can be used to determine sexual activity in general and to detect any abnormal sexual behavior that might relate to sexual conditions or disorders.

Nociceptive behaviors can be assessed using a test that measures, for example, allodynia as a model for chronic pain, inflammatory pain, pain threshold, sensitivity to drug-induced analgesia, thermal pain, mechanical pain, chemical pain, hyperalgesia, or shock sensitivity. Particular tests include the allodynia/place avoidance, calibrated von Frey hairs for mechanical pain, cold plate test, cold water tail immersion test, conditioned suppression, formalin paw assay, Hargreaves test, hot plate test, hot water tail immersion test, paw pressure test, paw withdrawal, plantar test, tail flick test, tail pressure test, and the writhing test, susceptibility to actue administration of pharmacological agents in nociception tests, and susceptibility to chronic administration of pharmacological agents in nociception tests. In one example, a mouse's nociception is assessed by placing the mouse on a 55° C. hot plate. The latency to a hind limb response (shake or lick) is measured. This assay provides data on the animal's general analgesic response to a thermal stimulus, and is used to detect a nociceptive condition or disorder. The formalin paw assay measures the response to a noxious chemical injected into the hindpaw. Licking and biting of the hindpaw is quantitated as the amount of time engaged in these activities. Two phases of responses are demonstrated with the first phase representing an acute pain response and the second phase representing a hyperalgesic response. Alterations in this normal biphasic display may serve as a model of various forms of pain and chronic pain disorders (Abbott et al., Pain 60:91-102, 1995).

Tests that measure or detect anxiety-related behaviors include acoustic startle habituation, acoustic startle reactivity, active avoidance, the canopy test, conditioned emotional response, conditioned suppression of drinking, conditioned ultrasonic vocalization, dark light emergence task, defensive burying, dPAG-induced flight, elevated plus maze, elevated zero maze, exploration tests in a novel environment, fear-potentiated startle, food exploration test, four plate test, Gellar-Seifter conflict test, light-dark box, light-enhanced startle, marble burying test, mirror chamber, novelty supressed feeding, pain-induced ultrasonic vocalizations, petition test, passive avoidance, probe burying test, punished locomotion test, separation-induced ultrasonic vocalizations, shock sensitization of startle response, social competition, social interation, staircase test, susceptibility to acute administration of pharmacological agents in anxiety-related assays, and susceptibility to chronic administration of pharmacological agents in anxiety-related assays. One such test is the light-dark exploration test, which measures the conflict between the natural tendencies of mice to explore novel environments but to avoid the aversive properties of brightly lit (anxiety-provoking) open areas. In this test, the brightly lit compartment encompasses about two-thirds of the surface area, while the dark compartment encompasses the remaining one-third of the area. An opening is designed to allow the mouse access to both compartments. The mouse is placed at the one end of the brightly lit compartment. The latency to enter the dark compartment, total time spent in the dark compartment, and the number of transitions between the two compartments is measured to give a sense of an anxiety-related response that might be related to an anxiety condition or disorder.

Tests for identifying stress-related behaviors include electric footshock stress tests, handling stress test, maternal separation stress test, restraint induced stress test, sleep deprivation stress test, social isolation stress test, swim stress test, stress-induced hyperthermia, and susceptibility to acute or chronic administration of pharmacological agents in stress-related tasks. These assays provide the ability to study stress and to provide insight into behaviors that may be related to stress conditions or disorders.

Tests for identifying fear-related behaviors in rodents include conditioned fear, fear potentiated startle, fear-response behavior, mouse defense test battery, ultrasonic vocalization test, and susceptibility to acute or chronic administration of pharmacological agnets in fear-related tests. These assays provide the ability to study emotional based behaviors that may be related to fear-based conditions or disorders.

Depression-related tests include acute restraint, chronic restraint, circadian activity, conditioned defensive burying, differential reinforcement to low rate of responding, learned helplessness, Porsolt forced swim test, tail suspension test, sucrose preference test, and susceptibility to acute or chronic administration of pharmacological agents in depression-related tests. Another is the tail suspension test, which includes suspending a mouse by its tail and measuring the duration of time it continues to struggle to escape from an inescapable situation. The time spent struggling is considered a measure of learned helplessness behavior or behavioral despair. The latency to the onset of the end of the struggling can be increased by clinically effective antidepressants. This assay therefore can be used to identify mice that may serve as models for depressive disorders.

Mood related behavioral assays include latent inhibition, marble burying, prepulse inhibition of the acoustic startle response, and susceptibility to acute and chronic administration in mood-related tests. Prepulse inhibition of the acoustic startle response occurs when a loud (120 dB) startle stimulus is preceded by a softer tone that does not elicit a startle response (the prepulse). It is believed that this is a measure of a filtering mechanism in the nervous system that allows an individual to focus on important incoming information and to ignore unimportant information. Schizophrenic patients have been documented to have impaired prepulse inhibition; therefore this test can be used employing mice to identify those having a response that may be indicative of schizophrenia or another psychotic disorder.

Figure 8:
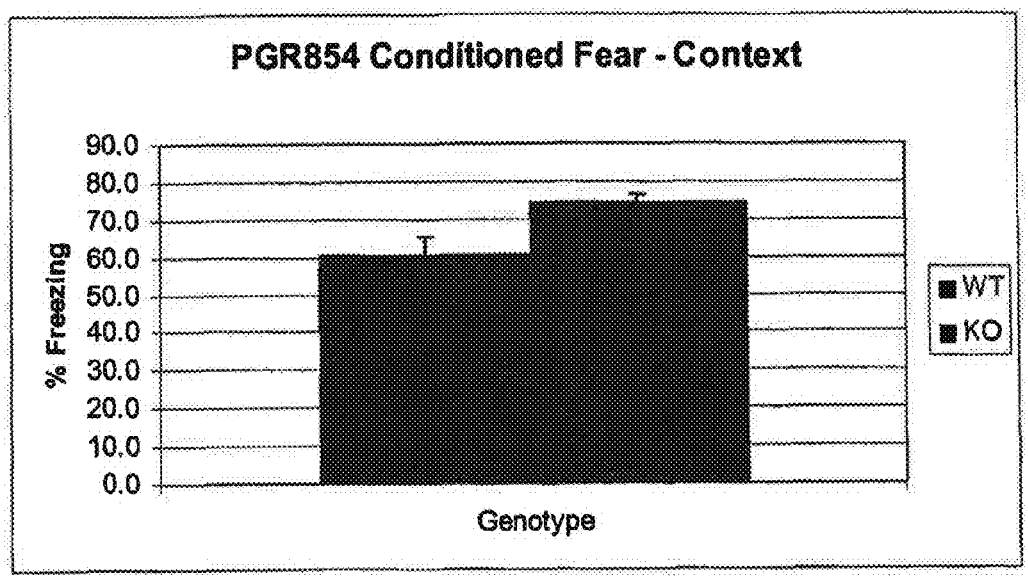
FIG. 8. Percentage freezing in the conditioned fear test. GPR85 knock out mice displayed significantly more freezing responses during the context test.

Suitable tests for assessing a mouse's learning and memory capacity include, for example, those that measure active avoidance, autoshaping, barnes maze, conditioned taste aversion, conditional spatial alternation, context and auditory cued conditioned fear, contextual discrimination, delayed matching to position, delayed matching/non-matching to position, eyeblink conditioning, fear potentiated startle, FIG. 8 maze, holeboard test, motor leaminingusing an accelerated rotarod, place aversion test, novel object recognition, olfactory discrimination, passive-avoidance, position/response learning, schedule-induced operant behaviors, radial arm maze, social recognition, social transmission of food preference, step down avoidance, taste learning, temporal processing using the Peak procedure, trace conditioning, T maze avoidance, transverse patterning, visual discrimination, wate maze place memory test, vigilence test, and Y maze, and Y maze avoidance.

The Morris water maze test is an assay that measures spatial learning and memory. An animal is trained in a pool of opaque water to locate a platform hidden under the water's surface using spatial cues external cues in the room. Measurements of spatial learning require analysis of spatial selectivity on a probe trial, in which the platform has been removed and the pattern in which the animal searches is examined. An animal that has learned the position of the platform using spatial cues will spend more time in the quadrant where the platform was located, and will also cross the precise location of the platform more often versus other possible sites. This complex learning task provides a way to determine learning and memory deficits and enhancements, and offers insight into the neural mechanisms of learning and memory (Crawley et al., Psychopharmacol. 132:107-124, 1997).

Context and auditory cue fear conditioning (i.e., conditioned fear) is determined by placing a mouse in an enclosed chamber in which the floor is equipped to deliver a mild electrical shock to the mouse's feet. The training day consists of placing the mouse in the chamber and allowing it to explore the environment. At the end of the exploration period, a white noise is turned on (i.e., the conditioning stimulus, CS). A footshock is paired with the white noise turning off. This training trial is then repeated again. At the end of the second trial, the mouse is returned to its home cage. The mouse is tested 24 hours later by separately assaying the amount of freezing exhibited in the context in which it was shocked (Context Test) and the amount of freezing exhibited to the white noise (CS Test). As the mouse conditions to the pairing of the tone and shock, it may exhibit a freezing behavior due to the fear that the mild foot shock imparts to the mouse. Freezing behavior on the test day suggests that the mouse has learned that it received a shock in this particular context when the white noise is turned off. This test is considered to provide data about emotional-based learning and memory.

Aggression and other social behaviors can be monitored by observation or quantification of behaviors such as grooming, home cage behaviors (e.g., nesting, huddling, playing, and barbering) isolation-induced fighting, maternal behavior, parental behavior, social interaction, social investigation. Particular tests include the Partition test, the social defeat test, the Resident versus Intruder test, and the Social Place Preference test. Any of the foregoing can be used to determine a mouse's susceptibility to acute or chronic administration of pharmacological agents. The resident-intruder paradigm is an assay that demonstrates species-specific aggressive behavior. This test is conducted by individually housing an animal (the resident) and introducing a new animal of the same gender (the intruder) into the cage. The new animal is viewed by the resident animal as an intruder and displays aggressive behaviors toward the intruder (Crusio, Behav. Genet. 26:459-533, 1996). The normal display of aggression towards an intruder may serve as a model for examining increased or decreased aggression to a normal environmental situation.

One test for social dominance can be carried out to assay social interactions and social behaviors. In the so-called "tube test," a mouse is placed into the end of a plexiglass cylinder and another mouse (called a social cohort) is placed at the other end of the tube. The animal that backs out of the tube first is considered the loser and the mouse that remains in the tube is considered the winner. In general, an animal that backs out of the tube during the first round generally backs out of the tube in subsequent rounds. A ranking can then be given to each animal, thus identifying the dominance or submissive status of an animal within a social context, as well as detecting abnormal social behaviors that can be related to antisocial personality conditions or disorders.

Behaviors relating to reward and addiction are assessed using tests that measure, for example, reward and place preference, self-administration of drugs of abuse (acute and chronic), sensitization and tolerance to drugs of abuse, sensitization to the motor activating properties of drugs, tolerance to repeated analgesic drug administration, or withdrawl symptoms after repeated self-administration of drugs of abuse. The impact on self-administration of drugs of abuse in stress tests can also be used to assess addiction.

Tolerance and sensitivity to ethanol and cocaine can be tested, for example, by examining core body temperature of the mice after an intra-peritoneal (i.p) injection of cocaine or ethanol. Initial sensitivity to cocaine and alcohol can be measured in mice after a single (acute) dose. In rodents, repeated exposure to alcohol or cocaine via repeated injections across days has been shown to produce tolerance. In both the alcohol studies and the cocaine studies, mice are administered an i.p. dose, and core body temperature is measured post injection with a digital thermometer with a rectal probe. On Day 2, mice are administered the same dose using the same route, and temperature again recorded post injection. For the cocaine studies, mice will be administered an i.p. dose and core body temperature will be measured post injection with a rectal thermometer. On Day 2 mice will be administered the same dose using the same route and temperature will be recorded post injection. Tolerance to the drug is indicated by an increase in body temperature on the second day of drug administration compared to the first day of drug administration. These assays detect sensitivity to various drug substances and, thus, are indicators of alcohol or cocaine use disorders.

The rewarding effects of various substances of abuse can be studied using the conditioned place preference paradigm and self-administration tests. The place preference paradigm is a non-invasive method that is amenable to classical Pavlovian conditioining. The rewarding drug serves as an unconditioned stimulus (US) that is paired with an environment that serves as the conditioned stimulus (CS). Given a choice between exploring a novel environment and the drug-paired CS environment, the animals prefer the drug-paired CS environment, thereby demonstrating conditioned place preference (Itzhak and Martin, Neuropsychopharmacol. 26:130-134, 2002). This Pavlovian conditioned response to a drug of abuse has been postulated to be involved in drug-seeking behavior and relapse following exposure to cues that were previously associated with drug use. Self-administration studies, in general, allow the animal to regulate the administration of a drug to its nervous system. With these types of studies, extinction and reinstatement of drug intake behaviors can be examined and may serve as a model for drug-seeking behavior and relapse in humans (Stewart et al., Brain Res. 457:287-294, 1988).

Administration of a drug such as bicuculine can be utilized to study an animal's susceptibility to seizures or seizure-like events. Mice that enter into classical seizure symptoms earliest are considered to be more susceptible to seizures. Likewise, mice that present seizure symptoms later than normal, are considered to be more resistant to seizures. This assay may allow the identification of alterations central to the formation of seizure disorders and related conditions.

Methods for performing many of the foregoing screens are well known in the art (see, e.g., Brunner et al., J. Exp. Psychol. Anim. Behav. Process 20:331-346, 1994; Crawley, What's Wrong With My Mouse? (John Wiley and Sons, Somerset, N.J., 2000). Crawley et al., (eds.); Current Protocols in Neuroscience (John Wiley and Sons, Somerset, N.J., 2001); Crawley et al., Hormones Behav. 31:197-211, 1997; Crawley et al., Psychopharmacol. (Berl) 132:107-124, 1997; Galey et al., Neurosci. Lett. 143:87-90, 1992; Hascoet et al., Pharmacol. Biochem. Behav. 65:339-344, 2000; Martinez-Mota et al., Psychoneuroendocrinol. 25:109-120, 2000; Mogil et al., Pain 80: 67-82, 1999; Toubas et al., Pharmacol. Biochem. Behav. 35:121-126, 1990; Van Der Hyden et al., Physiol. Behav. 62:463-470, 1997, Walker et al., Molec. Med. Today 5:319-321, 1999).

In addition to the initial screening of test compounds, the animals having mutant GPCR genes are useful for further testing of efficacy and safety of drugs or agents first identified using one of the other screening methods described herein. Cells taken from the animal and placed in culture can also be exposed to test compounds.

Testing Mice for Other Diseases, Disorders, Conditions, or Syndromes

The effect of overexpression, underexpression, misexpression, or mutation of a GPCR of the present invention can be assayed, for example, using any of a wide variety of measurements or tests; Barbee et al., Am. J. Physiol. 263:R728-733, 1992; Berul et al., Circulation 94:2641-2648, 1996; Butz et al., Physiol. Genomics 5:89-97, 2001; Coatney, Ilar J. 42:233-247, 2001; Crawley et al., Horm. Behav. 31:197-211, 1997; Crawley et al., Psychopharmacol. (Berl) 132:107-124, 1997; Crawley et al. (eds.) Current Protocols in Neuroscience (John Wiley and Sons, 2001); Furukawa et al., Lab. Anim. Sci. 48:357-363, 1998; Hartley et al., Ilar J. 43:147-158, 2002; Krege et al., Hypertension 25:1111-1115, 1995; Kurien et al., Lab. Anim. 33:83-86, 1999; Lorenz et al., Am. J. Physiol. 272:H1137-H1146, 1997; Mattson, Am. J. Physiol. 274: R564-R570, 1998; Mitchell et al., Am. J. Physiol. 274:H747-H751, 1998; Pollick et al., J. Am. Soc. Echocardiogr. 8:602-610, 1995; Rogers et al., Mamm. Genome 8:711-713, 1997; Rogers et al., Neurosci. Lett. 306:89-92, 2001; Shih et al., Nat. Med. 6:711-714, 2000; Wiesmann et al., Magma 6:186-188, 1998; Irwin, Psychopharmacologia 13:222-257, 1968; Brayton et al., Vet. Pathol. 38:1-19, 2001; Ward et al., Pathology of Genetically Engineered Mice (Iowa State University Press, Ames, Iowa, 2000).

General physiological tests and measurements include, for example, measurement of body temperature, body length and proportions, body mass index, general health appearance, vocalization during handling, lacrimation and salivation, visual tests (e.g., visual cliff, reaching response, visual menace), auditory tests (e.g., click test, acoustic startle, acoustic threshold), olfactory tests (e.g., sniffing and habituation to a novel odor, finding buried food), reflex tests (e.g., righting reflex, eye blink, whisker twitch), measurement of metabolic hormones (e.g., leptin, IGF-1, insulin, metabolites), whole body densitometry by dual energy x-ray absorptometry DEXA or high resolution radiography (Faxitron), and necropsy examination of organ systems.

Identification of a skin disease or disorder may be made by histopathology, examination of fur and skin condition, examination of pigmentation of fur and skin, and determination of wound healing by an ear punch test.

Cardiac diseases and disorders can be identified, for example, by means of histopathology or electrocardiography, or by determination of blood pressure, blood velocity, blood flow, or pulse rate.

Identifying mice having a disorder of the respiratory system, including the lungs, nose, larynx, trachea, and pleura, can be performed by histopathology, or by determination of lung capacity, respiration rate, $VO_2$, $pCO_2$, arterial $pO_2$, and tidal volume.

Testing mice for disorders of the immune and hematopoietic systems, including blood, bone marrow, thymus, spleen and lymph nodes, can be performed, for example, by histopathology, delayed hypersensitivity test, measurement of serum immunoglobins, blood pH, or coagulation time, volumetric analysis using Evans blue dye technique, or analysis of bone marrow smears, hematocrit, hemoglobin, erythrocytes, reticulocytes, leuknock outcytes, platelets, prothrombin, electrolytes, or lymphocytes.

Knock-out or transgenic mice of the present invention may have a disease or disorder of the digestive tract (e.g., the esophagus, stomach, duodenum, jejunum, ileum, cecum, colon, and rectum). Testing for these diseases and disorders of the digestive tract, may include fecal analysis, measurement of digestive enzymes, or histopathology.

Identification of mice having a disease or disorder of the liver may be by means of histopathology or analysis of total proteins, albumin, bilirubin, creatinine, transaminase, cholesterol, aldolase, ammonia, sorbitol dehydrogenase, or serum bile acids Testing for disorders of the pancreas in mice may be performed, for example, by histopathology, a glucose tolerance test, an insulin challenge test, or analysis of glucose, insulin, glucogon, or exocrine enzymes.

Testing for diseases or disorders of the urinary system, including the kidney, ureter, and urinary bladder, may include histolopathological examination, or analysis of sodium osmolality, potassium, urea nitrates, creatinine, chloride, bicarbonate, glucose, cystatin c, or urine electrolytes or blood pressure.

Testing mice for diseases or disorders of the female reproductive tract, including the ovary, oviducts, uterus, and vagina, may include determination of fertility (e.g., by vaginal plugging), cyclicity (e.g., by vaginal smears), parturition (e.g., by litter size), maternal behavior (e.g., by pup survival and nesting, histopathology, or analysis of levels of estrogens, follicle-stimulating hormone, or luteinizing hormone). Similarly, testing mice for diseases or disorders of the male reproductive tract, including the testis, epididymus, prostate, seminal glands, accessory glands, and penis may include histopathological examination, determination of fertility, sperm counts and motility, erectile capacity (e.g., by plethysmography), and/or analysis of levels of androgens, follicle-stimulating hormone, PSA or luteinizing hormone.

Mice having diseases or disorders of the musculature may be identified by histopathology, electromyography, testing of muscle strength and contractibility, or analysis of levels of creatinine, lactate, myoglobin, or isoenzymes.

Testing mice for diseases or disorders of the skeletal system may include, for example, bone strength determination, histopathological examination, mineral analysis, dual energy x-ray absorptiometry (DEXA), or analysis of osteocalcin, calcitrol, urine pyridinium, or N-telopeptide.

Testing mice for diseases or disorders of the endocrine system, including the pituitary, thyroid gland, adrenal gland, and mammary glands, may also be performed. Testing may include, for example, histopathological examination, determination of lactation capacity, testing of hormone release, and/or analysis of corticosterone, adrenocorticotrophic hormone, corticotrophin releasing hormone, thyroid hormone, thyrotropin releasing hormone, thyroid stimulating hormone, chorionic gonadotripin, growild typeh hormone, growild typeh hormone-releasing hormone, somatostatin, prolactin, alpha-melanocyte stimulating hormone, follicle-stimulating hormone, luteinizing hormone, or gonadotropin hormone-releasing hormone.

Finally, testing for mice for diseases or disorders of the nervous system, including the brain, spinal cord and peripheral ganglia, may include determination of stroke susceptibility (e.g., by focal ischemia or cerebral occlusion), histopathological examination, determination of neurotransmitter release (e.g., by microdialysis or cell culture) or synaptic transmission (e.g., by electrophysiology in brain slices), brain wave analysis by electroencephalography (EEG), whole brain imaging by magnetic resonance imaging, transmitter content determination by HPLC, protein localization and cell type analysis (e.g., by immunohistochemistry), neuron apoptosis determination (e.g., by TUNEL assay), total cell count, or examination of fiber tract localization and integrity, dendritic and axonal morphology, and structural integrity by morphometric analysis.

Diagnostics

Expression, biological activity, and mutational analysis of a GPCR gene of the invention can each serve as a diagnostic tool for a disease or disorder involving the GPCR; thus determination of the genetic subtyping of a GPCR gene sequence can be used to subtype individuals or families to determine their predisposition for developing a particular disease or disorder.

An exemplary method for detecting the presence or absence of a GPCR protein or nucleic acid in a biological sample involves obtaining a biological sample from a test subject and contacting the biological sample with a compound or an agent capable of detecting GPCR protein or nucleic acid (e.g., mRNA, genomic DNA) that encodes GPCR protein such that the presence of GPCR protein or nucleic acid is detected in the biological sample. A preferred agent for detecting GPCR mRNA or genomic DNA is a labeled nucleic acid probe capable of hybridizing to GPCR mRNA or genomic DNA.

The nucleic acid probe can be, for example, a full-length GPCR nucleic acid, such as the nucleic acid of Table 1, or a portion thereof, such as an oligonucleotide of at least 15, 30, 50, 100, 250 or 500 nucleotides in length and sufficient to specifically hybridize under stringent conditions to GPCR mRNA or genomic DNA. Other suitable probes for use in the diagnostic assays of the invention are described herein.

Another method for detecting the presence or absence of a GPCR protein in a biological sample involves obtaining a biological sample from a test subject and contacting the biological sample with an antibody that is capable of detecting GPCR protein. Where said antibody capable of binding to the GPCR protein preferably has a detectable label. Antibodies can be polyclonal, or more preferably, monoclonal. An intact antibody, or a fragment thereof (e.g., Fab or F(ab')2) can be used. The term "labeled", with regard to the probe or antibody, is intended to encompass direct labeling of the probe or antibody by coupling (i.e., physically linking) a detectable substance to the probe or antibody, as well as indirect labeling of the probe or antibody by reactivity with another reagent that is directly labeled. Examples of indirect labeling include detection of a primary antibody using a fluorescently labeled secondary antibody and end-labeling of a DNA probe with biotin such that it can be detected with fluorescently labeled streptavidin. The term "biological sample" is intended to include tissues, cells and biological fluids isolated from a subject, as well as tissues, cells and fluids present within a subject. That is, the detection method of the invention can be used to detect GPCR mRNA, protein, or genomic DNA in a biological sample in vitro as well as in vivo. For example, in vitro techniques for detection of GPCR mRNA include Northern hybridizations and in situ hybridizations. In vitro techniques for detection of GPCR protein include enzyme linked immunosorbent assays (ELISAs), Western blots, immunoprecipitations and immunofluorescence. In vitro techniques for detection of GPCR genomic DNA include Southern hybridizations. Furthermore, in vivo techniques for detection of GPCR protein include introducing into a subject a labeled anti-GPCR antibody. For example, the antibody can be labeled with a radioactive marker whose presence and location in a subject can be detected by standard imaging techniques.

In one embodiment, the biological sample contains protein molecules from the test subject. Alternatively, the biological sample can contain mRNA molecules from the test subject or genomic DNA molecules from the test subject. A preferred biological sample is a serum sample isolated by conventional means from a subject.

In another embodiment, the methods further involve obtaining a control biological sample from a control subject, contacting the control sample with a compound or agent capable of detecting GPCR protein, mRNA, or genomic DNA, such that the presence of GPCR protein, mRNA or genomic DNA is detected in the biological sample, and comparing the presence of GPCR protein, mRNA or genomic DNA in the control sample with the presence of GPCR protein, mRNA or genomic DNA in the test sample.

The invention also encompasses kits for detecting the presence of GPCR in a biological sample. For example, the kit can comprise a labeled compound or agent capable of detecting GPCR protein or mRNA in a biological sample; means for determining the amount of GPCR in the sample; and means for comparing the amount of GPCR in the sample with a standard. The compound or agent can be packaged in a suitable container. The kit can further comprise instructions for using the kit to detect GPCR protein or nucleic acid.

The diagnostic methods described herein can furthermore be utilized to identify subjects having or at risk of developing a disease or disorder associated with aberrant GPCR expression or activity. For example, the assays described herein, such as the preceding diagnostic assays or the following assays, can be utilized to identify a subject having or at risk of developing a disorder associated with a misregulation in GPCR protein activity or nucleic acid expression, such as a weight, cardiovascular, neurological or endocrine disorder. Alternatively, the prognostic assays can be utilized to identify a subject having or at risk for developing a disorder associated with a misregulation in GPCR protein activity or nucleic acid expression, such as a weight, cardiovascular, neural or endocrine disorder. Thus, the present invention provides a method for identifying a disease or disorder associated with aberrant GPCR expression or activity in which a test sample is obtained from a subject and GPCR protein or nucleic acid (e.g., mRNA or genomic DNA) is detected, wherein the presence of GPCR protein or nucleic acid is diagnostic for a subject having or at risk of developing a disease or disorder associated with aberrant GPCR expression or activity. As used herein, a "test sample" refers to a biological sample obtained from a subject of interest. For example, a test sample can be a biological fluid (e.g., serum), cell sample, or tissue.

Furthermore, the prognostic assays described herein can be used to determine whether a subject can be administered an agent (e.g., an agonist, antagonist, peptidomimetic, protein, peptide, nucleic acid, small molecule, or other drug candidate) to treat a disease or disorder associated with aberrant GPCR expression or activity. For example, such methods can be used to determine whether a subject can be effectively treated with an agent for a weight, cardiovascular, neural or endocrine disorder. Thus, the present invention provides methods for determining whether a subject can be effectively treated with an agent for a disorder associated with aberrant GPCR expression or activity in which a test sample is obtained and GPCR protein or nucleic acid expression or activity is detected (e.g., wherein the abundance of GPCR protein or nucleic acid expression or activity is diagnostic for a subject that can be administered the agent to treat a disorder associated with aberrant LGR6 expression or activity).

The methods of the invention can also be used to detect genetic alterations in a GPCR gene, thereby determining if a subject with the altered gene is at risk for a disorder characterized by misregulation in GPCR protein activity or nucleic acid expression, such as a weight, cardiovascular, neural or endocrine disorder. In preferred embodiments, the methods include detecting, in a sample of cells from the subject, the presence or absence of a genetic alteration characterized by at least one of an alteration affecting the integrity of a gene encoding a GPCR-protein, or the mis-expression of the GPCR gene. For example, such genetic alterations can be detected by ascertaining the existence of at least one of 1) a deletion of one or more nucleotides from a GPCR gene; 2) an addition of one or more nucleotides to a GPCR gene; 3) a substitution of one or more nucleotides of a GPCR gene, 4) a chromosomal rearrangement of a GPCR gene; 5) an alteration in the level of a messenger RNA transcript of a GPCR gene, 6) aberrant modification of a GPCR gene, such as of the methylation pattern of the genomic DNA, 7) the presence of a non-wild type splicing pattern of a messenger RNA transcript of a GPCR gene, 8) a non-wild type level of a GPCR-protein, 9) allelic loss of a GPCR gene, and 10) inappropriate post-translational modification of an GPCR-protein. As described herein, there are a large number of assays known in the art which can be used for detecting alterations in a GPCR gene. A preferred biological sample is a tissue or serum sample isolated by conventional means from a subject.

In certain embodiments, detection of the alteration involves the use of a probe/primer in a polymerase chain reaction (PCR) such as anchor PCR or RACE PCR, or, alternatively, in a ligation chain reaction (LCR) (see, e.g., Landegran et al. (1988) Science 241:1077-1080; and Nakazawa et al. (1994) Proc. Natl. Acad Sci. USA 91:360-364), the latter of which can be particularly useful for detecting point mutations in the GPCR-gene (see Abravaya et al. (1995) Nucleic Acids Res. 23:675-682). This method can include the steps of collecting a sample of cells from a subject, isolating nucleic acid (e.g., genomic, mRNA or both) from the cells of the sample, contacting the nucleic acid sample with one or more primers which specifically hybridize to a GPCR gene under conditions such that hybridization and amplification of the LGR6-gene (if present) occurs, and detecting the presence or absence of an amplification product, or detecting the size of the amplification product and comparing the length to a control sample. It is anticipated that PCR and/or LCR may be desirable to use as a preliminary amplification step in conjunction with any of the techniques used for detecting mutations described herein.

Alternative amplification methods include: self sustained sequence replication (Guatelli, J. C. et al., (1990) Proc. Natl. Acad Sci. USA 87:1874-1878), transcriptional amplification system (Kwoh, D. Y. et al., (1989) Proc. Nail. Acad Sci. USA 86:1173-1177), Q-Beta Replicase (Lizardi, P. M. et al. (1988) Bio-Technology 6:1197), or any other nucleic acid amplification method, followed by the detection of the amplified molecules using techniques well known to those of skill in the art. These detection schemes are especially useful for the detection of nucleic acid molecules if such molecules are present in very low numbers.

In an alternative embodiment, mutations in a GPCR gene from a sample cell can be identified by alterations in restriction enzyme cleavage patterns. For example, sample and control DNA is isolated, amplified (optionally), digested with one or more restriction endonucleases, and fragment length sizes; are determined by gel electrophoresis and compared. Differences in fragment length sizes between sample and control DNA indicates mutations in the sample DNA. Moreover, the use of sequence specific ribozymes can be used to score for the presence of specific mutations by development or loss of a ribozyme cleavage site.

In other embodiments, genetic mutations in GPCR can be identified by hybridizing a sample and control nucleic acids, e.g., DNA or RNA, to high density arrays containing hundreds or thousands of oligonucleotides probes (Cronin, M. T. et al. (1996) Human Mutation 7: 244-255; Kozal, M. J. et al. (1996) Nature Medicine 2: 753-759). For example, genetic mutations in GPCR can be identified in two dimensional arrays containing light-generated DNA probes as described in Cronin, M. T. et al. (1996) Human Mutation 7: 244-255.

Briefly, a first hybridization array of probes can be used to scan through long stretches of DNA in a sample and control to identify base changes between the sequences by making linear arrays of sequential overlapping probes. This step allows the identification of point mutations. This step is followed by a second hybridization array that allows the characterization of specific mutations by using smaller, specialized probe arrays complementary to all variants or mutations detected. Each mutation array is composed of parallel probe sets, one complementary to the wild-type gene and the other complementary to the mutant gene.

In yet another embodiment, any of a variety of sequencing reactions known in the art can be used to directly sequence the GPCR gene and detect mutations by comparing the sequence of the sample LGR6 with the corresponding wild-type (control) sequence. Examples of sequencing reactions include those based on techniques developed by Maxam and Gilbert (1977) Proc. Nati. Acad. Sci. USA 74:560 or Sanger (1977) Proc. Nati. Acad. Sci. USA 74:5463. It is also contemplated that any of a variety of automated sequencing procedures can be utilized when performing the diagnostic assays ((1995) Biotechniques 19:448), including sequencing by mass spectrometry (Cohen et al. (1996) Adv. Chromatogr. 36:127-162; and Griffin et al. (1993) AppL. Biochem. Biotechnol. 38:147-159).

Other methods for detecting mutations in the GPCR gene include methods in which protection from cleavage agents is used to detect mismatched bases in RNA/RNA or RNA/DNA heteroduplexes (Myers et al. (1985) Science 230:1242). In general, the art technique of "mismatch cleavage" starts by providing heteroduplexes of formed by hybridizing (labeled) RNA or DNA containing the wild-type GPCR sequence with potentially mutant RNA or DNA obtained from a tissue sample. The double-stranded duplexes are treated with an agent that cleaves single-stranded regions of the duplex such as which will exist due to basepair mismatches between the control and sample strands. For instance, RNA/DNA duplexes can be treated with RNase and DNA/DNA hybrids treated with SI nuclease to enzymatically digesting the mismatched regions. In other embodiments, either DNA/DNA or RNA/DNA duplexes can be treated with hydroxylamine or osmium tetroxide and with piperidine in order to digest mismatched regions. After digestion of the mismatched regions, the resulting material is then separated by size on denaturing polyacrylamide gels to determine the site of mutation. For examples see, Cotton et al. (1988) Proc. Natl Acad Sci USA 85:4397; and Saleeba et al. (1992) Methods Enzymol. 217: 286-295. In a preferred embodiment, the control DNA or RNA can be labeled for detection.

In still another embodiment, the mismatch cleavage reaction employs one or more proteins that recognize mismatched base pairs in double-stranded DNA (so called "DNA mismatch repair" enzymes) in defined systems for detecting and mapping point mutations in GPCR cDNAs obtained from samples of cells. For example, the mutY enzyme of *E. coli* cleaves A at G/A mismatches and the thymidine DNA glycosylase from HeLa cells cleaves T at G/T mismatches (Hsu et al. (1994) Carcinogenesis 15:1657-1662). According to an exemplary embodiment, a probe based on a GPCR sequence, e.g., a wild-type GPCR sequence, is hybridized to a cDNA or other DNA product from a test cell(s). The duplex is treated with a DNA mismatch repair enzyme, and the cleavage products, if any, can be detected from electrophoresis protocols or the like.

In other embodiments, alterations in electrophoretic mobility will be used to identify mutations in GPCR genes. For example, single strand conformation polymorphism (SSCP) may be used to detect differences in electrophoretic mobility between mutant and wild type nucleic acids (Orita et al. (1989) Proc Natl. Acad. Sci USA: 86:2766, see also Cotton (1993) Mutat. Res. 285:125-144; and Hayashi (1992) Genet. Anal. Tech. AppL. 9:73-79). Single-stranded DNA fragments of sample and control LGR6 nucleic acids will be denatured and allowed to renature. The secondary structure of single-stranded nucleic acids varies according to sequence, the resulting alteration in electrophoretic mobility enables the detection of even a single base change.

The DNA fragments may be labeled or detected with labeled probes. The sensitivity of the assay may be enhanced by using RNA (rather than DNA), in which the secondary structure is more sensitive to a change in sequence. In a preferred embodiment, the subject method utilizes heteroduplex analysis to separate double stranded heteroduplex molecules on the basis of changes in electrophoretic mobility (Keen et al. (1991) Trends Genet 7:5).

In yet another embodiment the movement of mutant or wild-type fragments in polyacrylamide gels containing a gradient of denaturant is assayed using denaturing gradient gel electrophoresis (DGGE) (Myers et al. (1985) Nature 313: 495). When DGGE is used as the method of analysis, DNA will be modified to insure that it does not completely denature, for example by adding a GC clamp of approximately 40 bp of high-melting GC-rich DNA by PCR. In a further embodiment, a temperature gradient is used in place of a denaturing gradient to identify differences in the mobility of control and sample DNA (Rosenbaum and Reissner (1987) Biophys Chem 265:12753).

Examples of other techniques for detecting point mutations include, but are not limited to, selective oligonucleotide hybridization, selective amplification, or selective primer extension. For example, oligonucleotide primers may be prepared in which the known mutation is placed centrally and then hybridized to target DNA under conditions which permit hybridization only if a perfect match is found (Saiki et al. (1986) Nature 324:163); Saiki et al. (1989) Proc. Natl Acad Sci USA 86:6230). Such allele specific oligonucleotides are hybridized to PCR amplified target DNA or a number of different mutations when the oligonucleotides are attached to the hybridizing membrane and hybridized with labeled target DNA. Alternatively, allele specific amplification technology which depends on selective PCR amplification may be used in conjunction with the instant invention.

Oligonucleotides used as primers for specific amplification may carry the mutation of interest in the center of the molecule (so that amplification depends on differential hybridization) (Gibbs et al. (1989) Nucleic Acids Res. 17:2437-2448) or at the extreme 3' end of one primer where, under appropriate conditions, mismatch can prevent, or reduce polymerase extension (Prossner (1993) Tibtech 11:238). In addition it may be desirable to introduce a novel restriction site in the region of the mutation to create cleavage-based detection (Gasparini et al. (1992) Mol. Cell Probes 6:1). It is anticipated that in certain embodiments amplification may also be performed using Taq ligase for amplification (Barany (1991) Proc. Natl. Acad Sci USA 88:189). In such cases, ligation will occur only if there is a perfect match at the 3' end of the 5' sequence making it possible to detect the presence of a known mutation at a specific site by looking for the presence or absence of amplification.

The methods described herein may be performed, for example, by utilizing pre-packaged diagnostic kits comprising at least one probe nucleic acid or antibody reagent described herein, which may be conveniently used, e.g., in clinical settings to diagnose patients exhibiting symptoms or family history of a disease or illness involving a GPCR gene.

This diagnostic process can also lead to the tailoring of drug treatments according to patient genotype, including prediction of side effects upon administration of drugs (referred to herein as pharmacogenomics). Pharmacogenomics allows for the selection of agents (e.g., drugs) for therapeutic or prophylactic treatment of an individual based on the genotype of the individual (e.g., the genotype of the individual is examined to determine the ability of the individual to respond to a particular agent).

Agents, or modulators, that have a stimulatory or inhibitory effect on the biological activity or gene expression of a GPCR polypeptide of the invention can be administered to individuals to treat disorders associated with aberrant GPCR activity. In conjunction with such treatment, the pharmacogenomics (i.e., the study of the relationship between an individual's genotype and that individual's response to a foreign compound or drug) of the individual may be considered. Differences in efficacy of therapeutics can lead to severe toxicity or therapeutic failure by altering the relation between dose and blood concentration of the pharmacologically active drug. Thus, the pharmacogenomics of the individual permits the selection of effective agents (e.g., drugs) for prophylactic or therapeutic treatments based on a consideration of the individual's genotype. Such pharmacogenomics can further be used to determine appropriate dosages and therapeutic regimens. Accordingly, the activity of a GPCR polypeptide of the invention, expression of a GPCR nucleic acid, or polymorphic content of GPCR genes in an individual can be determined to select appropriate agent(s) for therapeutic or prophylactic treatment of the individual.

Pharmacogenomics deals with clinically significant hereditary variations in the response to drugs because of altered drug disposition and abnormal action in affected persons (Eichelbaum, Clin. Exp. Pharmacol. Physiol., 23:983-985, 1996; Linder, Clin. Chem., 43:254-266, 1997). In general, two types of pharmacogenetic conditions can be differentiated. Genetic conditions transmitted as a single factor altering the way drugs act on the body (altered drug action) or genetic conditions transmitted as single factors altering the way the body acts on drugs (altered drug metabolism). Altered drug action may occur in a patient having a polymorphism (e.g., an single nucleotide polymorphism or SNP) in promoter, intronic, or exonic sequences of a GPCR polypeptide of the invention. Thus, determining the presence and prevalence of polymorphisms may allow for prediction of a patient's response to a particular therapeutic agent. In particular, polymorphisms in the promoter region may be critical in determining the risk that a patient will develop a particular disease or disorder.

In particular embodiments, the present invention provides methods of diagnosing or detecting a risk for developing a neurological or metabolic disease or disorder in a patient. Expression, biological activity, and mutational analysis of SREB polypeptides and polynucleotides can each serve as a diagnostic tool for neurological or metabolic diseases and disorders. Expression, biological activity, and mutational analysis of GPR88 and GPR22 can each serve as a diagnostic tool for neurological diseases and disorders. In addition, determination of the genetic subtyping of one or more GPCR gene sequences can be used to subtype individuals or families to determine their predisposition for developing a particular disease or disorder.

In certain embodiments related to both neurological and metabolic diseases and disorders, these methods comprise measuring a level of activity or expression of one or more SREB polynucleotides or polypeptides, e.g., SREB1, SREB2, and/or SREB3, in a biological sample obtained from a patient, and then comparing the level measured to control values or to levels measured in a control subject that does not have the neurological or metabolic disease or disorder. If the level in the patient is significantly higher or lower than the control level, then the patient may be considered at risk of having the neurological or metabolic disease or disorder. In certain embodiments, the patient is considered to have the neurological or metabolic disorder if the level in the patient is at least two-fold, three-fold, or five-fold different than the level in the control. In one embodiment, a patient is diagnosed with a neurological or metabolic disease or disorder if the level of expression or activity of one or more SREBs is significantly lower than a control value. In certain embodiments, the level of one or more SREBs' expression or activity in the patient is less than 75%, les than 50%, less than 25%, or less than 10% the level measured in the control.

In certain embodiments related to neurological diseases and disorders, these methods comprise measuring a level of activity or expression of GPR88 and/or GPR22 in a biological sample obtained from a patient, and then comparing the level measured to control values or to levels measured in a control subject that does not have the neurological or metabolic disease or disorder. If the level in the patient is significantly higher or lower than the control level, then the patient may be considered at risk of having the neurological disease or disorder. In certain embodiments, the patient is considered to have the neurological disease or disorder if the level in the patient is at least two-fold, three-fold, or five-fold different than the level in the control. In one embodiment, a patient is diagnosed with a neurological disease or disorder if the level of expression or activity of one or more of GPR88 and/or GPR22 is significantly lower than a control value. In certain embodiments, the level of one or more of GPR88 and/or GPR22 expression or activity in the patient is less than 75%, les than 50%, less than 25%, or less than 10% the level measured in the control.

An exemplary method for detecting the presence or absence of a GPCR protein or nucleic acid in a biological sample involves obtaining a biological sample from a test subject and contacting the biological sample with a compound or an agent capable of detecting a GPCR protein or nucleic acid (e.g., mRNA, genomic DNA) that encodes a GPCR protein such that the presence of the GPCR protein or nucleic acid is detected in the biological sample. A preferred agent for detecting GPCR mRNA or genomic DNA is a labeled nucleic acid probe capable of hybridizing to a GPCR mRNA or genomic DNA.

The nucleic acid probe can be, for example, a full-length GPCR nucleic acid, such as the nucleic acid of any of SEQ ID NOs:2, 4, 6, 14, or 18, or a portion thereof, such as an oligonucleotide of at least 15, 30, 50, 100, 250 or 500 nucleotides in length and sufficient to specifically hybridize under stringent conditions to a GPCR mRNA or genomic DNA. Other suitable probes for use in the diagnostic assays of the invention are described herein.

Another method for detecting the presence or absence of a GPCR protein in a biological sample involves obtaining a biological sample from a test subject and contacting the biological sample with an antibody that is capable of detecting a GPCR protein, where said antibody capable of binding to the GPCR protein preferably has a detectable label. Antibodies can be polyclonal, or more preferably, monoclonal. An intact antibody, or a fragment thereof (e.g., Fab or F(ab')2) can be used.

The methods described herein may be performed, for example, by utilizing pre-packaged diagnostic kits comprising at least one probe nucleic acid or antibody reagent described herein, which may be conveniently used, e.g., in clinical settings to diagnose patients exhibiting symptoms or family history of a disease or illness involving one or more GPCR genes, including, in particular embodiments, SREB1, SREB2, SREB3, GPR88, and GPR22.

Gene Therapy

Gene therapy is another potential therapeutic approach in which normal copies of a gene or nucleic acid encoding sense RNA for a GPCR of the invention are introduced into cells to successfully produce GPCR polypeptide. The gene must be delivered to those cells in a form in which it can be taken up and encode for sufficient protein to provide effective function. Alternatively, GPCR antisense RNA and DNA or other interfering RNAs (RNAi), such as siRNAs, or a gene that expresses such RNA may be introduced into cells that express, perhaps excessively, a wild-type or polymorphic GPCR polypeptide. The gene or RNA must be delivered to those cells in a form in which it can be taken up and provide for sufficient RNA to provide effective function.

Retroviral vectors, adenoviral vectors, adenovirus-associated viral vectors, or other viral vectors with the appropriate tropism for a particular cell involved in disease may be used as a gene transfer delivery system for delivering such polynucleotides. Numerous vectors useful for this purpose are generally known (Friedman, Science 244:1275-1281, 1989; Eglitis et al., BioTechniques 6:608-614, 1988; Tolstoshev et al., Curr. Opin. Biotech. 1:55-61, 1990; Sharp, Lancet 337: 1277-1278, 1991; Cornetta et al., Nucl. Acid Res. Mol. Biol. 36:311-322, 1987; Anderson, Science 226:401-409, 1984; Moen, Blood Cells 17:407-416, 1991; Miller et al., Biotech. 7:980-990, 1989; Le Gal La Salle et al., Science 259:988-990, 1993; Johnson, Chest 107:77S-83S, 1995). Retroviral vectors are particularly well developed and have been used in clinical settings (Rosenberg et al., N. Engl. J. Med. 323:370, 1990; Anderson et al., U.S. Pat. No. 5,399,346). Non-viral approaches may also be employed for the introduction of therapeutic DNA into diseased cells. For example, GPCR may be introduced into a cell by lipofection (Feigner et al., Proc. Natl. Acad. Sci. USA 84:7413, 1987; Ono et al., Neurosci. Lett. 117:259, 1990; Brigham et al., Am. J. Med. Sci. 298:278, 1989; Staubinger et al., Meth. Enzymol. 101:512, 1983), asialorosonucoid-polylysine conjugation (Wu et al., J. Biol. Chem. 263:14621, 1988; Wu et al., J. Biol. Chem. 264:16985, 1989); or micro-injection under surgical conditions (Wolff et al., Science 247:1465, 1990).

Gene transfer can also be achieved using non-viral means requiring introduction of the nucleic acid in vitro. This method would, for example, include calcium phosphate, DEAE dextran, electroporation, and protoplast fusion. Liposomes may also be potentially beneficial for delivery of DNA into a cell.

Many methods for introducing vectors into cells or tissues are available and equally suitable for use in vivo, in vitro and ex vivo. For ex vivo therapy, vectors may be introduced into stem cells taken from the patient and clonally propagated for autologous transplant back into that same patient. Delivery by transfection and by liposome injections may be achieved using methods that are well known in the art. Transplantation of normal genes into the affected cells of a patient can also be useful therapy. In this procedure, a normal gene encoding a GPCR polypeptide is transferred into a cultivatable cell type, either exogenously or endogenously to the patient. These cells are then injected into the targeted tissue(s).

In the constructs described, GPCR cDNA expression can be directed from any suitable promoter (e.g., the human cytomegalovirus (CMV), simian virus 40 (SV40), or metallothionein promoters), and regulated by any appropriate mammalian regulatory element. For example, if desired, enhancers known to preferentially direct gene expression in a particular cell may be used to direct GPCR expression. The enhancers used could include, without limitation, those that are characterized as tissue- or cell-specific in their expression. Alternatively, if a GPCR genomic clone is used as a therapeutic construct (for example, following isolation by hybridization with the GPCR cDNA described above), regulation may be mediated by the cognate regulatory sequences or, if desired, by regulatory sequences derived from a heterologous source, including any of the promoters or regulatory elements described above.

Antisense or interferring RNA (RNAI) based strategies may be employed to explore GPCR gene function and as a basis for therapeutic drug design. The principle is based on the hypothesis that sequence-specific suppression of gene expression can be achieved by intracellular hybridization between mRNA and a complementary antisense species. The formation of a hybrid RNA duplex may then interfere with the processing/transport/translation and/or stability of the target GPCR mRNA. Antisense and interferring RNA strategies may use a variety of approaches including the use of antisense oligonucleotides and injection of antisense RNA. Phenotypic effects induced by antisense effects are based on changes in criteria such as protein levels, protein activity measurement, and target mRNA levels. Such technology is well known in the art, and sense or antisense oligomers, or larger fragments, can be designed from various locations along the coding or control regions of sequences encoding a GPCR of the invention. In one example, the complementary oligonucleotide is designed from the most unique 5' sequence and used either to inhibit transcription by preventing promoter binding to the upstream nontranslated sequence or translation of a GPCR encoding transcript by preventing the ribosome from binding. Using an appropriate portion of the signal and 5' sequence, an effective antisense oligonucleotide includes any 15-25 nucleotide spanning the region that translates into the signal or 5' coding sequence of the polypeptide or 21-23 nucleotide spanning region for small interfering RNAs.

For example, gene therapy may also be accomplished by direct administration of antisense mRNA or small interfering RNAs to a cell that is expected to be involved in a disease or disorder. The antisense mRNA may be produced and isolated by any standard technique, but it is most readily produced by in vitro transcription using an antisense cDNA under the control of a high efficiency promoter (e.g., the T7 promoter). Administration of antisense mRNA to cells can be carried out by any of the methods for direct nucleic acid administration described above.

Ribozymes, enzymatic RNA molecules, may also be used to catalyze the specific cleavage of RNA. The mechanism of ribozyme action involves sequence-specific hybridization of the ribozyme molecule to complementary target RNA, followed by endonucleolytic cleavage. Examples, which may be used, include engineered hammerhead motif ribozyme molecules that can specifically and efficiently catalyze endonucleolytic cleavage of sequences encoding a GPCR of the invention.

Specific ribozyme cleavage sites within any potential RNA target are initially identified by scanning the target molecule for ribozyme cleavage sites which include the following sequences: GUA, GUU, and GUC. Once identified, short RNA sequences of, e.g., between 15 and 25 ribonucleotides corresponding to the region of the target gene containing the cleavage site may be evaluated for secondary structural features that render the oligonucleotide inoperable. The suitability of candidate targets may also be evaluated by testing accessibility to hybridization with complementary oligonucleotides using ribonuclease protection assays.

Other nucleic acid molecules that create triple helices within a gene have also been demonstrated to block transcription.

Antisense molecules and ribozymes of the invention may be prepared by any method known in the art for the synthesis of nucleic acid molecules. These include techniques for chemically synthesizing oligonucleotides such as solid phase phosphoramidite chemical synthesis. Alternatively, RNA molecules may be generated by in vitro and in vivo transcription of DNA sequences encoding a GPCR polypeptide of the invention. Such DNA sequences may be incorporated into a wide variety of vectors with suitable RNA polymerase promoters such as T7 or SP6. Alternatively, these cDNA constructs that synthesize antisense RNA constitutively or inducibly can be introduced into cell lines, cells, or tissues.

RNA molecules may be modified to increase intracellular stability and half-life. Possible modifications include, but are not limited to, the addition of flanking sequences at the 5' and/or 3' ends of the molecule or the use of phosphorothioate or 2' O-methyl rather than phosphodiesterase linkages within the backbone of the molecule. This concept can be extended in all of these molecules by the inclusion of nontraditional bases such as inosine, queosine, and wybutosine, as well as acetyl-, methyl-, thio-, and similarly modified forms of adenine, cytidine, guanine, thymine, and uridine, which are not as easily recognized by endogenous endonucleases.

The GPCR sequences (Table 1) taught in the present invention facilitate the design of novel transcription factors for modulating GPCR expression in native cells and animals, and cells transformed or transfected with GPCR polynucleotides. For example, the CYS2-HiS2 zinc finger proteins, which bind DNA via their zinc finger domains, have been shown to be amenable to structural changes that lead to the recognition of different target sequences. These artificial zinc finger proteins recognize specific target sites with high affinity and are able to act as gene switches to modulate gene expression. Knowledge of the particular GPCR target sequence of the present invention facilitates the engineering of zinc finger proteins specific for the target sequence using known methods such as a combination of structure-based modeling and screening of phage display libraries (Segal et aL, Proc. Nat. Acad. Sci. USA 96:2758-2763 (1999); Liu et aL, Proc. Nat. Acad. Sci. USA 94:5525-5530 (1997); Greisman et aL, Science 275: 657-661 (1997); Choo et aL, J MoL BioL 273:525-532 (1997)). Each zinc finger domain usually recognizes three or more base pairs. Since a recognition sequence of 18 base pairs is generally sufficient in length to render it unique in any known genome, a zinc finger protein consisting of 6 tandem repeats of zinc fingers would be expected to ensure specificity for a particular sequence (Segal et al.). The artificial zinc finger repeats, designed based on GPCR sequences, are fused to activation or repression domains to promote or suppress GPCR expression (Liu et al.). Alternatively, the zinc finger domains can be fused to the TATA box-binding factor with varying lengths of linker region between the zinc finger peptide and the TBP to create either transcriptional activators or repressors (Kim et aL., Proc. Nat. Acad. Sci. USA 94:3616-3620 (1997). Such proteins and polynucleotides that encode them, have utility for modulating GPCR expression in vivo in both native cells, animals and humans; and/or cells transfected with GPCR-encoding sequences. The novel transcription factor can be delivered to the target cells by transfecting constructs that express the transcription factor (gene therapy), or by introducing the protein. Engineered zinc finger proteins can also be designed to bind RNA sequences for use in therapeutics as alternatives to antisense or catalytic RNA methods (McColl et aL, Proc. Natl. Acad. Sci. USA 96:9521-9526 (1997); Wu et aL, Proc. Natl. Acad. Sci. USA 92:344-348 (1995)). The present invention contemplates methods of designing such transcription factors based on the gene sequence of the invention, as well as customized zinc finger proteins, that are useful to modulate GPCR expression in cells (native or transformed) whose genetic complement includes these sequences.

An alternative strategy for inhibiting GPCR function using gene therapy involves intracellular expression of an anti-GPCR antibody or a portion of an anti-GPCR antibody. For example, the gene (or gene fragment) encoding a monoclonal antibody that specifically binds to a GPCR polypeptide and inhibits its biological activity may be placed under the transcriptional control of a cell type-specific gene regulatory sequence.

EXAMPLES

Example 1

Identification of GPCR Polypeptides and Polynucleotides

To identify the full complement of GPCRs in human and mouse, we embarked on a multi-step process; the first step was to identify previously known GPCR genes and then the subsequent identification of novel genes. To identify known genes we searched the public literature and sequence databases of the National Center for Biotechnolgy Information for human and mouse GPCRs and then performed species comparisons. This procedure defined a unique gene set of GPCRs for both human and mouse and identified the human and mouse orthologs. In total, 340 GPCRs were identified in human and 304 in mouse. Sequence alignments indicated that 260 of these molecules were common to both species (FIG. 1).

We then asked whether the remaining GPCR genes (80 human and 44 in mouse), which did not show a counterpart in the other species, might have undiscovered orthologs. Using the non-shared GPCRs as queries, the public human and mouse genome sequence databases were searched for orthologous genes using TBLASTN, a variation of the Basic Local Alignment Search Tool (BLAST). These studies identified mouse orthologs for 61 of the human GPCRs, but no orthologs could be found for the remaining 19 (FIG. 1). No human orthologs were detected for 43 of the mouse genes. Thirty-three of these mouse genes belonged to the trace amine and MAS-related gene families. In combination with the literature/database searches, these studies for orthologs increased the number of GPCRs to 342 in human and 366 in mouse, with 323 GPCRs shared by the two species (FIG. 1).

We subsequently undertook an exhaustive search for new human GPCR genes. Two different approaches were used. In the first, we employed a homology-based strategy to search the human genome sequence database for genes encoding GPCRs (http://genome.ucsc.edu/goldenPath/14nov2002/chromosomes/). Two hundred fifty-four known GPCRs, representative of all classes, were each used as an independent query in TBLASTN searches of all human chromosomes. These searches yielded ~500,000 matches, which were first reduced to ~50,000 unique matches and then to 10,000 matches with homology to known GPCRs (see Methods). Among these, hits representing 315 of the 342 known GPCR genes were detected, consistent with 90%-95% coverage of the human genome database. Approximately 1000 hits were homologous to chemosensory GPCR receptors. Continued analysis of the remaining hits revealed 25 novel GPCR genes.

In a second discovery method, a search was conducted for proteins with sequence motifs characteristic of the four different classes of GPCRs. The Hidden Markov Model (HMM) profile-based approach was used to search the human proteome. This method yielded 1,100 potential matches. Among these hits 331 of the 342 known GPCRs were represented, confirming the validity of the search strategy. Following elimination of known genes, three novel genes were identified. The combination of both genomic search strategies revealed 28 GPCR genes that have not been previously described. These genes are referred to as PGRI to PGR28 (FIG. 1). Searches of the mouse genome sequence database, together with RT-PCR analyses, identified orthologs for 25 of the 28 novel genes in the mouse.

Altogether, these searches identified a total of 383 GPCRs in human and 391 in mouse; 358 of the GPCRs were common to the two species.

Methods

The 254 GPCRs used as queries were aligned using the Clustal W program. The amino acid sequence of the seven-transmembrane region of each GPCR was extracted and used to search through the public human genome (HG) database (downloaded in August, 2001) using TBLASTN at an E-value of 10. The resulting hits (~500,000) were combined and sorted according to contig and position numbers. Only the hit with the best E-value was selected among the group of hits within 1 kb from each other on the same contig. Each of the ~50,000 unique hits generated were used to search against nr protein database using BLASTP. From this search, 10,000 hits appeared to be most homologous to GPCRs. Almost 2000 of these hits were determined to be parts of various known GPCRs and were excluded from further consideration. The best 500 of the remaining hits were subjected to full-length gene structure prediction. This process involved comparison of 200 kb genomic DNA sequence surrounding each hit with the full-length sequence of its most homologous known GPCR using BLAST2. Twenty-five candidate novel GPCRs were obtained. Their nucleotide sequences were then used to search the EST database for the identification of human and/or mouse ESTs.

For the HMM profile-based approach, GPCR Class A, B and C HMM models were downloaded from the Pfam database and were used as queries in the HMMSEARCH program (HMMER package) to search against the International Protein Index (IPI) proteome database. All hits with E-values of less than 0.01 were evaluated for the existence of 7 TM domains using the HMMTOP program. Full-length coding sequences were predicted through a combination of methods including EST sequence assembly, ORF Finder, GenomeScan, GeneWise and GeneScan programs.

GPCRs from the same class were aligned to the class specific HMM model using the HMMALIGN program of the HMMER package. Positions not aligned to matching sites in the HMM model were removed. These multiple alignments were used to build neighbor-joining phylogenetic trees by the ClustalW program. Gaps and multiple substitutions were not corrected. Bootstrap consensus trees were plotted using TreeView. They were rooted using GPCRs that did not fit into any of four known classes. Bootstrap values for nodes near the root of the Class A tree were very low (<10%), reflecting the distant homology of the different families in this class.

Phylogenetic Analysis

Phylogenetic and receptor-ligand relationships among the GPCRs were subsequently analyzed. Each human and mouse GPCR was first assigned to one of the four distinct classes of GPCRs (A, B, C, F/S) by comparing with HMM models. All but five of the receptors (TPRA40, TM7SFI, TM7SFILI, TM7SFIL2 and TM7SF3) could be assigned to one of the four classes by this method. These assignments indicate that of 370 human GPCRs, 287 belong to Class A, 50 to Class B, 17 to Class C, and 11 to Class F/S. Of 393 mouse GPCRs, 311, 50, 17, and 10 belong to Classes A, B, C, and F/S, respectively.

The GPCRs were next catalogued according to ligand specificities reported in the literature. This effort identified 229 human and 215 mouse GPCRs with known ligands. The remaining 145 human and 178 mouse GPCRs have no known ligands and are therefore orphan receptors. Among the orphan receptors, 100 human and 133 mouse receptors belong to Class A, 34 human and 34 mouse receptors to Class B, 6 human and 6 mouse receptors to Class C, none to Class F/S, and 5 human and 5 mouse receptors could not be assigned to a specific class (FIG. 1).

The GPCRs were subsequently divided into a series of families of related receptors that either recognize the same/similar ligand(s) or are highly likely to do so. Sequence comparisons and phylogenetic analyses (see below) showed that GPCRs with highly related ligand specificities that are traditionally classed as belonging to the same "family" are at least 40% homologous in protein sequence. We therefore assigned GPCRs to specific families using the criteria that members of a family either recognize the same/similar ligand or show at least 40% sequence homology. In this manner, 93 different families of GPCRs were identified, including 16 families of orphan receptors that have not been previously described (FIG. 1). These studies assigned 12 of 145 human and 47 of 178 mouse orphan GPCRs to seven different families of receptors that interact with known ligands. The orphan receptors in these families can be predicted to recognize ligands similar to those detected by other members of the same family.

To further investigate sequence-ligand relationships among human GPCRs, we conducted a phylogenetic analysis. GPCRs were aligned to the class specific HMM profile model using the HMMALIGN program of the HMMER package. These alignments were used for the construction of phylogenetic trees, using the Clustal W program. The phylogenetic trees were then overlaid with information on the ligand specificities of individual receptors, where available.

The combined phylogenetic/ligand analyses of human GPCRs are shown in FIG. 2. The phylogenetic tree of the class A receptors, the largest set, was composed of a number of major branches that were progressively subdivided into smaller branches containing increasingly related GPCRs. The three smaller classes of receptors (classes B, C, and F/S) exhibited a similar organization, but fewer branches. GPCRs that recognize the same ligand, such as receptors for the neurotransmitter acetylcholine, or receptors that belong to the same family, were clustered together in small branches.

The phylogenetic trees, in addition, revealed a striking, higher order organization relevant to GPCR functions. Multiple receptor families with related functions that recognize ligands of a particular chemical class were grouped in the same large branch. For example, the 40 neurotransmitter/neuromodulator receptors of the dopamine, serotonin, trace amine, adenosine, acetylcholine, histamine and adrenoreceptor α and β families were all clustered phylogenetically. Moreover, the 106 GPCRs known to recognize peptide ligands were clustered in four large branches, three in the class A tree and one in the class B tree. This organization is of predictive value for numerous orphan GPCRs. For example, GPCRs such as PGR2, PGR3, PGR11, GPR19, GPR37, GPR39, GPR45, GPR63 and GPR103 could be predicted to have peptide ligands since they were grouped with other receptors activated by peptides. Other orphan receptors, such as GPR21 and GPR52 could conceivably be activated by amine neuromodulators, as they clustered phylogenetically with amine-type molecules in the large neurotransmitter branch of the class A tree.

Full-Length Sequence for Novel Human GPCR Genes Methods

To identify full-length clones for the novel human GPCR genes that were discovered by the gene-mining effort, the following methods were used:

First-Strand cDNA Synthesis

First strand cDNA Synthesis was performed as essentially described in the following kit, CLONTECH Laboratories, Inc., Protocol #PT3269-1 16 Version #PR14596.

Two 10-µl reactions described below convert 50 ng-1 µg of total or poly A+RNA into RACE-Ready first-strand cDNA. For optimal results, use 1 µg of poly A+RNA or 1 µg of total RNA in the reactions below.

1. Combined the following in separate 0.5-mi microcentrifuge tubes:

For preparation of 5'-RACE-Ready or cDNA 3'-RACE-Ready cDNA 1-3 µl RNA sample 1-3 µl RNA sample
1 µl 5'-CDS primer 1 µl 3'-CDS primer A
1 µl SMART II A oligo 2. Add sterile $H_2O$ to a final volume of 5 µl for each reaction.

3. Mix contents and spin the tubes briefly in a microcentrifuge.

4. Incubate the tubes at 70° C. for 2 min.

5. Cool the tubes on ice for 2 min.

6. Spin the tubes briefly to collect the contents at the bottom.

7. Add the following to each reaction tube (already containing 5 µl):

2 µl 5× First-Strand buffer
1 µl DTT (20 mM)
1 µl dNTP Mix (10 mM)
1 µl PowerScript Reverse Transcriptase
10 µl Total volume 8. Mix the contents of the tubes by gently pipetting.

9. Spin the tubes briefly to collect the contents at the bottom.

10. Incubate the tubes at 42° C. for 1.5 hr in an air incubator.

11. Dilute the first-strand reaction product with Tricine-EDTA Buffer:
   Added 20 µl if started with <200 ng of total RNA.
   Added 100 µl if started with >200 ng of total RNA.
   Added 250 µl if started with poly A+RNA.

12. Heat tubes at 72° C. for 7 min.

13. Samples can be stored at −20° C. for up to three months.

Now have 3'- and 5'-RACE-Ready cDNA samples.

3' and 5' RACE

1. Treat total RNA or mRNA with calf intestinal phosphatase (CIP) to remove the 5" phosphates. This eliminates truncated mRNA and non-mRNA from subsequent ligation with the GeneRacer RNA Oligo. Dephosphorylation reaction was set up in a 1.5 ml sterile microcentrifuge tube using the reagents in the kit. 1-5 µg total RNA was used in a total volume of 10 ul with 10× RNaseOut and CIP (10 U). The reaction was incubated at 50° C. for 1 hour. After incubation, the RNA was precipitated with ethanol.

2. Treat dephosphorylated RNA with tobacco acid pyrophosphatase (TAP) to remove the 5' cap structure from intact, full-length mRNA. This treatment leaves a 5' phosphate required for ligation to the GeneRacer RNA Oligo.

The reaction was set up on ice the using the reagents in the kit.

Dephosphorylated RNA 7 µl
10×TAP Buffer 1 µl
RNaseOut (40 U/ul) 1 µl
TAP (0.5 U/ul) 1 µl
Total Volume 10 µl The reaction was incubated at 37° C. for 1 hour. After incubation, the RNA was precipitated with ethanol.

3. Ligate the GeneRacer RNA Oligo to the 5' end of the mRNA using T4 RNA ligase. The GeneRacer RNA Oligo will provide a known priming site for GeneRacer. 7 µl of dephosphorylated, decapped RNA was incubated at 65° C. for 5 minutes. Then the following were added:

10× Ligase Buffer 1 µl
10 mM ATP 1 µl
RNaseOut. (40 U/ul) 1 µl
T4 RNA ligase (5 U/ul) 1 µl
Total Volume 10 µl After incubation, 90 µl of DEPC treated water was added and the reaction was extracted with phenol/chloroform, and precipitated with the addition of 2 µl of 10 mg/ml mussel glycogen, 10 µl 3 M sodium acetate, pH 5.2 and 220 ul of 95% ethanol.

4. Reverse-transcribe the ligated mRNA using Cloned AMV RT or SuperScript II RT and the GeneRacer. OligodT Primer to create RACE-ready first-strand cDNA with known priming sites at the 5' and 3' ends.

To 10 µl ligated mRNA, 1 µl of the desired primer was added and 1 µl of dNTP Mix (25 mM each) to the ligated RNA. Then the mixture was incubated at 65° C. for 5 minutes to remove any RNA secondary structure, chilled on ice for 2 minutes and added the following reagents to the ligated RNA and primer mixture:

5×RT Buffer 4 µl
Cloned AMV RT (15 U/µl) 1 µl
Sterile water 2 µl
RNaseOut (40 U/µl) 1 µl
Total Volume 20 µl The reaction was incubated at 45° C. for 1 hour and then at 85° C. for 15 minutes to inactivate the cloned AMV RT.

5. To obtain 5' ends, amplify the first-strand cDNA using a reverse gene specific primer (Reverse GSP) and the GeneRacer 5' Primer. Only mRNA that has the GeneRacer RNA Oligo ligated to the 5' end AND is completely reverse-transcribed will be amplified using PCR. If needed, perform additional PCR with nested primers.

6. To obtain 3' ends, amplify the first-strand cDNA using a forward gene-specific primer (Forward GSP) and the GeneRacer 3' Primer. Only mRNA that has a polyA tail and is reverse-transcribed will be amplified using PCR. If needed, perform additional PCR with nested primers.

PCR Conditions Used for 3' or 5' RACE or Internal Fragment Amplification

PCR was performed using the following cycle parameters, 94 C for 2 minutes for melting, then (94 C for 30 sec; 67 C for 1 minute; 72 C for 1.5 minutes) for 6 cycles, then (94 C for 30 seconds, 60 C for 1 minute, 72 C for 1.5 minutes) for 38 cycles, then 72 C for 7 minutes and then hold at 4 C.

7. Purify RACE PCR products using the S.N.A.P. columns included in the kit.

Rapid Amplification of cDNA Ends (RACE)

This procedure describes the 5'-RACE and 3'-RACE PCR reactions that generate the 5' and 3' cDNA fragments.

1. For each 50-µl reaction, mix the following reagents:

34.5 µl PCR-Grade Water
5 µl 10× Advantage 2 PCR Buffer
1 µl dNTP Mix (10 mM)
1 µl 50× Advantage 2 Polymerase Mix
41.5 µl Total volume Mix well by vortexing (without introducing bubbles) and briefly spin the tube in a microcentrifuge.

2. For 5'-RACE: PCR reactions as shown in Table III of Clontech's RACE kit.

For 3'-RACE: PCR reactions as shown in Table IV of Clontech's RACE kit.

PCR Cycle conditions: as described in the Clontech's RACE kit.

Complete reactions were then run on gel to visualize PCR products. If the gel showed nothing then the reaction would be amplified for additional cycles (total of 40).

Human PGR4

Full length cDNA was isolated from human Pituitary by a combination of 5' and 3' Rapid Amplification of cDNA Ends (RACE) and internal RT-PCR experiments using the methods described above. RACE pituitary was prepared using the Invitrogen GeneRacer Kit (Cat #L1500-01).

The following RACE primers were used:

```
5' RACE (Invitrogen)
CGACTGGAGCACGAGGACACTGA        (SEQ ID NO: 1557)

3' RACE (Invitrogen):
GCTGTCAACGATACGCTACGTAACG      (SEQ ID NO: 1558)

5' nested RACE primer:
GGACACTGACATGGACTGAAGGAGTA     (SEQ ID NO: 1559)

3' nested RACE primer:
CGCTACGTAACGGCATGACAGTG        (SEQ ID NO: 1560)
```

The following cDNA primers were used:

```
HPG5dn01,
GCCGCGCTGCAGGTGCACGATG,        (SEQ ID NO: 1561)

HPG5-360up,
TGCCACCTGCTCTTCTACGTGATG,      (SEQ ID NO: 1562)

HPG5-601dn
GCAAATCAGTGTGCAAATCGAAA,       (SEQ ID NO: 1563)

HPG5-629up
CATTCCTGGAGAGATCTCGTGGGA       (SEQ ID NO: 1564)

HPG5-1183dn
GGTGCCACTGATGGAGGGTACTG,       (SEQ ID NO: 1565)

HPG5-755up
GGTAAGCCTGGCCTACTCGGAGAG,      (SEQ ID NO: 1566)

HPG5MaxDN
```

```
                TGCACCTGGCCAACAAATCCTTTT,       (SEQ ID NO: 1567)

HPG5MaxUP
                GGTAAGCCTGGCCTACTCGGAGAG,       (SEQ ID NO: 1568)

HPGgMax5up18
                GGGCCAGAGGCGAGATGT,             (SEQ ID NO: 1569)

HPG5gMax5dn
                GCAGGTCCGCGCAGAA,               (SEQ ID NO: 1570)
                used for 5' RACE HPG5gMax3up
                CCACCAGATCCGCGTGTC;             (SEQ ID NO: 1571)
                used for 3' RACE HPG5gMax3end
                GTTGGTCAGGTTGGTCTCGAAC,         (SEQ ID NO: 1572)
```

The human PGR4 cDNA sequence is shown in SEQ ID NO: 88, and the human

Human PGR2

Full length cDNA was isolated from human uterus by a combination of 5' and 3' Rapid Amplification of cDNA Ends (RACE) and internal RT-PCR experiments as described above. RACE pituitary was prepared using the Invitrogen GeneRacer Kit (Cat #L1 500-01).

The following RACE primers were used:

```
                5' RACE (Invitrogen)
                CGACTGGAGCACGAGGACACTGA         (SEQ ID NO: 1557)

3' RACE (Invitrogen):
                GCTGTCAACGATACGCTACGTAACG       (SEQ ID NO: 1558)

5' nested RACE primer:
                GGACACTGACATGGACTGAAGGAGTA      (SEQ ID NO: 1559)

3' nested RACE primer:
                CGCTACGTAACGGCATGACAGTG         (SEQ ID NO: 1560)
```

The following cDNA primers were used:

```
                3RaceUp
                ACTACCTTCTGGCGCTCACA            (SEQ ID NO: 1573)

5RaceDn
                CCCAGCAGGACACTGTAGTAGA          (SEQ ID NO: 1574)

HPG9-1up
                ATGGATCCCAGCGTTGTTAGCAAT        (SEQ ID NO: 1575)

HPG9-1dnA
                TGGAGTCCTTGGATGGCCTTATTC        (SEQ ID NO: 1576)

HPG9-1dnB
                CCGCGAACACGATGACCAC             (SEQ ID NO: 1577)

HPG9-2upB
                GGGGGAAGCTGGGACCTCCGAATA        (SEQ ID NO: 1578)

HPG9-3up
                CGAGGTCCTCAAGTGGGCTCACT         (SEQ ID NO: 1579)

HPG9-3dn
                GGTGTTTCTATGGCGCGATCTCA         (SEQ ID NO: 1580)

HPG9-MaxUp
                CGTTGTTAGCAATGAGTATTATG         (SEQ ID NO: 1581)

HPG9-Maxdn
                TATCACTTTATTTTATTAAAGGTTACAC    (SEQ ID NO: 1582)
```

The human PGR2 cDNA sequence is provided in SEQ ID NO: 34, and the polypeptide sequence is provide in SEQ ID NO: 33.

Human PG3

Full length cDNA was isolated from human whole brain by a combination of 5' and 3' Rapid Amplification of cDNA Ends (RACE) and internal RT-PCR experiments as described above. RACE pituitary was prepared using the Invitrogen GeneRacer Kit (Cat #L1500-01).

The following RACE primers were used:

```
                5' RACE (Invitrogen)
                CGACTGGAGCACGAGGACACTGA         (SEQ ID NO: 1557)

3' RACE (Invitrogen):
                GCTGTCAACGATACGCTACGTAACG       (SEQ ID NO: 1558)

5' nested RACE primer:
                GGACACTGACATGGACTGAAGGAGTA      (SEQ ID NO: 1559)

3' nested RACE primer:
                CGCTACGTAACGGCATGACAGTG         (SEQ ID NO: 1560)
```

The following cDNA primers were used:

```
                Hpg10max5up
                ATGGAGCACACGCACGCCCACCTCG       (SEQ ID NO: 1583)

Hpg10max5dn
                TCATGATGATGCGGGGGGCCCAAAG       (SEQ ID NO: 1584)

Hpg10-02up
                CGGCCAAGGGTAGGAGCCAGTCCTG       (SEQ ID NO: 1585)

Hpg10-02dn
                CTTGAGCGGGTGGCAGACAGCGATA;      (SEQ ID NO: 1586)
                                                used in 5' RACE Hpg10-03up
                GGGTTTCGTGCCCGTGGTCTACT         (SEQ ID NO: 1587)

Hpg10-03dn
                ATGGTGAACAAGATGGCGGTGGT         (SEQ ID NO: 1588)

Hpg10-04up
                CACCCGCTCAAGTACCACA             (SEQ ID NO: 1589)

Hpg10-04dn
                TCACAGGATGATGACACAAGCTC         (SEQ ID NO: 1590)

Hpg10-05up
                CCATCTTGTTCACCATTACCTC,         (SEQ ID NO: 1591)
                                                used in 3' RACE Hpg10-05dn
                CATTACGACTTTTTATAGGTTTTCC       (SEQ ID NO: 1592)

Hpg10g01up
                CACCGAGCCGGCGACCAGAGTC          (SEQ ID NO: 1593)

Hpg10g01dn
                TGAGCGGGTGGCAGACAGCGAT          (SEQ ID NO: 1594)
```

The human PGR3 cDNA sequence is provided in SEQ ID NO: 54, and the polypeptide sequence is provided in SEQ ID NO: 53.

Human PGR6

Full length cDNA was isolated from human whole brain by a combination of 5' and 3' Rapid Amplification of cDNA Ends (RACE) and internal RT-PCR experiments as described above. RACE pituitary was prepared using the Invitrogen GeneRacer Kit (Cat #L1500-01).

The following RACE primers were used:

```
5' RACE (Invitrogen)
CGACTGGAGCACGAGGACACTGA        (SEQ ID NO: 1557)

3' RACE (Invitrogen):
GCTGTCAACGATACGCTACGTAACG      (SEQ ID NO: 1558)

5' nested RACE primer:
GGACACTGACATGGACTGAAGGAGTA     (SEQ ID NO: 1559)

3' nested RACE primer:
CGCTACGTAACGGCATGACAGTG        (SEQ ID NO: 1560)
```

The following cDNA primers were used:

```
ET11-01up
ATGGGGGATGAGCTGGCACCTTG        (SEQ ID NO: 1595)

ET11-01dn
TGGCACGGGGAAGCATCATGAGT        (SEQ ID NO: 1596)

ET11-02up
TAGTTCCAGACAGCTGCTCCTTCCTTT    (SEQ ID NO: 1597)

ET11-02dn
GAAGTCTTGGCCTCTGCATAGATCCTC    (SEQ ID NO: 1598)

ET11-03up
ATGGTGGCAGTGGGATGATCTGTTA      (SEQ ID NO: 1599)

ET11-03dn
AGGTAGCGCAGTGGATGGATGACT;      (SEQ ID NO: 1600)
                               used in 5' RACE ET11-04up
GCTGTACTGGCTTTTCCTTCCCTCA      (SEQ ID NO: 1601)

ET11-04dn
ACACCACCCCTGTGCTCACGTA         (SEQ ID NO: 1602)

ET11-05up
CTGCTCTCAGACCTGGCCTACAT        (SEQ ID NO: 1603)

ET11-05dn
CTAGGAAATGGTAAAGATGGCCTGG      (SEQ ID NO: 1604)

ET11-06up
TGCCATGCTCCCATACCTGTACCTG;     (SEQ ID NO: 1605)
                               used in 3' RACE ET11-06dn
CTCCACTGCTGTGGATCGTTGGCTT      (SEQ ID NO: 1606)

ET11-07up
ATGTGGCCTCCTGGTCATTGTTAC       (SEQ ID NO: 1607)

ET11-07dn
ATTTTGGCTTCTGTGTGTTGGTCAG      (SEQ ID NO: 1608)
```

The human PGR6 cDNA sequence is provided in SEQ ID NO: 91, and the PGR6 polypeptide sequence is provided in SEQ ID NO: 90.

Human PGR10

Full length cDNA was isolated from human Pituitary by a combination of 5' and 3' Rapid Amplification of cDNA Ends (RACE) and internal RT-PCR experiments as described above. RACE pituitary was prepared using the Clontech SMART RACE Kit (Cat #K1811-1).

The following CLONTECH RACE primers were used:

```
                                              (SEQ ID NO: 1609)
3'-RACE-

CDS AAGCAGTGGTATCAACGCAGAGTACTTTTTTTTTTTTTTTTT

TTTTTTTTTTVN
```

```
                                              (SEQ ID NO: 1610)
5'-RACE-

CDSTTTTTTTTTTTTTTTTTTTTTTTTVN (WHERE N = A, C, G,

T AND V = A, C, G)

(SEQ ID NO: 1611)
Smart IIA
AAGCAGTGGTATCAACGCAGAGTACGCGGG (SEQ ID NO: 1612)
NUP
AAGCAGTGGTATCAACGCAGAGT (SEQ ID NO: 1613)
UPM-LONG
CTAATACGACTCACTATAGGGCAAGCAGTGGTATCAACGCAGAGT (SEQ ID NO: 1614)
UPM-SHORT
CTAATACGACTCACTATAGGGC
```

The following cDNA primers were used:

```
J-H-PG63-U1
TGGATGATCTCATGAGCGTCCTG        (SEQ ID NO: 1615)

J-H-PG63-L1
TCTGAAACCCCACGACGTTCTG         (SEQ ID NO: 1616)

J-H-PG63-U2
AGAACCGGGGACTCTCTATGG          (SEQ ID NO: 1617)

J-H-PG63-L2
GGTGGGCAAAAAGAGGGAGTATG        (SEQ ID NO: 1618)

J-H-PG63-U8
CACAAGTCAGATCTCCATCCCTACG      (SEQ ID NO: 1619)

J-H-PG63-L8
TGCTGTATCCAGAAGCCTACCATGT      (SEQ ID NO: 1620)

J-H-PG63-U7
GGACTGTGTCTCTCCATGCACCTAC      (SEQ ID NO: 1621)

J-H-PG63-L7
GATCCATTCTTGCTCCTGTTAGACCA     (SEQ ID NO: 1622)

J-H-PG63-U6
TGACTCTTATGCATGGGATTGATGA      (SEQ ID NO: 1623)

J-H-PG63-L6
CTCCTACCAAGTTCCCCTCTAGATGTT    (SEQ ID NO: 1624)

J-H-PG63-U5
AGATGGGATTCTGTGCACAAGCTC       (SEQ ID NO: 1625)

J-H-PG63-L5
ACATGAAGATGGTCACGGACAGG        (SEQ ID NO: 1626)

J-H-PG63-U3
GTAGAAATCAGCACCACGCCCTCT       (SEQ ID NO: 1627)

J-H-PG63-U4
CAGATCTCCATCCCTACGTTACTCCA     (SEQ ID NO: 1628)
```

The human PGR10 cDNA sequence determined by PCR and RACE is provided in SEQ ID NO: 6, and the PGR10 polypeptide sequence is provided in SEQ ID NO: 5.

Human PGR25

Full length cDNA was isolated from human Pituitary by a combination of 5' and 3' Rapid Amplification of cDNA Ends (RACE) and internal RT-PCR experiments as described above. RACE pituitary was prepared using the Clontech SMART RACE Kit (Cat #K 811-1).

The following CLONTECH RACE primers were used:

3'-RACE-CDS (SEQ ID NO: 1609)
AAGCAGTGGTATCAACGCAGAGTACTTTTTTTTTTTTTTTTTT
TTTTTTTTTVN

5'-RACE- (SEQ ID NO: 1610)
CDSTTTTTTTTTTTTTTTTTTTTTTTVN (WHERE N = A, C, G, T AND V = A, C, G)

Smart IIA (SEQ ID NO: 1611)
AAGCAGTGGTATCAACGCAGAGTACGCGGG

NUP (SEQ ID NO: 1612)
AAGCAGTGGTATCAACGCAGAGT

UPM-LONG (SEQ ID NO: 1613)
CTAATACGACTCACTATAGGGCAAGCAGTGGTATCAACGCAGAGT

UPM-SHORT (SEQ ID NO: 1614)
CTAATACGACTCACTATAGGGC

The following cDNA primers were used:

| Primer | Sequence | SEQ ID NO |
|---|---|---|
| JW-H-PG208-L6 | CGGTAATGGGAGGAATTCACGG | (SEQ ID NO: 1629) |
| JW-H-PG208-U2 | CGGAGCAGACAGCCTTGAATCT | (SEQ ID NO: 1630) |
| JW-H-PG208-L2 | GTGGATGTGGTAGCGCTGGTT | (SEQ ID NO: 1631) |
| JW-H-PG208-U3 | AAATCCTGCCCAAGACCGTGAA | (SEQ ID NO: 1632) |
| JW-H-PG208-L3 | CTGGCTCGAGGCGGAAACTAA | (SEQ ID NO: 1633) |
| JW-H-PG208-U4 | ACGGCTGTGCGCTCACGAGA | (SEQ ID NO: 1634) |
| JW-H-PG208-L4 | AGCACGCCAAAGACCCACGAG | (SEQ ID NO: 1635) |
| J-H-PG208-U7 | GCTGGAAAGGAGATCGCCATGT | (SEQ ID NO: 1636) |
| J-H-PG208-L7 | TGGCCCATGACGGTGTCAATAG | (SEQ ID NO: 1637) |
| J-H-PG208-U8 | GCGTGCTTGCTGTCAACGGTT | (SEQ ID NO: 1638) |
| J-H-PG208-L8 | GCTCACACGGCTGACAGGTCG | (SEQ ID NO: 1639) |
| J-H-PG208-U9 | TGTCTTCAACGCTGCCAAGCC | (SEQ ID NO: 1640) |
| J-H-PG208-L9 | GGTACAGCAGACCCACGACGG | (SEQ ID NO: 1641) |
| J-H-PG208-U11 | ATCCAAGGAGGGCCTGAAAGTCTA | (SEQ ID NO: 1642) |
| J-H-PG208-L11 | CAAGGCTGTCTGCTCCGAGAG | (SEQ ID NO: 1643) |
| JW-H-PG208-U1 | GCTGGAAAGGAGATCGCCATGT | (SEQ ID NO: 1644) |
| JW-H-PG208-L1 | TGAAGTCCAGGAAGGCGCAGTA | (SEQ ID NO: 1645) |
| JW-H-PG208-U5 | CCCCTGCCCTGTTTGTCATCG | (SEQ ID NO: 1646) |
| JW-H-PG208-L5 | GCTGTCTCGGGGCCACAACAC | (SEQ ID NO: 1647) |
| J-H-PG208-U10 | TGACCTGGGAAAATCTATACGGTCG | (SEQ ID NO: 1648) |
| J-H-PG208-L10 | TTGGTTATGATGGGATGGTAGGCA | (SEQ ID NO: 1649) |

The human PGR25 cDNA sequence is provided at SEQ ID NO: 46, and the human PGR25 polypeptide sequence is provided at SEQ ID NO: 45.

Human PGR17

Full length cDNA was isolated from human Pituitary by a combination of 5' and 3' Rapid Amplification of cDNA Ends (RACE) and internal RT-PCR experiments as described above. RACE pituitary was prepared using the Clontech SMART RACE Kit (Cat #K1811-1).

The following CLONTECH RACE primers were used:

3'-RACE-CDS (SEQ ID NO: 1609)
AAGCAGTGGTATCAACGCAGAGTACTTTTTTTTTTTTTTTTTT
TTTTTTTTTVN

5'-RACE- (SEQ ID NO: 1610)
CDSTTTTTTTTTTTTTTTTTTTTTTTVN (WHERE N = A, C, G, T AND V = A, C, G)

Smart IIA (SEQ ID NO: 1611)
AAGCAGTGGTATCAACGCAGAGTACGCGGG

NUP (SEQ ID NO: 1612)
AAGCAGTGGTATCAACGCAGAGT

UPM-LONG (SEQ ID NO: 1613)
CTAATACGACTCACTATAGGGCAAGCAGTGGTATCAACGCAGAGT

UPM-SHORT (SEQ ID NO: 1614)
CTAATACGACTCACTATAGGGC

The following cDNA primers were used:

| Primer | Sequence | SEQ ID NO |
|---|---|---|
| J-H-PG421-U1 | CCTGGGCAGAGAAGACATAGACCT | (SEQ ID NO: 1650) |
| J-H-PG421-L1 | GTAATTTGGGATGGAGTGGTCATATCT | (SEQ ID NO: 1651) |
| J-H-PG421-U2 | GGCTTCATTTCAATGGCATACAAT | (SEQ ID NO: 1652) |
| J-H-PG421-L2 | TCAATAAGCCTAGTTGGGAGAGTCAAT | (SEQ ID NO: 1653) |
| J-H-PG421-U3 | AGCTGCCGGAACTGTACCTTGGTTTAC | (SEQ ID NO: 1654) |

| | | |
|---|---|---|
| J-H-PG421-L3 AGCCACCACAGAACTGCCATTAACTG | (SEQ ID NO: 1655) | |
| J-H-PG421-U4 GAGCACACATATATTCGGTGAACCC | (SEQ ID NO: 1656) | |
| J-H-PG421-L4 CTGGCAATGAGGACATCTGGTAAA | (SEQ ID NO: 1657) | |
| J-H-PG421-U5 AGTCACCAAACACATTCGCCTTC | (SEQ ID NO: 1658) | |
| J-H-PG421-L5 CCCAGATAATATGCCCAAAGTTGTAGC | (SEQ ID NO: 1659) | |
| J-H-PG421-U6 TGGGCATATTATCTGGATTACTAACA | (SEQ ID NO: 1660) | |
| J-H-PG421-L6 CAGCCAATGTGGAAGTGATAGC | (SEQ ID NO: 1661) | |
| J-H-PG421-U7 TGGCAATGTCATCAATTCCTATGTCAG | (SEQ ID NO: 1662) | |
| J-H-PG421-L7 GTTTGGGCTGTCTCCGTAGGGTT | (SEQ ID NO: 1663) | |
| J-H-PG421-U8 CCTTTCTATCTACGGAAGCATCGACTT | (SEQ ID NO: 1664) | |
| J-H-PG421-L8 GGCACTCACAACATAGGTGGTTAATG | (SEQ ID NO: 1665) | |
| J-H-PG421-U9 GTGAGTGCCAGCATTTCAGATGATATG | (SEQ ID NO: 1666) | |
| J-H-PG421-L9 TGACTGTGATTGCCACCATGATAGC | (SEQ ID NO: 1667) | |
| J-H-PG421-U10 TGCCAAAACAAAAATCACATGCTAATG | (SEQ ID NO: 1668) | |
| J-H-PG421-L10 CAGGTTGTGTGGTTGATCCGTTACTT | (SEQ ID NO: 1669) | |
| J-H-PG421-U11 CTATCATGGTGGCAATCACAGTCAGT | (SEQ ID NO: 1670) | |
| J-H-PG421-L11 GTGAGTCAACCCTACAAATCCGAAAAA | (SEQ ID NO: 1671) | |

The human PGR17 cDNA sequence is provided in SEQ ID NO: 30, and the human PGR17 polypeptide sequence is provided at SEQ ID NO: 29.

Human KIAA1828

Full length cDNA was isolated from human Pituitary by a combination of 5' and 3' Rapid Amplification of cDNA Ends (RACE) and internal RT-PCR experiments as described above. RACE pituitary was prepared using the Clontech SMART RACE Kit (Cat #K1811-1). Pituitary poly A RNA was obtained from Clontech (cat#6584-1).

The following CLONTECH RACE primers were used:

(SEQ ID NO: 1609)
3'-RACE-CDS

AAGCAGTGGTATCAACGCAGAGTACTTTTTTTTTTTTTTTTTT
TTTTTTTTTVN (SEQ ID NO: 1610)
5'-RACE-

CDSTTTTTTTTTTTTTTTTTTTTTTTVN (WHERE N = A, C, G, T AND V = A, C, G)

(SEQ ID NO: 1611)
Smart IIA
AAGCAGTGGTATCAACGCAGAGTACGCGGG (SEQ ID NO: 1612)
NUP
AAGCAGTGGTATCAACGCAGAGT (SEQ ID NO: 1613)
UPM-LONG
CTAATACGACTCACTATAGGGCAAGCAGTGGTATCAACGCAGAGT (SEQ ID NO: 1614)
UPM-SHORT
CTAATACGACTCACTATAGGGC The following cDNA primers were used:

| | | |
|---|---|---|
| J-H-1828-U1 AGCCCCGCAATCTGTTGATAACT | (SEQ ID NO: 1672) | |
| J-H-1828-L1 AAGCAGAAATTCAGGAGCGTGTG | (SEQ ID NO: 1673) | |
| J-H-1828-U2 TGGAGAAGGAGACGCATCTGC | (SEQ ID NO: 1674) | |
| J-H-1828-L2 CTTGGTCACCTGCTTGTAGATGTT | (SEQ ID NO: 1675) | |
| J-H-1828-U3 CCTGACCTTTCCCAGTGTTCAATGT | (SEQ ID NO: 1676) | |
| J-H-1828-L4 TTGTCCATGAGAATCTCCCGTCTG | (SEQ ID NO: 1677) | |
| J-H-1828-U5 GGACCCTGGAAAAACGAAACTACTG | (SEQ ID NO: 1678) | |
| J-H-1828-L5 TCCATGAGAATCTCCCGTCTGTC | (SEQ ID NO: 1679) | |
| J-H-1828-U6 TGTGTACTTCCTGGGCACCTACG | (SEQ ID NO: 1680) | |
| J-H-1828-L6 GCAGGCCTTCTAGCAATTTACCCTT | (SEQ ID NO: 1681) | |
| J-H-1828-U7 CGCTGACCGCCGCTGTCT | (SEQ ID NO: 1682) | |
| J-H-1828-L7 CGCCGCAGCTGCACGTA | (SEQ ID NO: 1683) | |
| J-H-1828-U8 CTCCTGGCCGCCGTCTG | (SEQ ID NO: 1684) | |
| J-H-1828-L8 GGACCCCTCCGCTGACGA | (SEQ ID NO: 1685) | |
| J-H-1828-L9 GCGCCGCAGCTGCACGTA | (SEQ ID NO: 1686) | |
| J-H-1828-U10 GCCTGGGCGCCTTCTACG | (SEQ ID NO: 1687) | |
| J-H-1828-L10 AGGTGCACGTGCGCCTC | (SEQ ID NO: 1688) | |
| J-H-1828-U11 CCCCGTGCTGCGCCAAG | (SEQ ID NO: 1689) | |
| J-H-1828-L11 GCGTGGCCCGGAGCGTTT | (SEQ ID NO: 1690) | |
| J-H-1828-U12 GGTCACGGCTGCCACGAACAT | (SEQ ID NO: 1691) | |

```
J-H-1828-L12
GCACGCGGAATTGGGATAAGG          (SEQ ID NO: 1692)

J-H-1828-L13
CTCTGCTGGGTGCCGGCTAAA          (SEQ ID NO: 1693)
```

The human KIAA1828 cDNA sequence is provided in SEQ ID NO: 2, and the human KIAA1828 polypeptide sequence is provided in SEQ ID NO: 1.

Human HGPCR19

Full length cDNA was isolated from human Whole brain by a combination of 5' and 3' Rapid Amplification of cDNA Ends (RACE) and internal RT-PCR experiments as described above. RACE pituitary was prepared using the Invitrogen GeneRacer Kit (Cat #L1500-01).

The following RACE primers were used:

```
5' RACE (Invitrogen)
CGACTGGAGCACGAGGACACTGA        (SEQ ID NO: 1557)

3' RACE (Invitrogen):
GCTGTCAACGATACGCTACGTAACG      (SEQ ID NO: 1558)

5' nested RACE primer:
GGACACTGACATGGACTGAAGGAGTA     (SEQ ID NO: 1559)

3' nested RACE primer:
CGCTACGTAACGGCATGACAGTG        (SEQ ID NO: 1560)
```

The following cDNA primers were used:

```
Hpg27-01up
ATGACGCCCAACAGCACTGGC          (SEQ ID NO: 1694)

Hpg27-01dn
TGGCGGGCGCTGCTCATAG;           (SEQ ID NO: 1695)
                               used in 5' RACE Hpg27-01bn
GGATGGCTGAGCTGGACGGAT          (SEQ ID NO: 1696)

Hpg27-02up
TTACTGGTCCTGCCTCCTCGTCTAC      (SEQ ID NO: 1697)

Hpg27-02dn
CAGTCAGTGCGGGGTCAAACA          (SEQ ID NO: 1698)

Hpg27-03up
AGGCTATCTTCCCAGCCCCCTACCT;     (SEQ ID NO: 1699)
                               used in 3' RACE Hpg27-03dn
CTTGCCTGCCTGGAGTCGGAC          (SEQ ID NO: 1700)

Hpg27-04up
CTCCTCTCAGTCCTGGCCTATG         (SEQ ID NO: 1701)

Hpg27-04dn
ACTTCCCAGAGACAGAGTCTGTGTG      (SEQ ID NO: 1702)

HpG27-05up
TGCTACCACACAGGACATATGTGTT      (SEQ ID NO: 1703)

HpG27-05dn
GAGCCCATAGACTTCGAGGTACAG       (SEQ ID NO: 1704)

HpG27-06up
CCTCAACACAGCTGCCCAGAAAAGG      (SEQ ID NO: 1705)

HpG27-06dn
GCTAGGAGCAGGITCGCGGTGAT        (SEQ ID NO: 1706)

HpG27-07up
TCCTCTGGCCGTTTATGATTAT         (SEQ ID NO: 1707)

HpG27-07dn
TGGAAAGGAGGAAGAGATACTAGTTAA    (SEQ ID NO: 1708)
```

The human HGPCR19 nucleotide sequence is provided at SEQ ID NO: 1063, and the human HGPCR19 polypeptide sequence is provided at SEQ ID NO: 586.

Human PGR24

Full length cDNA was isolated from human Amygdala and Pituitary by a combination of 5' and 3' Rapid Amplification of cDNA Ends (RACE) and internal RT-PCR experiments as described above. RACE pituitary was prepared using the Invitrogen GeneRacer Kit (Cat #L1500-01).

The following RACE primers were used:

```
5' RACE (Invitrogen)
CGACTGGAGCACGAGGACACTGA        (SEQ ID NO: 1557)

3' RACE (Invitrogen):
GCTGTCAACGATACGCTACGTAACG      (SEQ ID NO: 1558)

5' nested RACE primer:
GGACACTGACATGGACTGAAGGAGTA     (SEQ ID NO: 1559)

3' nested RACE primer:
CGCTACGTAACGGCATGACAGTG        (SEQ ID NO: 1560)
```

The following cDNA primers were used:

```
HHpg147-1up
AGATCTTTCACATCAGTAGCCAGA       (SEQ ID NO: 1709)

HHpg147-1dn
GGAAGTGCATTGCGACTGT            (SEQ ID NO: 1710)

HHpg147-2up
CCAAGGAGAGGAGAGGCGCAGTT        (SEQ ID NO: 1711)

HHpg147-2dn
GAAAGCACAGACAGGCTCCACCAG;      (SEQ ID NO: 1712)
                               used in 5' RACE HHpg147-3up
TACCTGGACTCCACCGCCTGC          (SEQ ID NO: 1713)

HHpg147-3dn
CAGGGTGACCGCCACGATG            (SEQ ID NO: 1714)

HHpg147-4up
CTCTGTCATTTGTGGGCTGTGGC        (SEQ ID NO: 1715)

HHpg147-4dn
GGTGTTGGCAGTCAGCACGAAGA        (SEQ ID NO: 1716)

HHpg147-5up
GCTGCTGTGGAGGAAGGTGGTAG;       (SEQ ID NO: 1717)
                               used in 3' RACE HHpg147-5dn
GGCCCTCAGGATCAAATACGCTA        (SEQ ID NO: 1718)

HHpg147-6up
CTCAATGTGCACACAAATGCCAT        (SEQ ID NO: 1719)

HHpg147-6dn
GGCCCTCAGGATCAAATACGCTA        (SEQ ID NO: 1720)

HHpg147-7up
AGAGGAGAGGCGCAGTTGCTTAAC       (SEQ ID NO: 1721)

HHpg147-7dn
CATATCTGGGTCCAGATCTGCTGCT      (SEQ ID NO: 1722)

HHpg147-8up
GCCTCCAGACCTTCCGTCAT           (SEQ ID NO: 1723)
```

```
HHpg147-8dn
GCATAAACCAGGAAGATGTACAGCC      (SEQ ID NO: 1724)

HHpg147-9up
GGCTGTCACAGTCGCAATGCAC         (SEQ ID NO: 1725)

HHpg147-9dn
GGCTGGCACGGGACTTAAAGGA         (SEQ ID NO: 1726)

N147-01up
GGGCTGTACATCTTCCTGGTTTAT       (SEQ ID NO: 1727)

N147-01adn
AGGGAGTTCTAGGGCCATAGGT         (SEQ ID NO: 1728)

N147-01bdn
CGGGACTTAAAGGAGAGGATATGG       (SEQ ID NO: 1729)

N147-03up
CAGGTCCCAGCCCCCATATCC          (SEQ ID NO: 1730)

N147-03dn
TCCCACAGTACCCACCCTGCC          (SEQ ID NO: 1731)

N147-04up
TGGCTCTCAGAGGTACTCGCAGCA       (SEQ ID NO: 1732)

N147-04dn
AAAGCACTTCTCCCTCAGCGGGTT       (SEQ ID NO: 1733)

N147-05up
GGGCATGGGTTGAATGACTTCGAG       (SEQ ID NO: 1734)

N147-05dn
TCCTCCCAAGGGGTACTGCCTGGT       (SEQ ID NO: 1735)
```

The human PGR24A amygdala nucleotide sequence is provided at SEQ ID NO: 80, and the human PGR24 amygdala polypeptide sequence is provided at SEQ ID NO: 79. The human PGR24P pituitary nucleotide sequence is provided at SEQ ID NO: 1552, and the human PGR24P pituitary polypeptide sequence is provided at SEQ ID NO: 1551.

Example 2

GPR85 Knock Out Mice

GPR85 knockout mice were subjected to a variety of neurological and metabolic assays to determine the effect of reduced GPR85 levels on neurological and metabolic activity and identify neurological and metabolic diseases and disorders associated with GPR85 mutation or misregulation.

Methods

Home cage activity was monitored by a photobeam system (Accuscan Instruments) that is exterior to the cage. The photobeams provide information of when an animal is moving around in its home cage. Animals in their home cage were placed in the photobeam boxes and tested for activity over a three day period. This data provides insight into the animal's circadian rhythms of activity. Measurements examined include activity onset, average day activity, average night activity, and average activity over a 24 hour period. Food consumption was also measured during this same time frame (Test Days 1-3). The amount of food placed in the cage was measured before Test Day 1 and at the end of Test Day 3, and the average over the 3 days will give information on the amount of food eaten in a 24 hour period.

Open field activity was monitored in open field chambers (Accuscan Instruments) measuring 40 cm×40 cm×40 cm. Locomotor activity is detected by photobeams breaks as the animal crosses each beam. Measurements used to assess locomotor activity includes: Horizontal activity (total distance traveled in centimeters (cm)), total number of rearing events (animal raises up on hindlimbs), and distance traveled in the center compared to total distance traveled (center:total distance ratio). Mice were placed in the center of the field and then left undisturbed for 20 minutes in order to measure spontaneous activity in a novel environment. Mice will normally explore the edges/walls first and over time spend more time in the center as they become familiar with the environment. This assay provides data on the general activity level of mice (i.e. hypo- or hyper-active).

The hot plate test for nociception (pain) was carried out by placing a mouse on a 55° C. hot plate (Accuscan Instruments) inside a 15 cm×15 cm enclosure (to restrict them from walking off the hot plate). The latency to a hind limb response (shake or lick) is measured with a maximum cut-off time of 30 seconds to ensure that tissue damage does not occur. The test is performed once for each mouse. This assay provides data on the animal's general nociceptive response.

The light-dark exploration test measures the conflict between the natural tendencies of mice to explore a novel environment but to avoid the aversive properties of a brightly lit (anxiety-provoking) open area. The brightly lit compartment (27 cm×20 cm×30 cm) comprises two-thirds of the surface area while the dark compartment (18 cm×20 cm×30 cm) comprises one-third of the surface area. An opening is designed to allow the mouse access to both compartments.

The stress-induced hyperthermia test measures anticipatory anxiety and reflects an unconditioned physiological response where the rectal temperature of a mouse increases in response to the stressor of handling and rectal temperature measurement. The change in temperature from baseline (first) recording to the second temperature recording is a demonstration of the degree of stress/anxiety of that animal.

The basal temperature ($T_0$) of mice is measured rectally (Physitemp). A few seconds later the mouse was placed in the light-dark box for 6 minutes. Immediately after the completion of the light-dark box test, the mouse is removed from the box and the stressed temperature ($T_1$) was determined. Measurements used to assess anxiety-related responses are the total number of transitions in the light-dark box and the change in body temp ($T_1-T_0$) from baseline over the 6 minute test.

The tail suspension assay involves the use of an automated tail suspension apparatus (Med Associates) where the animal is suspended by its tail on a metal plate that is connected to a load cell amplifier. The load cell amplifier picks up the animal's movements (struggle to escape) and this data is collected by a computer during the 6 minute test session. The time spent struggling is a measure of learned helplessness behavior or behavioral despair, and the latency to the onset of the end of the struggling can be increased by clinically effective antidepressants. The time the animal spends immobile is the measure used to assess the depressive-like response of the animal.

The tube test for social dominance is carried out to assay social interactions and social behaviors. An experimental mouse is placed into the end of a PVC cylinder (6 cm in diameter, 30 cm in length) and another mouse (called a social cohort) is placed at the other end of the tube. The animal that backs out of the tube first is considered the loser and the mouse that remains in the tube is considered the winner. In general, an animal that backs out of the tube first round is considered to be socially submissive while an animal that causes another animal to back out is considered to be socially dominant. The percentage of winners and losers can then be measured to determine if a group of animals is socially dominant or submissive.

Prepulse inhibition of the acoustic startle response (PPI) was tested using the SR-Lab System (San Diego Instruments). A test session began by placing a mouse in the Plexiglas cylinder where it was left undisturbed for 3 minutes. A test session consisted of six different trial types. One trial type was a 40 ms, 120 dB sound burst used as the startle stimulus. There were four different acoustic prepulse plus acoustic startle stimulus trials. The prepulse sound was presented 100 ms before the startle stimulus. The 20 ms prepulse sounds were 73, 76, 79, and 82 dB. Finally, there were 70 dB trials where no stimulus was presented to measure baseline movement in the cylinders. Six blocks of the six trial types were presented in pseudorandom order such that each trial type was presented once within a block of six trials. The average intertribal interval was 15 seconds, with a range of 10-20 seconds. The startle response was recorded for 65 ms (measuring the response every 1 ms) starting with the onset of the startle stimulus. The background noise level in each chamber was 70 dB. The maximum startle amplitude recorded during the 65 ms sampling window was used as the dependent variable. Animals that did not demonstrate maximum startle amplitude greater than 100 were excluded from analyses. Measurements used to assess PPI are the maximum startle amplitude and the percent each of the 4 prepulses inhibits the startle response.

Context and auditory cue fear conditioning requires a training and testing day. Conditioned fear involves placing a mouse in an enclosed chamber measuring 30 cm×24 cm×24 cm. The floor of the chamber is made up of metal rods equipped to deliver a mild electrical shock (the unconditioned stimulus, 0.5 mA, 2 sec) to the mouse's feet. Electrical shock is paired with a tone such that the shock is delivered immediately when the tone turns off. The training day consists of placing the mouse in the chamber and allowing it to explore the environment for 2 minutes. At the end of 2 minutes a 75-80 dB white noise is turned on (the conditioning stimulus, CS) for 30 seconds. A 2 second, 0.5 mA footshock is paired with the white noise turning off. This training trial is then repeated again. The experiment takes approximately 5 minutes on the training day. The mouse is tested 24 hours later by separately assaying the amount of freezing it shows in the context (Context Test) in which it was shocked and the amount of freezing it shows to the tone (CS Test). Freezing behavior on the test days suggests that the mouse has learned that it received a shock in this particular context and when the white noise is turned off. This test measures emotional-based learning and memory.

Tolerance and sensitivity to ethyl alcohol (ethanol) will be tested by examining core body temperature of the mice before and after an intra-peritoneal (i.p) injection of ethanol. Initial sensitivity to alcohol is measured in mice after a single (acute) dose. In rodents repeated exposure to alcohol via repeated injections across days has been shown to produce tolerance. Core body temperature was measured rectally ($T_0$) (Physitemp) and then the mice were administered an i.p. dose of 2.5 mg/kg and placed in a Plexiglas dosing chamber. that is the same size as the animal's cage. Core body temperature was measured rectally 30 minutes post injection ($T_1$) and returned to their home cage. Mice were housed in the testing room overnight. On the next day mice were treated identically as the previous day, with a 30 minute interval between ethanol administration and $T_1$. Sensitivity to ethanol is measured by calculating the difference in body temp ($T_1$-$T_0$) while tolerance is measured by calculating the difference between the temperature changes for each day.

For cocaine studies, mice were administered an i.p. dose of 40 mg/kg and immediately placed into the open field arenas (see description above) to assess locomotor activity for 20 minutes post injection. The next day mice were administered the same dose using the same route, and locomotor activity measured in the open field arenas for 20 minutes post injection. Initial sensitivity to the stimulant effects of cocaine are seen as an increase in locomotor activity.

Results

Data Analysis

Data analysis for the various behavioral paradigms were analyzed using two-way (genotype×gender) or three-way (genotype×gender×repeated measure such as time) analysis of variance (ANOVA). Tube test analysis was carried out using the Mann-Whitney U test for nonparametric analysis. Significance was set at P<0.100. If a score of P<0.100 was obtained for a test in the Primary Screen, an additional set of wild-type and knockout mice were obtained to repeat the tests which showed a significant finding.

Mice

For tests where the P value met our criteria for statistical significance (P<0.100), an additional set of wild-type and knockout mice were used to test if the initial findings could be replicated. The mice were housed in a room with a 12:12 h light:dark schedule with access to food and water ad libitum. Mice began testing at 10-12 weeks of age.

Figure 6A:
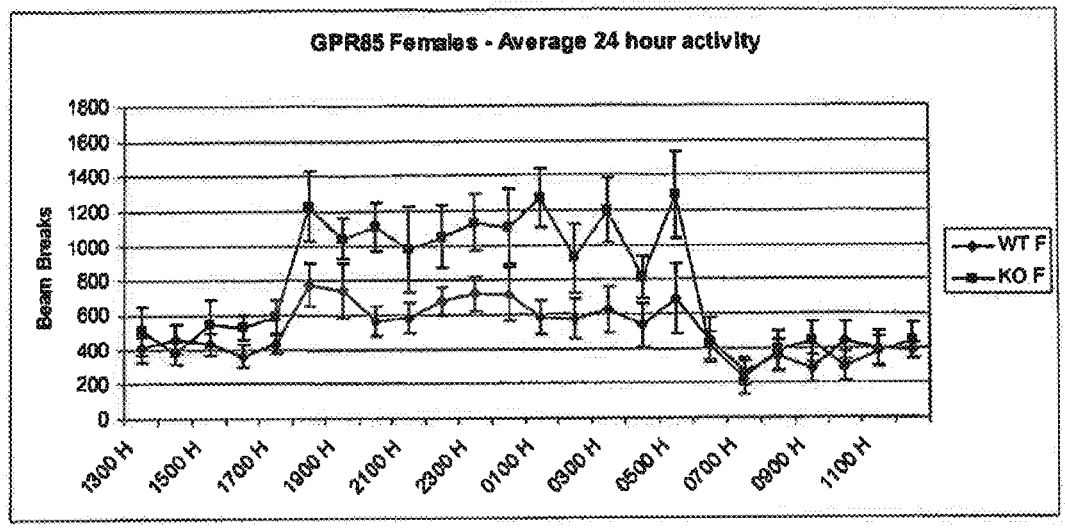
FIGS. 6A-6B. Home Cage Activity data for GPR85.
Figure 6B:
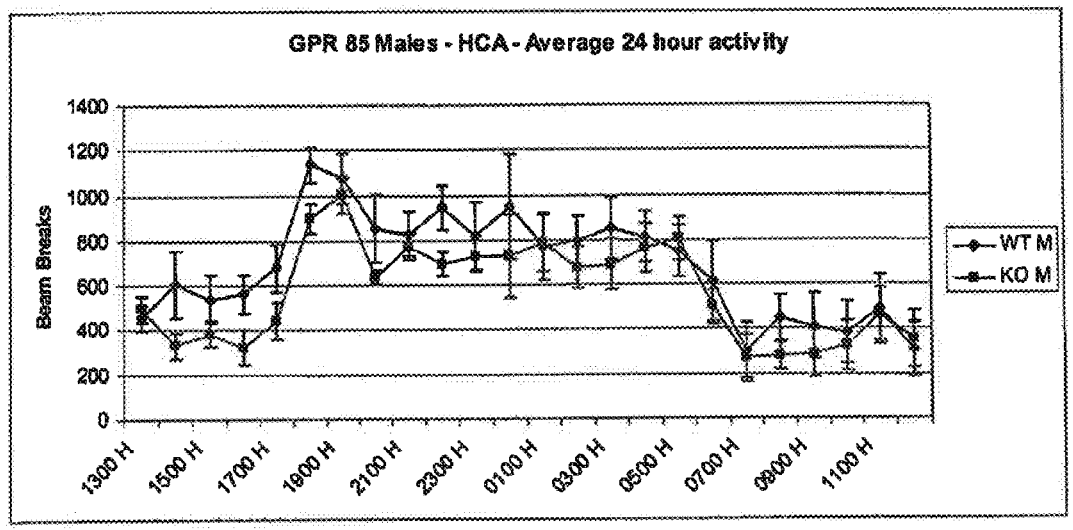

Home Cage Activity. A significant, replicable Gender X Genotype interaction was observed for total activity levels between KO and WT mice. As shown in FIG. 6, post-hoc analysis indicates that KO females are more active at night compared with WT females ($F_{(1,41)}$=6.61, P=0.014) while activity levels during the day are equal. There was no significant difference between WT and KO male mice for total activity levels. There was also no significant difference between WT and KO mice for time of activity onset. These results suggest that GPR85 may be involved with basal nighttime activity, which may impact circadian rhythms and sleep patterns.

Stress-Induced Hyperthermia (SIH). The Light Dark Exploration test (LD) and SIH was combined into a single paradigm as described above. The number of transitions between the light and dark portions of the box during the LD test was not different between genotypes. However, a significant, replicable genotype effect was observed in the SIH test for the change in temperature ($T_0$-$T_1$), which is determined by subtracting the baseline temperature ($T_0$) from the temperature measurement 6 minutes later ($T_1$), at the end of the Light-Dark test. As shown in FIG. 7, KO mice demonstrate an increased change in 30 temperature compared to the WT mice ($F_{(1,49)}$=3.195, P=0.080), suggesting an increased stress/anxiety response. This result suggests that GPR85 is involved in stress and/or anxiety.

A significant difference was also noted for basal temperatures between WT and KO mice ($F_{(1,49)}$=15.832, P=<0.001), with KO mice consistently demonstrating a decreased core body temperature compared to WT litter mates. This suggests that GPR85 has a role in thermoregulation.

Context Fear Conditioning. The conditioned fear paradigm is used to assay a fear-based response using a Pavlovian learning and memory paradigm. A significant, replicable genotype effect was demonstrated in the Context Fear paradigm for the levels of freezing to the environment in which the animals had received a mild footshock paired with an auditory cue. As shown in FIG. 8, the GPR85 KO mice displayed significantly more freezing responses than the WT mice ($F_{(1,43)}$=6.898, P=0.012). These findings indicate GPR85 KO mice have an enhanced learning and memory response to fear conditioning that is associated with the context or environment where the shock occurred.

Figure 9:
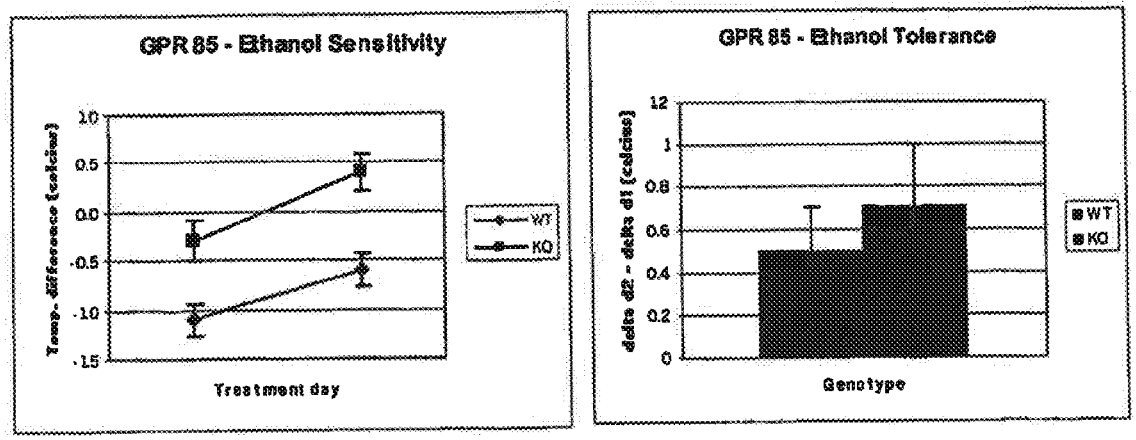
FIGS. 9A-9B. Acute effects of ethanol-induced hypothermia.

Ethanol Sensitivity and Tolerance. This two day paradigm is used to assay the acute response to the hypothermic/sedative effects of ethanol by measuring the difference in core body temperature before and after administration of a 2.5 g/kg i.p. injection of ethanol. Repeated injections of ethanol over days in rodents have been shown to produce tolerance in as few as 2 days. As shown in FIG. 9, i.p. injections of ethanol reduced body temperature in both WT and KO mice. The results of this paradigm also show that the GPR85 KO mice exhibit reduced initial sensitivity and normal tolerance to the hypothermic effects of ethanol when compared to WT mice ($F_{(1,49)}=17.485$, P=<0.001). These results indicate GPR85 is involved in regulating the behavioral responses effects of ethanol and possibly other drugs of abuse.

GPR85 KO mice demonstrated a decrease in their sensitivity to ethanol upon a second, independent exposure to ethanol. A total of 16 (8 KO and 8 WT) mice were dosed with ethanol, using the same dose and route of administration previously used, and 4 of the 8 KO mice were noticeable less sedated when compared with other mice that received the same dose. This result further demonstrates that GPR85 KO mice are less sensitive to the effects of ethanol.

Weight measurements. Weight measurements were taken (Table 34). The weight data indicates that the male KO mice weigh approximately 15% less than WT mice suggesting that this gene may be involved in metabolism and other processes that influence weight gain/loss. TABLE-US-00075 TABLE 34 Weight data. The number of mice per WT and KO group is shown above and below the value respectively. 10 GPR85 MALES WKS 11 WKS 12 WKS 13 WKS 14 WKS n=4 n=7 n=12 n=4 n=2 MEAN WT M 26.0 24.9 26.1 25.1 MEAN KO M 20.1 22.7 22.3 22.4 n=0 n=2 n=12 n=8 n=7

Summary. In summary, GPR85 mice demonstrated several behavioral differences when compared to their WT littermates. GPR85 females demonstrated an increase in basal nighttime activity compared to WT females. This result indicates GPR85 is involved in the modulation of activity and activity patterns. GPR85 KO male mice weighed less than their WT littermates, suggesting that this gene may be involved in metabolism and other processes that influence weight gain/loss. GPR85 KO mice also demonstrated an increased stress/anxiety response, impaired thermoregulation, enhanced learning and memory, and decreased sensitivity to a drug of abuse. These results suggest that this gene is involved in the following conditions and disorders: thermoregulatory dysfunction, metabolism disorders, obesity, diabetes, activity disorders (including but not limited to ADD and ADHD) circadian rhythm disorders, and sleep disorders, learning and memory processes (including but not limited to dementia and Alzheimer's disease), anxiety disorders, stress disorders, and addiction.

Example 3

GPR85/SREB3 DKO Mice are Hyperactive in Open Field

To further examine the role of SREBs in neurological and metabolic diseases and disorders, GPR85 and SREB3 knock-out mice were generated according to the methods described in U.S. Pat. No. 6,228,639. GPR85/SREB3 double knock-out (DKO) mice were generated by mating GPR85 knock-out (KO) mice to SREB3 knock-out mice.

Open field activity of GPR85/SREB3 double knock-out mice was examined to determine if loss of GPR85 and SREB3 was associated with neurological defects. This assay provides data on the general activity level of mice (i.e., hypo- or hyper-active), and indication of anxiety towards the aversive properties of the novel, open environment.

Open field activity was monitored in VersaMax chambers (Accuscan Instruments, Columbus, Ohio) measuring 40×40 cm. Locomotor activity was detected by photobeams breaks as the animal crossed each beam. The animal was placed in the center of the field and then left undisturbed for a period of time (20 min to 2 hr) in order to measure its spontaneous activity in a novel environment. Measurements used to assess locomotor activity included: horizontal activity, total distance traveled, vertical activity (rearing events—animal raises up on hindlimbs), rotation, stereotypy, and distance traveled in the center compared to total distance traveled (center: total distance ratio).

Figure 10:
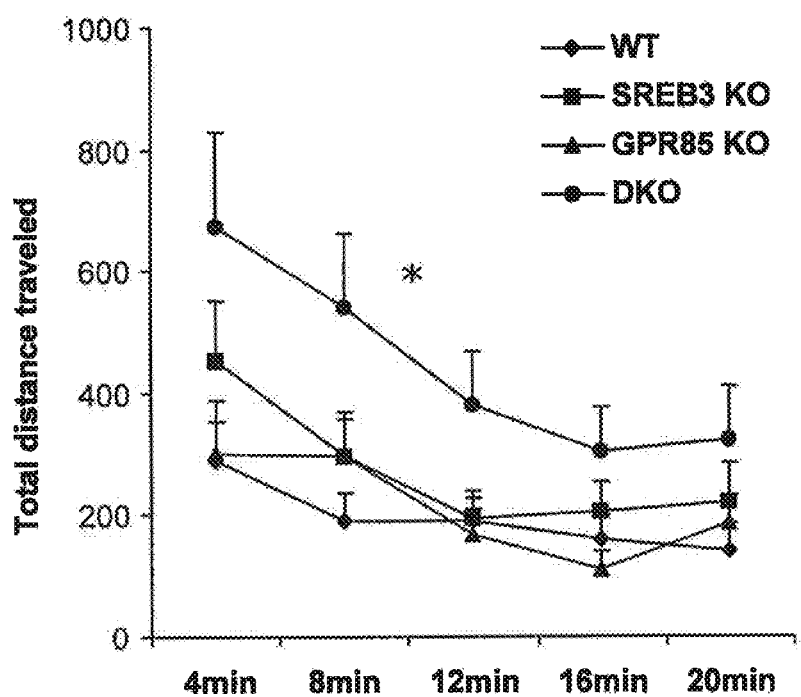
FIG. 10 is a graph demonstrating that mice in which both GPR85 and SREB3 have been knocked out (DKO) are hyperactive as assessed in the open field activity test. Data plotted are in 4-min bins. Compared to wild type (WT) mice, the DKO mice exhibit increased locomotor activity as measured by the total distance traveled in the chamber ($p<0.05$, repeated measures ANOVA, n=12-14 per group), whereas the SREB3 and GPR85 single knock-outs (Kos) do not behave differently from WT.

As shown in FIG. 10, GPR85/SREB3 DKO mice were hyperactive as assessed in the open field activity test. Compared to wild type (WT) mice, the DKO mice exhibited increased locomotor activity as measured by the total distance traveled in the chamber ($p<0.05$, repeated measures ANOVA, n=12-14 per group), whereas the SREB3 and GPR85 single KOs did not behave differently from WT.

Example 4

GPR85/SREB3 DKO Mice Have Reduced Prepulse Inhibition (PPI)

Prepulse inhibition (PPI) of the acoustic startle response evaluates the brain's sensorimotor gating function that is often disrupted in schizophrenic and other psychotic conditions. Psychostimulants such as PCP and amphetamine reduce or disrupt PPI, and many antipsychotics increase PPI and/or reverse psychostimulant-induced reduction of PPI. In addition, the startle response to the loud noise itself (in the absense of any prepulse) is a measure of the basic sensorimotor reflex.

The PPI of GPR85/SREB3 DKO mice was determined using the SR-Lab System (San Diego Instruments, San Diego, Calif.). A test session consisted of six trial types under the background noise of 70 dB. One type used a 40 msec, 120 dB noise as the startle stimulus. Four types contained acoustic startle stimulus preceded by acoustic prepulses of different intensity: the 20-msec prepulse noise of 73, 76, 79, or 82 dB was presented 100 msec before the 120 dB startle stimulus. The last trial type used the 70 dB background noise with no startle stimulus to measure baseline reaction. Six blocks of the six trial types were presented in pseudorandom order. The startle response was recorded for 65 ms starting with the onset of the startle stimulus. Measurements used to assess PPI were the maximum startle amplitude and the percent each of the 4 prepulses inhibited the startle response.

Figures 11A, 11B:
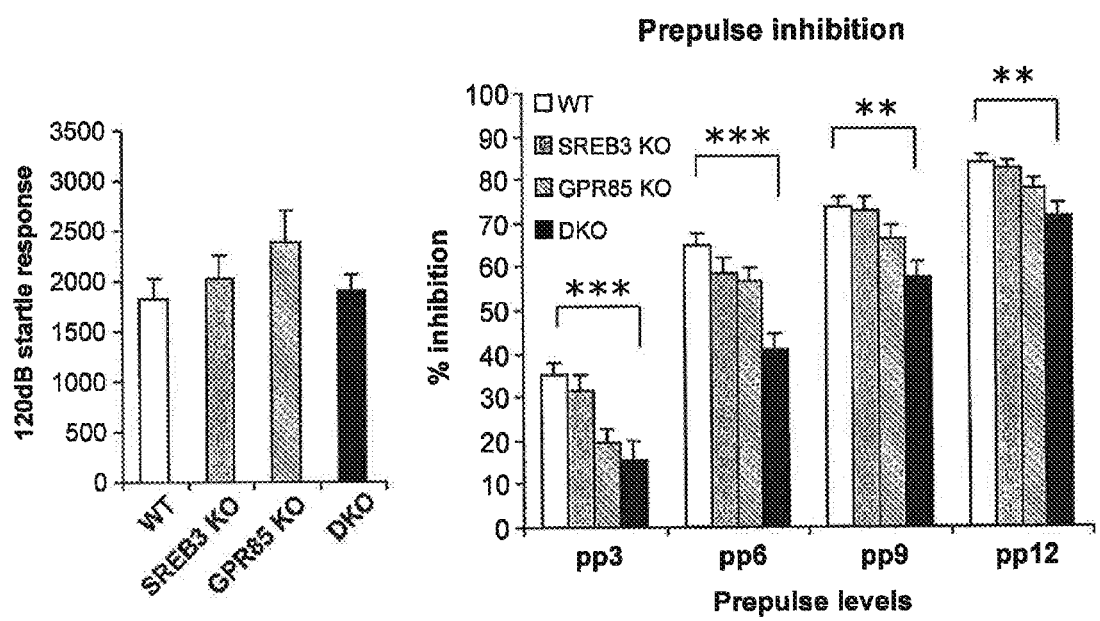
FIGS. 11A-11B are graphs demonstrating that DKO mice have reduced prepulse inhibition (PPI). The startle responses to 120 dB noise alone are not significantly altered in any of the KO strains (FIG. 11A). There is significant reduction of PPI (FIG. 11B) in DKO mice at all prepulse levels ($p<0.01$, *$p<0.001$, n=19-22 per group, Student's t-test). There is also a partial reduction of PPI in GPR85 KO but not SREB3 KO.

As shown in FIG. 11, GPR85/SREB3 DKO mice had reduced prepulse inhibition (PPI). The startle responses to 120 dB noise alone were not significantly altered in any of the KO strains (FIG. 11A). There was significant reduction of PPI (FIG. 11B) in DKO mice at all prepulse levels ($p<0.01$, *$p<0.001$, n=19-22 per group, Student's t-test). There was also a partial reduction of PPI in GPR85 KO but not SREB3 KO.

Figure 16A:
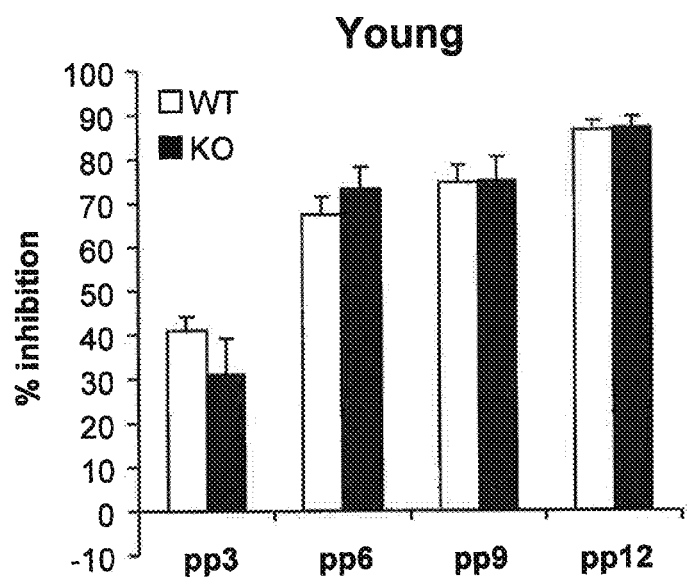
FIGS. 16A and 16B are graphs that demonstrate that older GPR85 KO mice also have reduced prepulse inhibition (PPI). The same animals are tested at young (3 months, FIG. 16A) and old (17 months, FIG. 16B) ages. There is a significant reduction of PPI in old GPR85 KO mice (*$p<0.05$, #$p=0.066$, n=6-9 per group, Student's t-test).
Figure 16B:
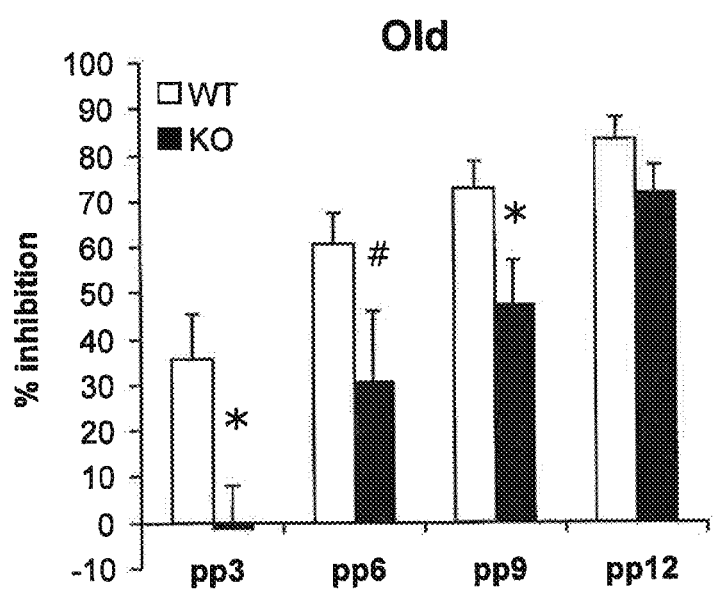

Old GPR85 KO mice also had reduced prepulse inhibition (PPI, FIG. 7). The same animals we tested at young (3 months, FIG. 16A) and old (16 months, FIG. 16B) ages. There was a significant reduction of PPI in old GPR85 KO mice (*$p<0.05$, #$p=0.066$, n=6-9 per group, Student's t-test).

Example 5

GPR85/SREB3 DKO Mice Exhibit Behavioral Disorders

Marble burying is a behavioral test that can demonstrate the anxiolytic-like effect of both known anxiolytics and antidepressants. It also models certain aspects of the obsessive compulsive disorder. This procedure was performed on GPR85/SREB3 DKO mice, as well as GPR85 KO, SREB3 KO and WT mice, as follows. Eighteen clean glass marbles of diameter 1.5 cm were evenly distributed on top of 5-cm deep cobb bedding in a large clean mouse cage. Each mouse was individually placed into the cage, and the cage was covered with a metal grid. The mouse was left in the cage for 30 min without food or water, and then transferred back into its home cage. The number of marbles at least two-thirds buried by the mouse was counted. Anxiolytic-like effect was reflected in the reduction of number of marbles buried.

Figure 12:
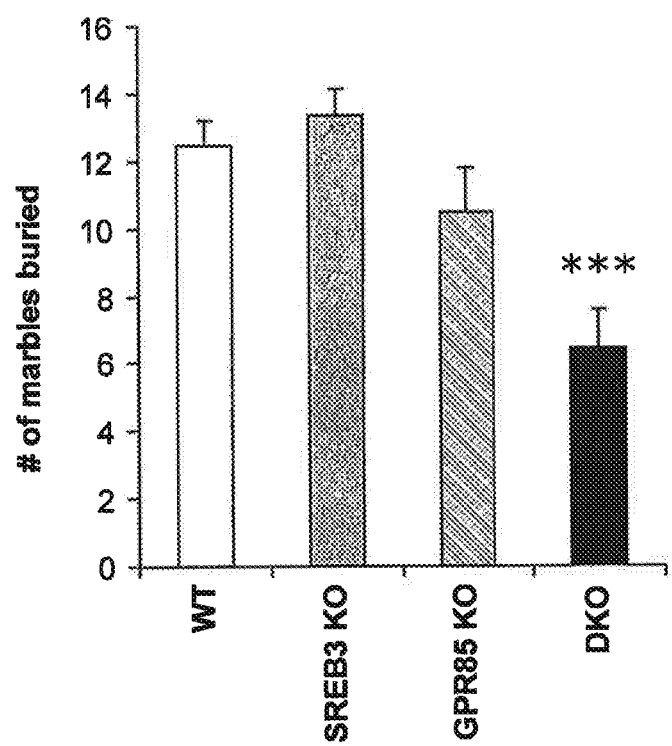
FIG. 12 is a graph demonstrating that DKO mice are less anxious or have less obsessive behavior in the marble burying test. There is a significant reduction of number of marbles buried by DKO mice (***$p<0.001$, n=19-22 per group, Student's t-test) but not GPR85 KO or SREB3 KO.

As depicted in FIG. 12, GPR85/SREB3 DKO mice are less anxious or have less compulsive behavior in the marble burying test. There was a significant reduction of number of marbles buried by DKO mice (***$p<0.001$, n=19-22 per group, Student's t-test) but not GPR85 KO or SREB3 KO.

Nest building is considered a form of instinct social behavior. Mice of both sexes build a nest when provided with suitable material and are typically found lying in it during the daytime. In the wild, the nest provides shelter, camouflage from predators, conservation of body heat, and is an important component of fitness. Parents and offspring share the nest and both parents retrieve pups into the nest. Mutant mice related to human conditions such as schizophrenia and autism spectrum disorder have shown deficits in nest building behavior.

Nest building activity of GPR85/SREB3 DKO and control mice were assessed as follows. Mice were singly housed. A piece of nestlet, a 5 cm×5 cm piece of pressed cotton, was introduced into the cage during early daytime. Afterwards, the quality of the nest built and the location of the mouse relative to the nest were recorded at 1, 2, 6 and 24 hours post insertion of nestlet. Nest quality was measured using the following scale: (0) nestlet unmodified; (1) nestlet minimally teared; (2) shallow nest with partially shredded nestlet; (3) nest relatively well developed; and (4) perfect nest with tall walls.

Figure 13:
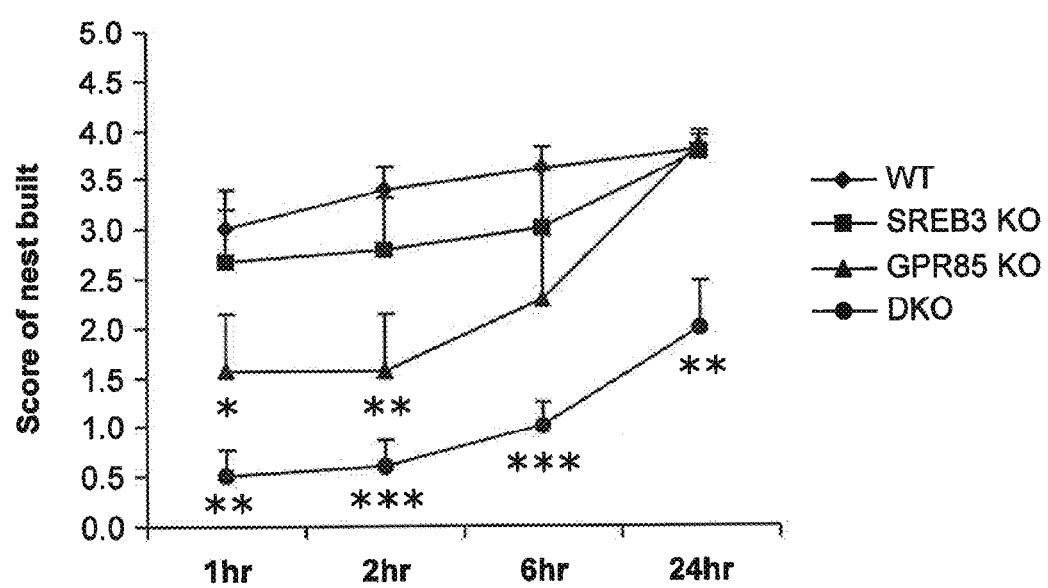
FIG. 13 is a graph showing that DKO mice are impaired in nest building. At all time points examined after a piece of nesting material is given, the DKO mice show significant impairment in building the nest ($p<0.01$, *$p<0.001$, n=7-10 per group, Mann-Whitney U test). GPR85 KO mice also show significant impairment at 1 h and 2 h time points (*$p<0.05$, **$p<0.01$), while SREB3 KO mice have no significant impairment.

As shown in FIG. 13, GPR85/SREB3 DKO mice were impaired in nest building. At all time points examined after a piece of nesting material was given, the DKO mice showed significant impairment in building the nest ($p<0.01$, *$p<0.001$, n=7-10 per group, Mann-Whitney U test). GPR85 KO mice also showed significant impairment at 1 h and 2 h time points (*$p<0.05$, **$p<0.01$), while SREB3 KO mice had no significant impairment.

Old GPR85 KO mice were also impaired in nest building (FIG. 15). When tested at 16-18 months of age, both male and female GPR85 KO mice showed significant impairment in building the nest at all time points examined (*$p<0.05$, $p<0.01$, *$p<0.001$, n=6-9 per group, Mann-Whitney U test).

Resident-intruder test is a test of male social behavior and was used to test GPR85/SREB3 DKO mice and controls. A singly housed male test mouse (resident) was introduced with a stranger mouse (intruder) of wildtype genotype. Their behaviors were videotaped and observed for 12 min. Wildtype resident mice exhibited normal social/aggressive behavior, consisting of investing the intruder mouse by sniffing and other contacts followed by aggressive behavior towards the intruder such as biting and attacking.

As shown in FIG. 14, GPR85/SREB3 DKO mice had reduced aggressive behavior in the resident-intruder test. Only WT and DKO, but not GPR85 KO or SREB3 KO, were tested. The total numbers of all social interactive behavior exhibited by the WT or DKO resident mice, including sniffing, tail chasing and attacking, did not differ significantly by genotype (left panel). There was a significant reduction of aggressive behavior, i.e., attacking the intruder mice, in the DKO mice (**$p<0.01$, n=16DKO, 21WT, Student's t-test).

Example 6

GPR85 KO AND GPR85/SREB3 DKO Mice Exhibit Altered Metabolic Characteristics A variety of physiological and metabolic characteristics were analyzed in GPR85 KO and GPR85/SREB3 DKO mice, including body weight and food intake.

Growth curves were generated by measuring the animal's weight and length every one or two weeks. Both male and female GPR85 KO mice had lower body weight and length than WT, with more significant genotype difference in female mice. P values at 70 weeks were: female weight $p<0.0001$ (FIG. 17A), male weight $p=0.12$ (FIG. 17B), female length $p<0.0001$ (FIG. 17C), male length $p<0.05$ (FIG. 17D) (n=8-10 per group, Student's t-test).

Figures 18A, 18B:
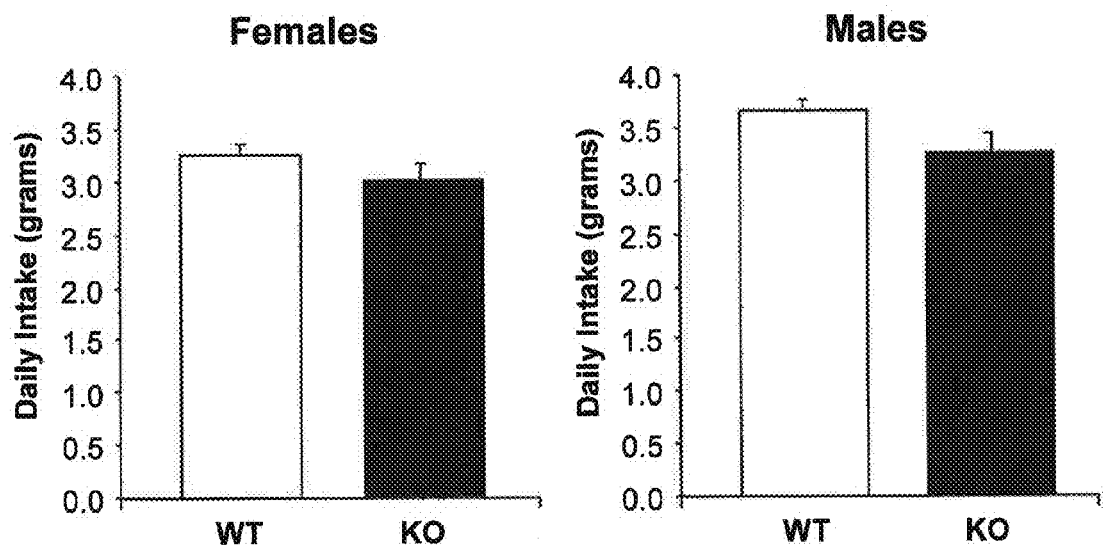
FIGS. 18A and 18B are graphs demonstrating that GPR85 KO mice have normal baseline food intake. There is no significant difference in the amount of daily food intake between genotypes in either male (FIG. 18B) or female (FIG. 18A) mice (n=8-10 per group, Student's t-test).
Figure 19A:
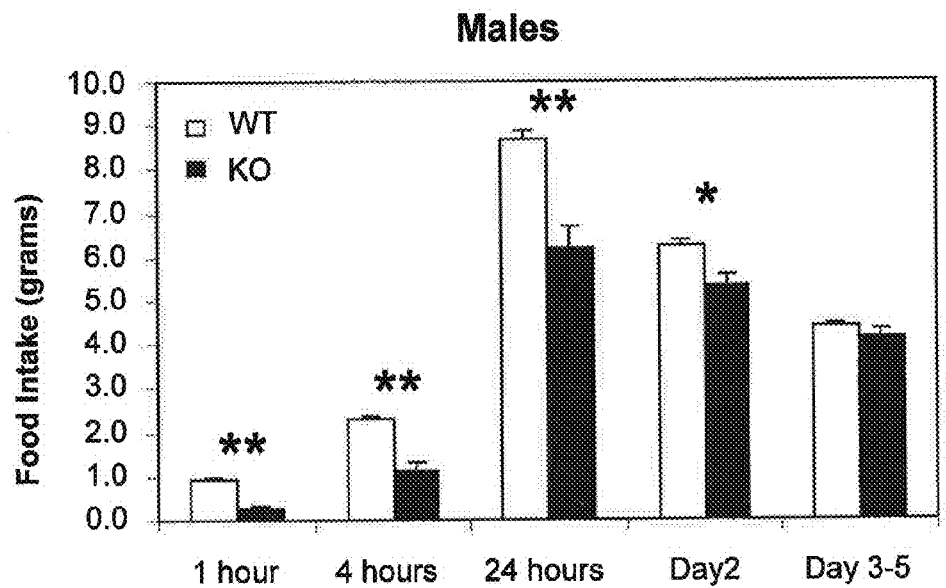
FIGS. 19A and 19B are graphs demonstrating that GPR85 KO mice eat less after a fasting challenge. Mice are subjected to a 24-hr fasting and then re-feeding. The amount of food eaten and the animal's body weight are measured at 1 h, 4 h and 24 h after re-feeding. Daily food intake is also measured for Days 2-5. Both male (FIG. 19A) and female (FIG. 19B) KO mice have significantly less cumulative food intake during re-feeding than WT mice (*p<0.05, **p<0.01, n=8-10 per group, Student's t-test).
Figure 19B:
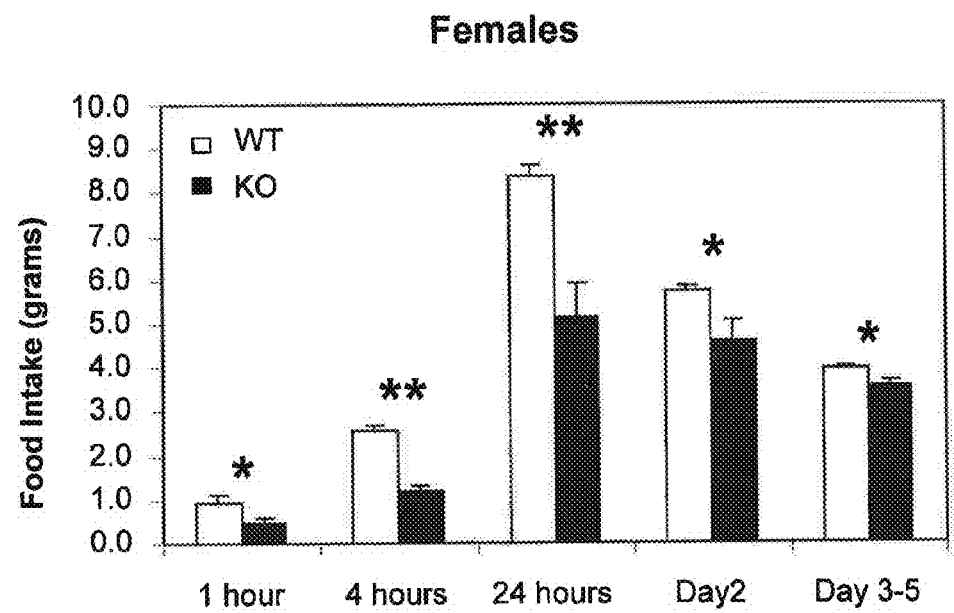

GPR85 KO mice had normal baseline food intake. There was no significant difference in the amount of daily food intake between genotypes in either male (FIG. 18A) or female (FIG. 18B) mice (n=8-10 per group, Student's t-test). However, GPR85 KO mice ate less after a fasting challenge. Mice were subjected to a 24-hr fasting and then re-feeding. The amount of food eaten and the animal's body weight was measured at 1 h, 4 h and 24 h after re-feeding. Daily food intake was also measured for Days 2-5. Both male (FIG. 19A) and female (FIG. 19B) KO mice had significantly less cumulative food intake during re-feeding than WT mice (*$p<0.05$, **$p<0.01$, n=8-10 per group, Student's t-test).

Figures 20A, 20B:
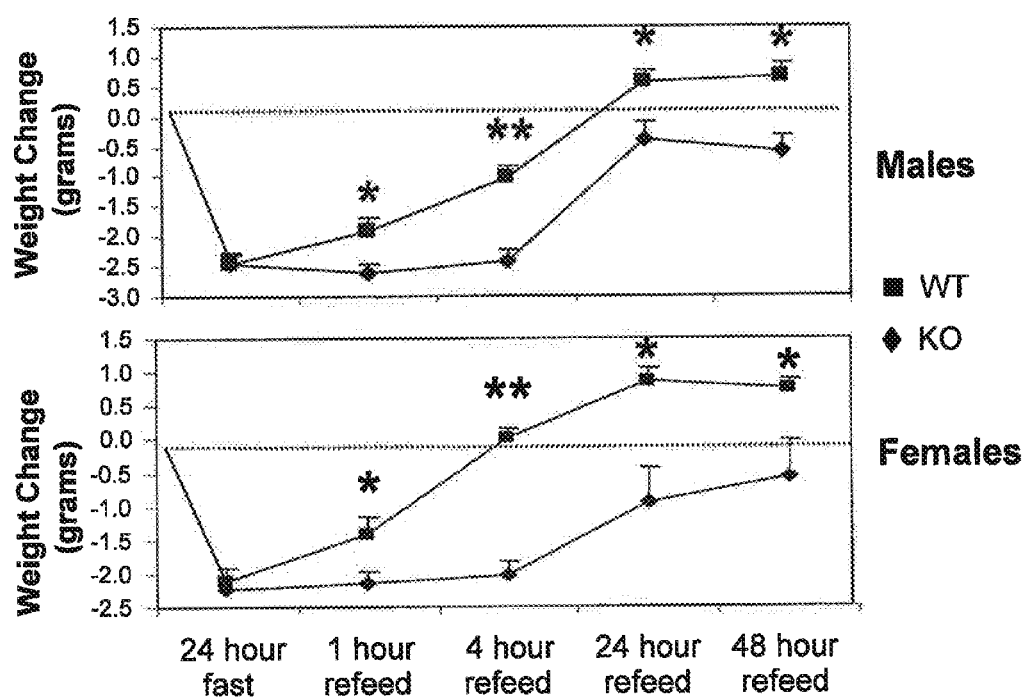
FIGS. 20A and 20B are graphs showing that GPR85 KO mice are slow to recover body weight after a fasting challenge. Body weight changes are monitored in the same experiment as in FIGS. 19A and 19B. Both male and female KO mice lost the same amount of weight as the WT mice after the fasting (FIGS. 20A and 20B, respectively). However, during re-feeding, both male and female KO mice are significantly slower in regaining their body weight than WT mice (*p<0.05, **p<0.01, n=8-10 per group, Student's t-test).

GPR85 KO mice were slow to recover body weight after a fasting challenge. Body weight changes were monitored in the same experiment described above. Both male and female KO mice lost the same amount of weight as the WT mice after the fasting (FIGS. 20A and 20B, respectively). However, during re-feeding, both male and female KO mice were significantly slower in regaining their body weight than WT mice (*$p<0.05$, **$p<0.01$, n=8-10 per group, Student's t-test).

Figure 21:
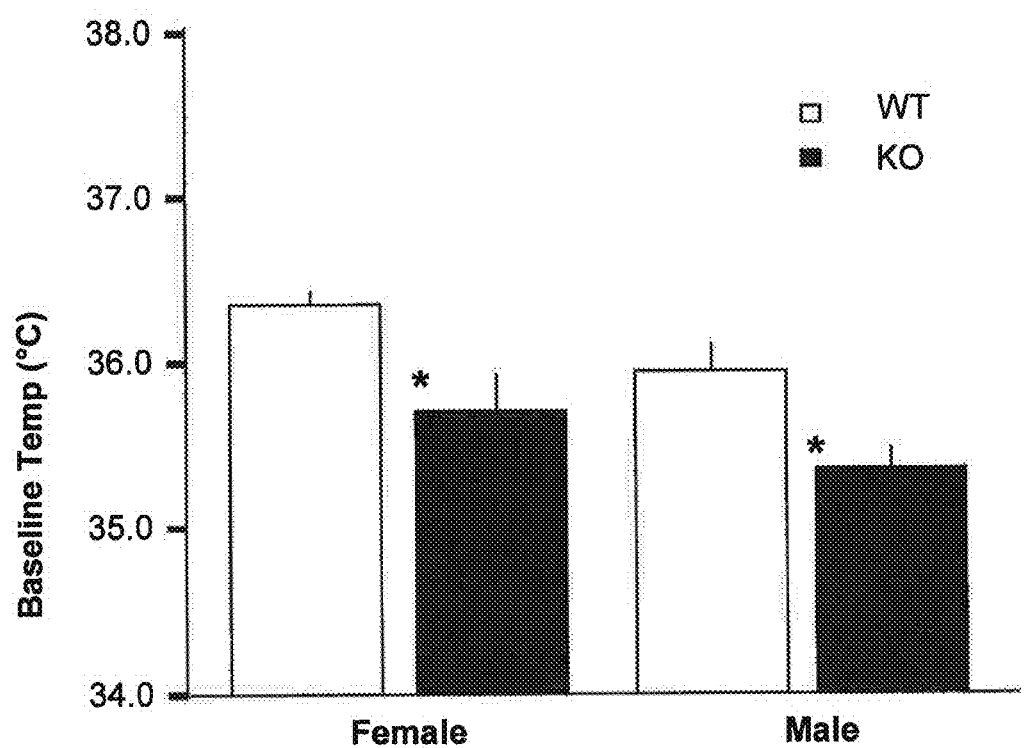
FIG. 21 is a graph showing that GPR85 KO mice have lower baseline body temperature. Baseline body temperature is measured by a rectal probe on singly housed, resting mice. Both male and female KO mice have significantly lower body temperature than WT mice (p<0.05, n=9-11 per group, Student's t-test).

GPR85 KO mice had lower baseline body temperatures. Baseline body temperatures were measured by a rectal probe on singly housed, resting mice. Both male and female KO mice had significantly lower body temperature than WT mice ($p<0.05$, n=9-11 per group, Student's t-test), as shown in FIG. 21.

Female GPR85 KO mice had lower percentage of white fat. DEXA analysis showed that KO mice had significantly lower total fat mass than WT mice ($p<0.05$, n=10 per group, Student's t-test, FIG. 22A). Mice were then dissected, and abdominal white fat and brown fat were weighed. KO mice had a significantly lower amount of white fat ($p<0.01$, FIG. 22B) but a normal amount of brown fat (FIG. 22C). The percentage of white fat versus the whole body weight was also significantly lower in KO mice ($p<0.01$) by ~33% (FIG. 22D).

Figure 23:
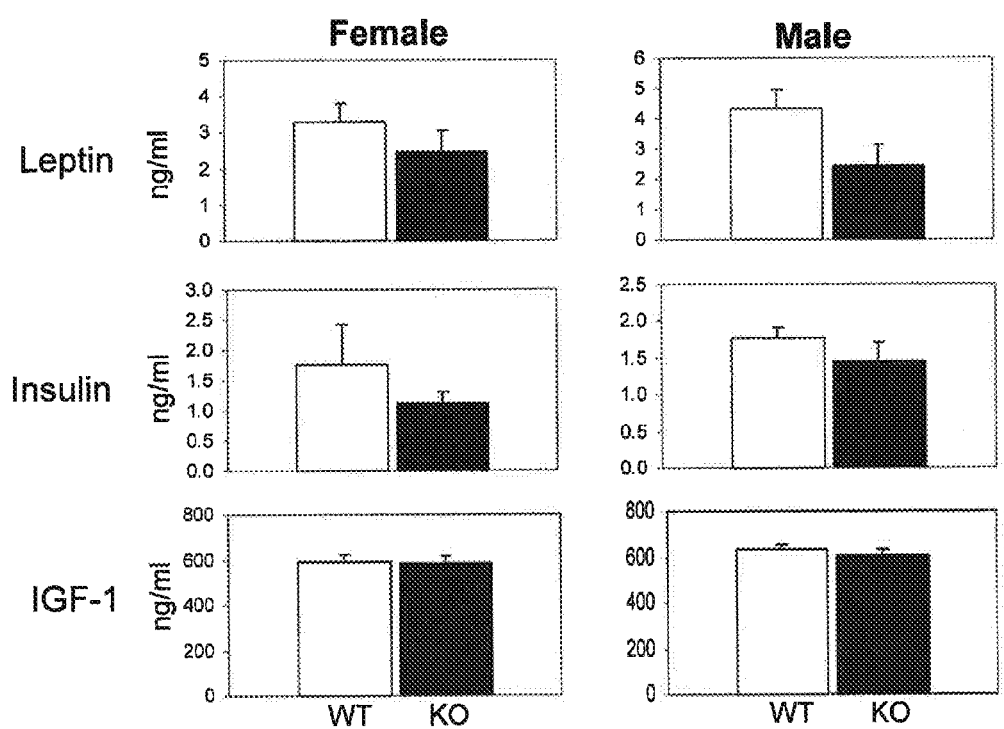
FIG. 23 provides graphs showing that GPR85 KO mice have slightly reduced leptin and insulin levels. There is a trend of reduction of baseline plasma leptin and insulin levels in both male and female KO mice (n=7-10 per group, top four panels), but these differences are not statistically significant. There is no difference in IGF-1 level between genotypes (bottom two panels).

GPR85 KO mice have slightly reduced leptin and insulin levels. Blood was collected via tail clip or retro-orbital eye bleeding, and centrifuged in microtainer tubes (Becton-Dickinson, Franklin Lakes, N.J.) for plasma separation. Plasma was assayed for cholesterol, T4, triglyceride, and glucose using a Prochem V biochemistry analyzer (Drew Scientific, Oxford, Conn.). Leptin, insulin and glucagon were measured by Linco Diagnostics (St. Charles, Mo.) using a Lincoplex luminex assay. There was a trend of reduction of baseline plasma leptin and insulin levels in both male and female KO mice (n=7-10 per group, FIG. 23). There was no difference in IGF-1 level between genotypes.

Old male GPR85 KO mice had improved glucose tolerance. Old (16 months) male KO mice had significantly lower fed and fasting glucose levels compared to WT mice (FIGS. 24A and 24B, *$p<0.05$, **$p<0.01$, n=7-10 per group, Student's t-test). These mice were given an insulin challenge or a glucose challenge. In the insulin challenge test (FIG. 24C), mice were fasted for 4 hours and then injected with 0.75 U/kg insulin via i.p., and blood glucose levels were measured at different time points afterwards. KO mice had significantly lower glucose levels and were slower in recovery (*$p<0.05$, **$p<0.01$). In the glucose challenge test (FIG. 24D), mice were injected with 2 g/kg glucose via i.p., and blood glucose levels were measured at different time points afterwards. KO mice were faster in clearing glucose than WT at 1 hr post injection ($p<0.05$).

Figures 25A, 25B:
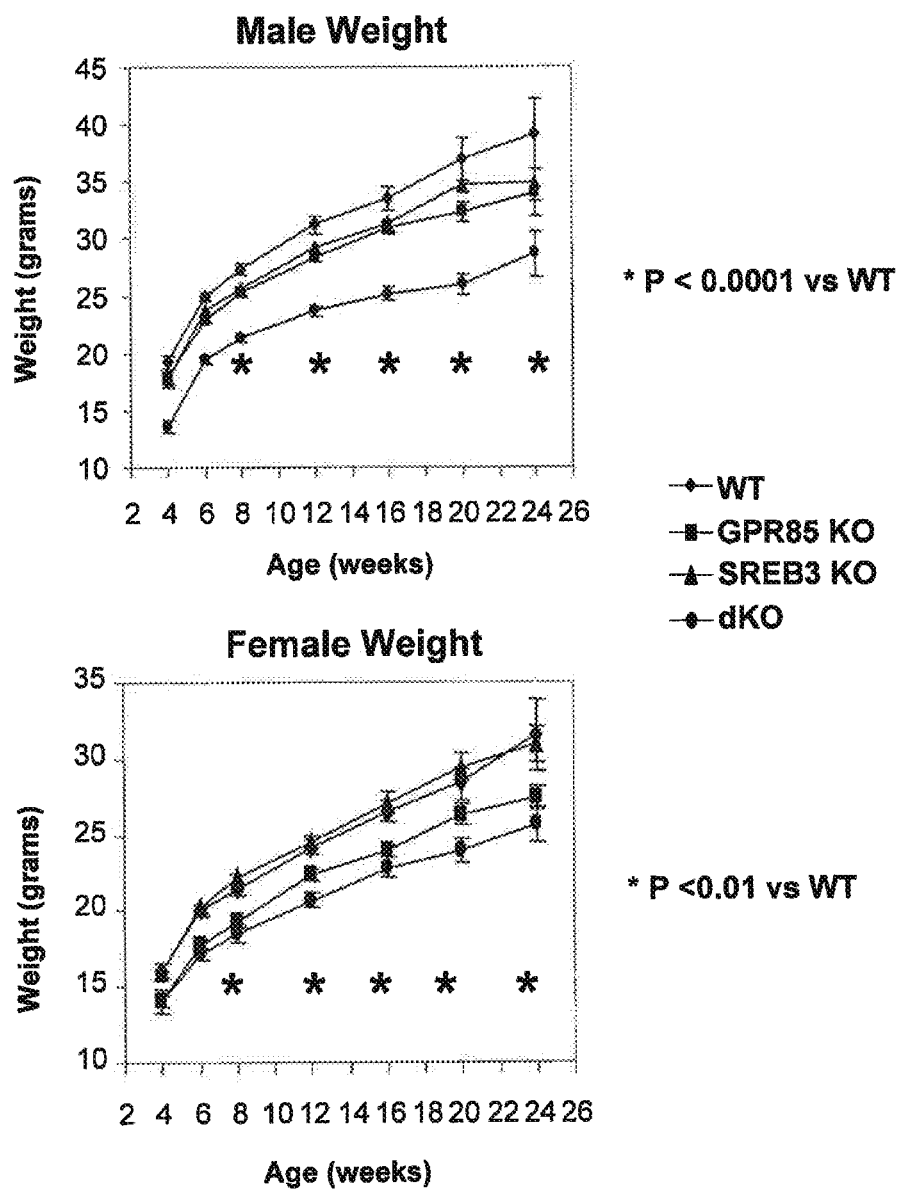
FIGS. 25A and 25B are graphs showing that DKO mice have greatly reduced body weight and body length. Growth curves are generated by measuring the animal's weight and length every two or four weeks. Both male and female DKO mice have significantly lower body weight and length than WT, with more significant genotype difference in male mice (n=8-10 per group, Student's t-test). Male DKO mice weigh 27% less than WT (p<0.0001, FIG. 25A). Female DKO mice weigh 18% less than WT (p<0.01, FIG. 25B).

GPR85/SREB3 DKO mice had greatly reduced body weight and body length. Growth curves were generated by measuring the animal's weight and length every two or four weeks. Both male and female DKO mice had significantly lower body weight and length than WT, with more significant genotype difference in male mice (n=8-10 per group, Student's t-test). Male DKO mice weighed 27% less than WT ($p<0.0001$, FIG. 25A). Female DKO mice weighed 18% less than WT ($p<0.01$, FIG. 25B).

Figure 26:
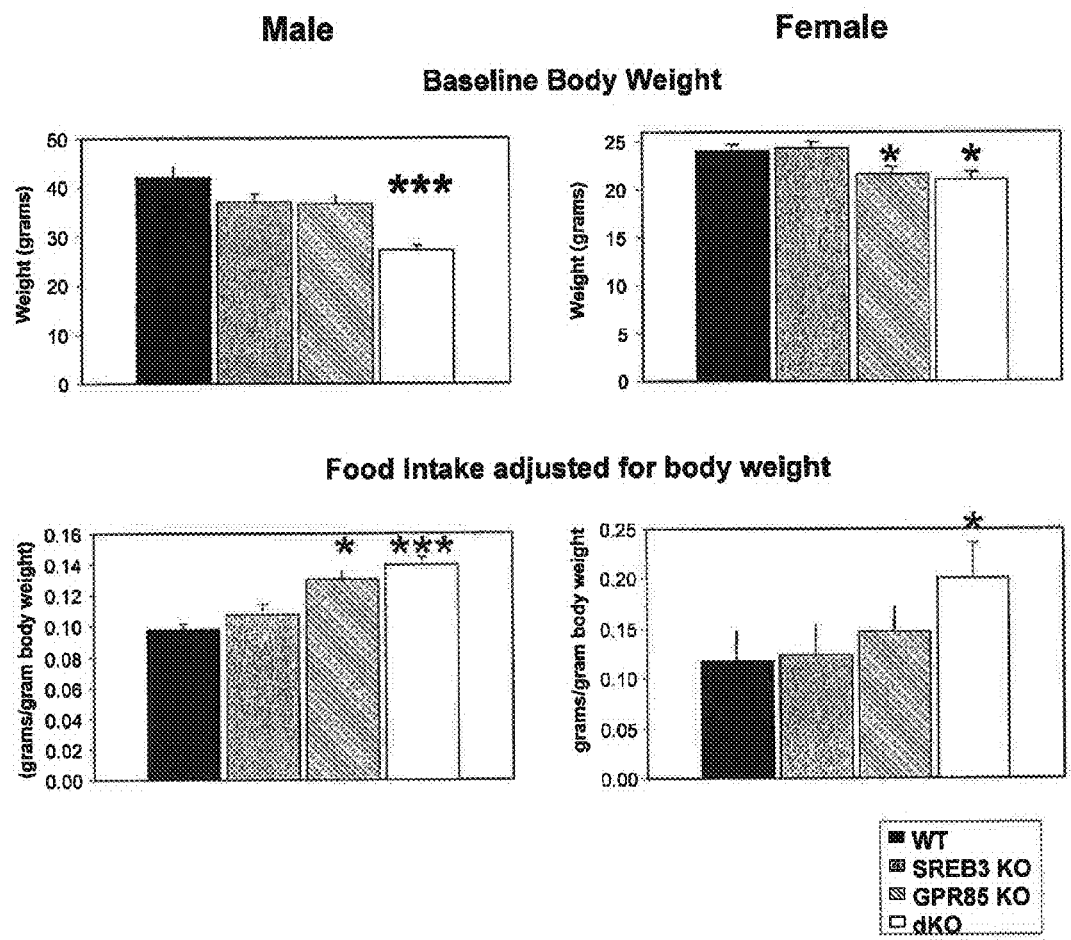
FIG. 26 provides graphs showing that DKO mice eat more food per gram body weight. Both male and female DKO mice have lower baseline body weight than WT (upper panels, *p<0.05, ***p<0.001, Student's t-test, n=6-10 per group, ages 3-5 months). When normalized to their body weights, both male and female DKO mice eat more food per gram body weight (lower panels, *p<0.05, ***p<0.001).

GPR85/SREB3 DKO mice eat more food per gram body weight. Both male and female DKO mice had lower baseline body weight than WT (FIG. 26, *$p<0.05$, ***$p<0.001$, Student's t-test, n=6-10 per group, ages 3-5 months). When normalized to their body weights, both male and female DKO mice ate more food per gram body weight (lower panels, *$p<0.05$, ***$p<0.001$).

These results suggest that SREBs play important roles in metabolism and that targeting SREBs may be therapeutically useful in the treatment of a variety of metabolic diseases and disorders, including obesity and diabetes.

Example 7

GPR88 Knockout Mice Reduced Motor Coordination

Neurological characteristics of GPR88 knockout (KO) mice were measured using a variety of tests. Rotarod is one of the most commonly used tests of motor coordination. The rotarod used (Rotamex-5, from Columbus Instruments, Columbus, Ohio) had 4 channels to test 4 mice simultaneously. The rotating rod was 3 cm in diameter. Its rotating speed could be programmed in fixed or accelerating mode.

GPR88 knockout mice were generated using methods described in U.S. Pat. No. 6,228,639 and tested using the roratod. An accelerating program was used, with start speed set at 1 rpm, end ppm, and acceleration rate at 1 rpm per 3 sec. Each mouse was placed on top of the rod and the program was started. The mouse had to keep walking and adjusting its pace in order to stay on the rod. The trial terminated when the mouse fell off from the rod or started to cling to the rod and rotated along with it. Infrared beam sensors were located above the rotating rod to detect animals on top of the rod, and thus are used to record the latency for the mouse to fall off or start to rotate. Each mouse was tested in 4 trials a day, with an inter-trial interval of at least 1 min, for 4-5 days.

Figure 27:
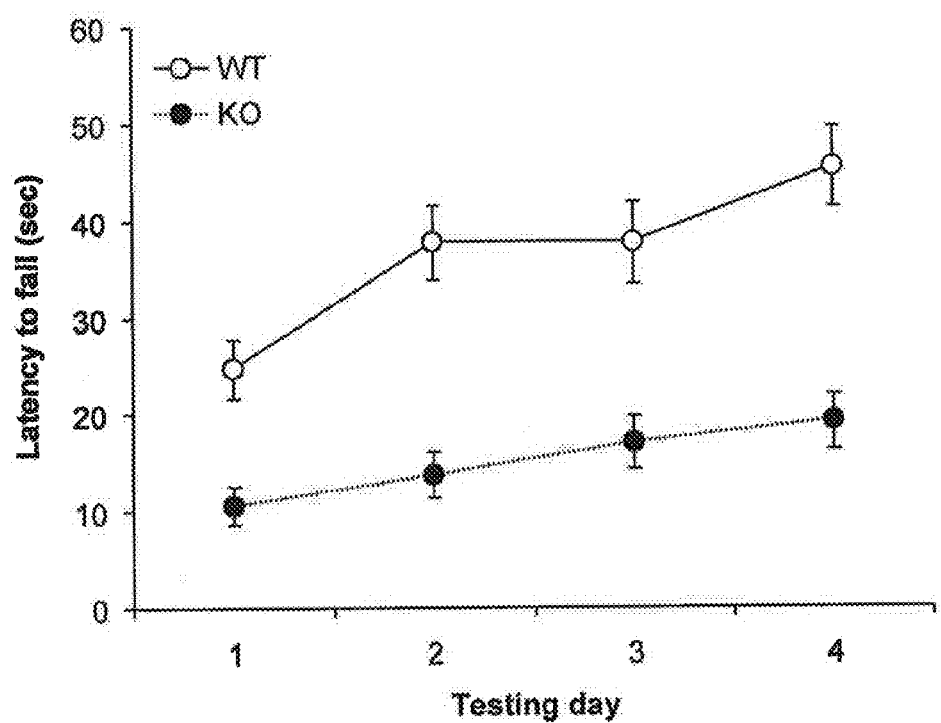
FIG. 27 is a graph demonstrating that GPR88 knock-out (KO) mice are impaired in motor coordination as assessed by the rotarod test. Each mouse was tested for 4 trials per day, and the latency to fall from the rotating rod with accelerating rotating speed was averaged across the 4 trials. The KO mice (n=16) had significantly shorter latency compared to wild type (WT) mice (n=18) in each of the four testing days (p<0.01 for day 1, p<0.001 for days 2-4, Student's t-test).

As shown in FIG. 27, GPR88 KO mice were impaired in motor coordination as assessed by the rotarod test. The KO mice (n=16) had significantly shorter latency compared to wild type (WT) mice (n=18) in each of the 4 testing days ($p<0.01$ for day 1, $p<0.001$ for days 2-4, Student's t-test). These results indicate that GPR88 is involved in motor coordination.

Example 8

GPR88 Knockout Mice are Hyperactive in the Open Field

Open field activity of GPR88 knock-out mice was examined to determine if loss of GPR88 is associated with neurological defects. This assay provides data on the general activity level of mice (i.e., hypo- or hyper-active), and indication of anxiety towards the aversive properties of the novel, open environment.

Open field activity was monitored in VersaMax chambers (Accuscan Instruments, Columbus, Ohio) measuring 40×40 cm. Locomotor activity was detected by photobeams breaks as the animal crossed each beam. The animal was placed in the center of the field and then left undisturbed for a period of time (20 min to 2 hr) in order to measure its spontaneous activity in a novel environment. Measurements used to assess locomotor activity included: horizontal activity, total distance traveled, vertical activity (rearing events—animal raises up on hindlimbs), rotation, stereotypy, and distance traveled in the center compared to total distance traveled (center: total distance ratio).

As shown in FIG. 28, compared to WT mice (n=18), the KO mice (n=18) had increased horizontal activity ($p<0.05$, repeated measures ANOVA, FIG. 28A), total distance traveled in the chamber ($p<0.05$, FIG. 28B), vertical/rearing activity ($p<0.001$, FIG. 28C) and stereotypy behavior ($p<0.05$, FIG. 28D). These results suggest that GPR88 in involved in neuropsychiatric functions and/or motor control.

Example 9

GPR88 Knockout Mice are Hypersensitive to Amphetamine-Induced Activity

Psychostimulants, including indirect dopamine agonist amphetamine, induce psychosis-like conditions manifested as hyperactivity and increased stereotypic behavior. The role of GPR88 in modulating these conditions was investigated using GPR88 knockout mice.

Amphetamine-induced hyperactivity of GPR88 knockout mice was measured by injecting the animals with amphetamine and monitoring the animals' activity levels. GPR88 KO mice were injected with amphetamine (2.5 mg/kg) via i.p. The mice were placed in the activity chambers 30 minutes after amphetamine injection, and their locomotor activities were monitored for 20 min.

Figure 29:
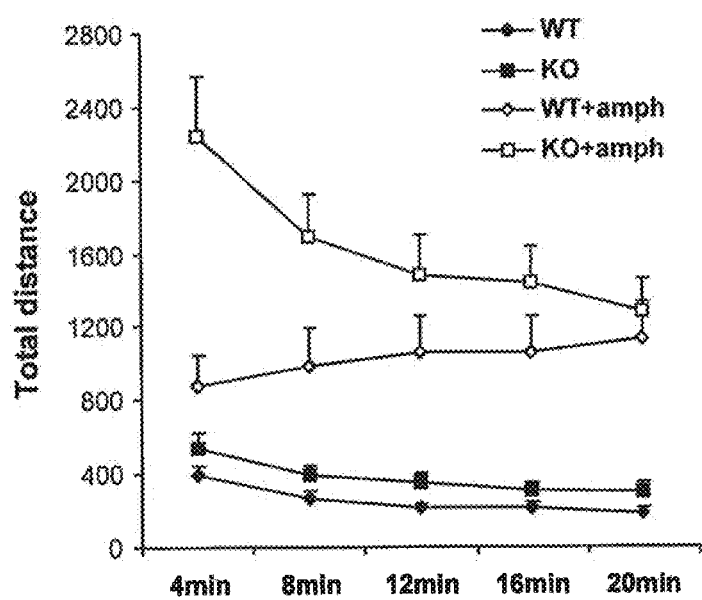
FIG. 29 is a graph demonstrating that GPR88 KO mice are hypersensitive to amphetamine-induced hyperactivity. Mice were injected with amphetamine (2.5 mg/kg) via i.p. The mice were placed in the activity chambers 30 minutes after amphetamine injection, and their locomotor activities were monitored for 20 min. Compared to baseline locomotor activity in the absence of drugs, both WT and KO mice had significantly higher activity after amphetamine administration (p<0.001 respectively). However, the activity level of KO mice (n=18) was much higher than that of the WT mice (n=18) (p<0.001 for the first 4-min block, p<0.05 for the second 4-min block, p<0.05 during the whole 20-min period). There was a strong genotype×treatment interaction for the first 4-min block (F(3,68)=10.5, p<0.01, two-way ANOVA).

As shown in FIG. 29, compared to baseline locomotor activity in the absence of drugs, both WT and KO mice had significantly higher activity after amphetamine administration ($p<0.001$ respectively). However, the activity level of KO mice (n=18) was much higher than that of the WT mice (n=18) ($p<0.001$ for the first 4-min block, $p<0.05$ for the second 4-min block, $p<0.05$ during the whole 20-min period).

There was a strong genotype×treatment interaction for the first 4-min block ($F(3,68)=10.5$, $p<0.01$, two-way ANOVA). These results strongly suggest that GPR88 modulates hyperactivity.

Example 10

GPR88 Knockout Mice are Sensitive to Amphetamine-Induced Reduction of Prepulse Inhibition (PPI)

Prepulse inhibition (PPI) of the acoustic startle response evaluates the brain's sensorimotor gating function that is often disrupted in schizophrenic and other psychotic conditions. Psychostimulants such as PCP and amphetamine reduce or disrupt PPI, and many antipsychotics increase PPI and/or reverse psychostimulant-induced reduction of PPI. In addition, the startle response to the loud noise itself (in the absense of any prepulse) is a measure of the basic sensorimotor reflex.

Preppulse inhibitor testing of GPR88 knockout mice was performed using the SR-Lab System (San Diego Instruments, San Diego, Calif.). A test session consisted of six trial types under the background noise of 70 dB. One type used a 40 msec, 120 dB noise as the startle stimulus. Four types contained acoustic startle stimulus preceded by acoustic prepulses of different intensity: the 20-msec prepulse noise of 73, 76, 79, or 82 dB was presented 100 msec before the 120 dB startle stimulus. The last trial type used the 70 dB background noise with no startle stimulus to measure baseline reaction. Six blocks of the six trial types were presented in pseudorandom order. The startle response was recorded for 65 ms starting with the onset of the startle stimulus. Measurements used to assess PPI were the maximum startle amplitude and the percent each of the 4 prepulses inhibited the startle response.

As shown in FIG. 30, GPR88 KO mice tended to be more sensitive to amphetamine-induced reduction of prepulse inhibition (PPI). GPR88 KO (n=20) and WT (n=21) mice in the inbred 129sv background were tested for baseline PPI, and there was no significant difference between genotypes ($p>0.3$, repeated measures ANOVA). Several weeks later, the mice were injected with amphetamine (2.5 mg/kg) via i.p. and tested for PPI 30 minutes later. The startle responses to the 120 dB stimulus of both WT and KO were significantly decreased after amphetamine treatment, and there was no significant difference between genotypes ($p>0.5$, FIG. 30A). There was significant reduction of PPI in both WT and KO after amphetamine treatment ($p<0.001$ for both, FIG. 30B). There was a trend of more reduction of PPI in KO than WT ($p=0.091$, repeated measures ANOVA).

Example 11

GPR22 KO Mice are Hypoactive and Anxious in the Open Field

Open field activity of GPR22 knock-out mice was examined to determine if loss of GPR22 is associated with neurological defects. This assay provides data on the general activity level of mice (i.e., hypo- or hyper-active), and indication of anxiety towards the aversive properties of the novel, open environment.

GPR22 knock-out 9KO) mice were generated using methods described in U.S. Pat. No. 6,228,639. Open field activity was monitored in VersaMax chambers (Accuscan Instruments, Columbus, Ohio) measuring 40×40 cm. Locomotor activity was detected by photobeams breaks as the animal crossed each beam. Mice were placed in the center of the field and then left undisturbed for a period of time (20 min to 2 hr) in order to measure their spontaneous activity in a novel environment. Measurements used to assess locomotor activity included: horizontal activity, total distance traveled, vertical activity (rearing events—animal raises up on hind limbs), rotation, and stereotypy. Measurements related to anxiety included time spent in the center arena of the chamber and distance traveled in the center compared to total distance traveled (center:total distance ratio). Data was plotted in 4-min bins.

As shown in FIG. 31, GPR22 KO mice were hypoactive and more anxious in the open field activity test. Compared to wild type (WT) mice (n=23), the KO mice (n=27) traveled less distance during the testing period ($p<0.05$, repeated measures ANOVA), and spent less time in the center arena of the chamber ($p<0.05$, Student's t-test). These results indicate that GPR22 is involved in anxiety disorders, panic attacks, PTSD, stress disorders, and mood regulation.

Example 12

GPR22 KO Mice have Increased Anxiety

A light-dark box was used to determine whether GPR22 knock-out mice were more prone to anxiety. The light-dark box measures the conflict between the natural tendencies of mice to explore a novel environment but to avoid the aversive properties of a brightly lit (anxiety-provoking) open field. It has two compartments. The brightly-lit compartment (27 cm×20 cm×30 cm) comprises two-thirds of the surface area, while the dark compartment (18 cm×20 cm×30 cm) comprises one-third of the surface area. An opening is designed to allow the mouse access to both compartments.

GPR22 knockout mice were placed individually into a light-dark box for 6 min. The timing of each transition from the dark to light or light to dark compartments, defined as all four limbs of the animal crossing the boundary, was recorded during the period using The Observer Mobile with a Psion Workabout (Noldus Information Technology, Netherlands).

Figure 32:
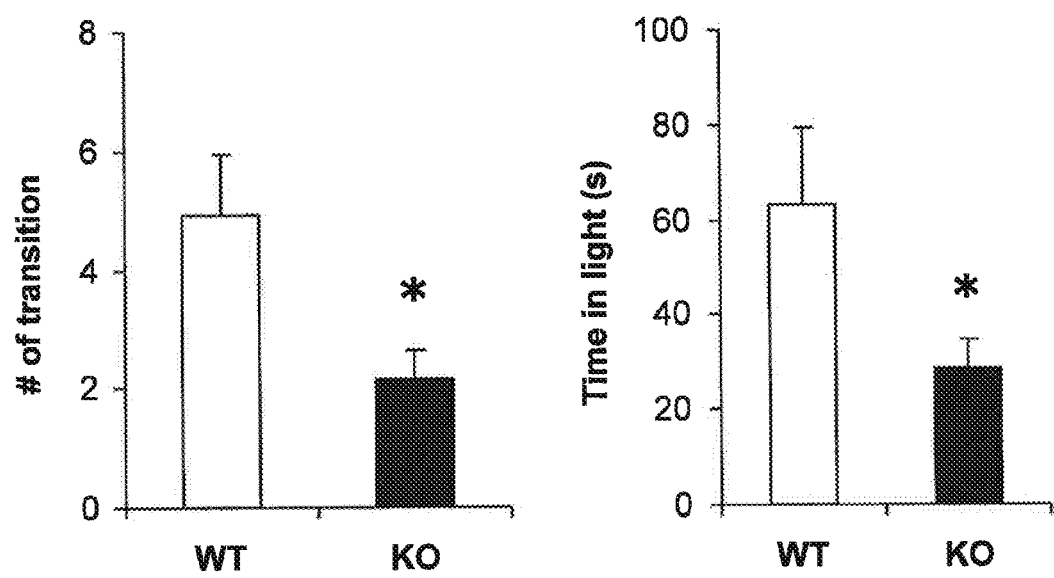
FIG. 32 is a graph demonstrating that GPR22 KO mice are more anxious than WT controls in the light-dark box test. In this test, less number of transitions between the light and dark compartments and more time spent in the dark compartment are two indicators for increased anxiety in animals. Compared to WT mice (n=21), the KO mice (n=26) had less number of transitions between the light and dark compartments (p<0.05, Student's t-test), and spent less time in the light compartment (p<0.05).

As shown in FIG. 32, GPR22 KO mice were more anxious in the light-dark box test. In this test, less number of transitions between the light and dark compartments and more time spent in the dark compartment were two indicators of increased anxiety in animals. Compared to WT mice (n=21), the KO mice (n=26) had a lower number of transitions between the light and dark compartments ($p<0.05$, Student's t-test), and spent less time in the light compartment ($p<0.05$). These results indicate that reduced GPR22 activity is associated with anxiety.

Example 13

GPR22 KO Mice are Hyperactive at Night

Activity of GPR22 knockout mice was determined by measuring their home cage activity. This data provides insight into the animal's circadian patterns of sleep-wake cycles.

Home cage activity of GPR22 knockout mice was monitored in MicroMax chambers (Accuscan Instruments, Columbus, Ohio) that were exterior to the cages. The photobeams provided information of when an animal was moving around in its home cage. Animals singly housed in their home cages were placed in the photobeam boxes for three to seven days and activity was recorded continually. Measurements used to assess home cage activity included: horizontal activity, total distance traveled, rotation, and periods of rest time and active time (onset, offset and duration). Data was plotted in 1-hr bins.

Figure 33:
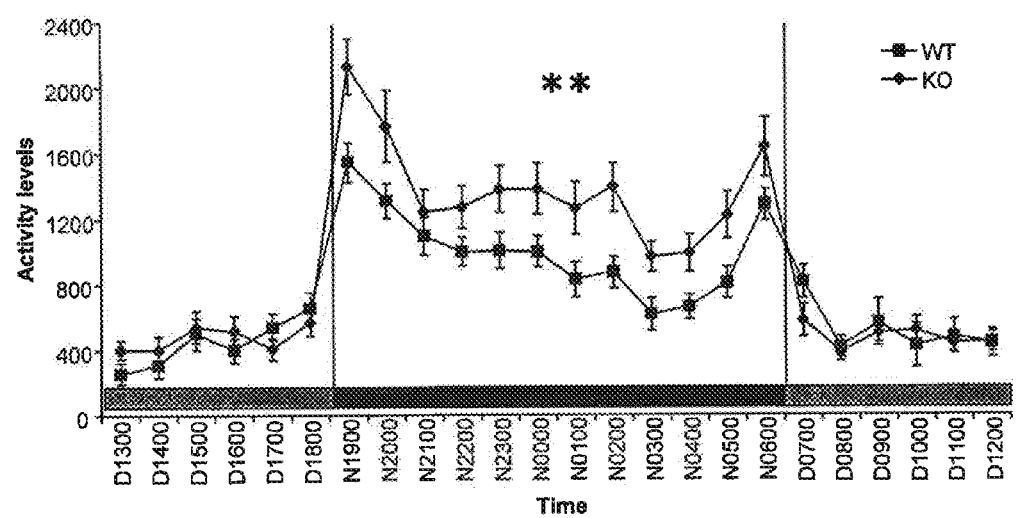
FIG. 33 is a graph demonstrating that GPR22 KO mice are hyperactive at night in their home cages. Data plotted are in 1-hr bins. Compared to WT mice (n=23), the KO mice (n=23) had significantly higher locomotor activity levels during the night time (p<0.01, repeated measures ANOVA). During the daytime, locomotor activity levels were not significantly different between genotypes.

GPR22 KO mice were hyperactive at night in their home cages (FIG. 33). Compared to WT mice (n=23), the KO mice (n=23) had significantly higher locomotor activity levels during the night time (p<0.01, repeated measures ANOVA). During the daytime, locomotor activity levels were not significantly different between genotypes. These results suggest that GPR22 is involved with basal nighttime activity, which may impact circadian rhythms and sleep patterns.

All of the above U.S. patents, U.S. patent application publications, U.S. patent applications, foreign patents, foreign patent applications and non-patent publications referred to in this specification and/or listed in the Application Data Sheet, are incorporated herein by reference, in their entirety.

From the foregoing it will be appreciated that, although specific embodiments of the invention have been described herein for purposes of illustration, various modifications may be made without deviating from the spirit and scope of the invention. Accordingly, the invention is not limited except as by the appended claims.

SEQUENCE LISTING (1735 sequences)

SEQ ID NO: 1 - protein, 560 aa, Homo sapiens
MDLKTVLSLPRYPGEFLHPVVYACTAVMLLCLLASFVTYIVHQSAIRISRKGRHTLLNFCFHAALTFTVFAGGINRTKYPILCQAVGIVLHYSTLSTMLWIGVTARNIYKQVTKKAPLCLDTDQPPYPRQPLLRFYLVSGGVPFIICGVTAATNIRNYGTEDEDTAYCWMAWEPSLGAFYGPAAIITLVTCVYFLGTYVQLRRHPGRRYELRTQPEEQRRLATPEGGRGIRPGTPPAHDAPGASVLQNEHSFQAQLRAAAFTLFLFTATWAFGALAVSQGHFLDMVFSCLYGAFCVTLGLFVLIHHCAKREDVWQCWWACCPPRKDAHPALDANGAALGRAACLHSPGLGQPRGFAHPPGPCKMTNLQAAQGHASCLSPATPCCAKMHCEPLTADEAHVHLQEEGAFGHDPHLHGCLQGRTKPPYFSRHPAEEPEYAYHIPSSLDGSPRSSRTDSPPSSLDGPAGTHTLACCTQGDPFPMVTQPEGSDGSPALYSCPTQPGREAALGPGHLEMLRRTQSLPFGGPSQNGLPKGKLLEGLPFGTDGTGNIRTGPWKNETTV

SEQ ID NO: 2 - DNA, 2131 bp, Homo sapiens
agccccgcaatctgttgataactcggtcccagctcggccgctgccctcgcgaatggagagcgggtccccggcggggggagcgcagcgcgtctgtctccgggagcgcggcccggccgccccggcagccgcttcggccacagcagatgggagcagctcccggactgcgcccgccccgccgcggtcaccctgaggccaggggcccgggagcgcgacctcctggccgccgtctgggactttgaccttccagaggccatggaggctggcggggagcagggcgccacctgatcgcctccccctggacgcctcctccagcggcgctcacgcttccgcaactttgcagcgctcatggatctgaagacagtgctctccctgccccgctacccaggggagttcctgcaccccgtggtgtacgcgtgcacggccgtcatgctgctctgcctcctggcctccttcgtcacctacatcgtgcaccagagcgccatccgcatcagccgcaagggccggcacacgctcctgaatttctgcttccacgcggccctgaccttcactgtgttcgccggcggcatcaatcgcaccaagtaccccatcctgtgccaggcggtgggcatcgtgctgcactattctacactgtccaccatgctgtggataggagtgaccgccaggaacatctacaagcaggtgaccaagaaggcccctctgtgcctggacacagaccagccaccgtaccccaggcagcccctgctcaggttttacctcgtcagcggaggggtcccctttatcatctgtggggtcacggctgccacgaacatcaggaattacgggacagaggacgaggacacggcgtactgctggatggcctgggagcccagcctgggcgccttctacggcccagccgccatcatcaccctggtcacctgtgtgtacttcctgggcacctacgtgcagctgcggcgccacccagggcgcaggtacgagctgcgcacacagcccgaggagcagcggcggctggcgacacccgagggcggccgtgggatccggccaggcaccccacccgcacacgatgcccccggcgcctccgtgctgcagaacgagcactcattccaggcacagctgcgcgccgccgccttcacgctgttcctgttcacggccacgtgggccttcggggcgctggcggtgtcacagggccacttcctggacatggtcttcagctgcctgtacggcgccttctgcgtgaccctgggactcttcgtgctcatccaccactgcgccaagcgtgaggacgtgtggcagtgctggtgggcatgctgcccgccccgcaaggacgcccaccccgcacttgacgccaacggggccgcgctgggccgcgccgcctgcctgcactcgccgggactgggccagccacggggcttcgcgcacccaccgggcccctgcaagatgaccaacctgcaggccgcgcagggccacgccagttgcctgtcaccggccaccccgtgctgcgccaagatgcactgcgagccactgacggcggacgaggcgcacgtgcacctgcaggaggagggcgccttcgggcacgacccccacctgcacgggtgccttcagggcagaactaagccgccctactttagccggcacccagcagaggagcccgagtacgcctaccacatcccatccagcctggatggcagcccccgcagctcgcgcacagacagcccccccagctctctggatggcccggcggggacacacacgctggcctgctgcacccagggcgaccccttccccatggtcacccagcccgagggcagtgatgggagccctgccctctacagctgccccacgcagccgggcagggaggcagcgctcgggcccggccacttggagatgctgcggaggacacagtccctgccctttggtggccccagccagaacgggctgcccaagggtaaattgctagaaggcctgccgtttggcaccgacgggaccggcaacatccgaacgggaccctggaaaaacgaaactactgtgtagatgggggcagaggacacggtgttcctggaggagcttcagagcagagtggggggcccatctgccacatgaggtcactgggggtaccgaagtgaccccgcctttc

SEQ ID NO: 3 - protein, 578 aa, Mus musculus
MTQWDLKTVLSLPQYPGEFLHPVVYACTAVMLLCLLASVITYILHQSAIRISRKGRHALLNFCFHAALTFTVFAGGINRTQHPILCQAVGIALHYSTLSTMLWIGVTARNIYKQVTKKALPCPGADQPPYPKQPLLRFYLISGGVPFIICGVTAATNIRNYGTEDEDVAYCWMAWEPSLGAFYGPAAFIALVTCVYFLCTYVQLRRHPERRYELRERTEEQQRLAVPESGHRHGVRPGTPPTCDALAASQLQNEHSFKAQLRAAAFTLFLFTATWTFGALAVSQGHFLDMIFSCLYGAFCVTLGLFVLIHHCAKREDVWQCWWSCCPSRGDTSTTKPGAHPTLDANGDALGHTACLQDSPCPGKLRGFGHPPASHCKMTNLQAAQGHVSCLSPATPCCAKMHCEQLMEEEAAHIHMAEEDVYPHDPHLHDPHLHRCLKGRTKSHYFSRHQAAAAEREYAYHIPSSLDGSPHSSRSESPTSSLEGPMGMHTLACCAQADPFPMVSQPEGGDTSPGLYGCPPHLSPGPAHLEMLRRTQSLPFGGPSQNGLLQGDVREGLPFGTDGTGNIRTGPWKNETTV

SEQ ID NO: 4 - DNA, 2049 bp, Mus musculus
ccatggaaggctgatcgattgataagatccagttatcactgaaaagacaggcaaggagatgcatcaggctctactgaaaccagtcttggttggcacagaaccaacaaagaaaaaaaaaatccagacccgagcagagcaagaagactgagcgagatgcacacggtgactcacactggtgagcgcaccacttgagaagctggggcagctacagactgagaccctgccacaaaacaaatggaaacgaaaccacagatggagacgaggaagactacccaggaaaactgagtcgagagaagaaccgaggctgaggagatgactcagtgggatttgaagactgtcctctccctgccccagtacccaggggagttcctgcatcctgtggtgtatgcctgcaccgcggtcatgctcctgtgtctccttgcctctgtcatcacctacatcttgcatcagagtgccatccggataagccggaaaggccggcacgcactcctcaacttctgcttccacgccgctctgaccttcaccgtgtttgctggtggcatcaatcgcacccaacaccccatcctgtgccaagcagtgggcattgctctgcactattccacgctttctaccatgctgtggatcggtgtgactgctaggaacatctacaaacaggtgaccaagaaggccctgccatgtcctggagcagaccagccaccgtaccctaagcagcccttgctcaggttctacctcatcagcggaggggtccctttcatcatctgtggggtcacagctgccacaaacatcagaaattatggcaccgaggatgaggacgtggcatactgctggatggcctgggaacccagcctgggtgcgttctatgggccggctgccttcattgccctggtcacctgcgtgtacttcctctgcacctacgtgcagctgcggcgtcacccggagcgcaggtatgagctcagagagcgcacggaggagcagcagcgactggctgtgccagagagcggccatcgccacggagtccgtcccgggaccccacccacctgtgatgccctggctgcctcgcagctgcagaacgagcattccttcaaggctcagcttcgtgccgctgccttcacactgttcctgttcacagctacatggacctttggggccctggctgtgtctcagggccacttcctggacatgatcttcagctgtctgtacggcgccttctgcgtgacactgggactctttgtacttatccatcactgcgccaagcgggaggacgtgtggcagtgctggtggtcctgctgcccttcccggggagacacctccaccaccaagcccggcgcccatcctacactcgatgccaacggggatgcgctggggcatacggcctgcctgcaggactcaccatgccctgggaaactcagaggttttggccatccaccagccagccactgcaagatgaccaacctgcaggctgcccagggccatgtcagctgtctgtcacctgccaccccgtgctgtgccaagatgcactgtgagcagttaatggaggaggaggcggcccacatccacatggctgaggaggacgtctacccacacgatccccacctgcatgaccctcacctgcacaggtgcctcaagggcagaactaagtcccactacttcagccggcaccaggcagctgcggctgagagggagtatgcttaccacatcccctccagcctggatggcagtccccacagttcacgttcggagagccccaccagctctctggagggcccaatggggatgcacacattggcctgctgtgcccaggctgaccccttccccatggtcagccagcctgagggtggagacacaagccctgggctctatggctgccccccacacctatccccaggccctgcccacttggagatgctacgaaggacacagtccctgccttttgggggccccagccagaatgggctgctccagggtgatgttcgagaaggcctgccatttggcactgatgggacagggaacatccgaacaggaccctggaaaaatgaaactacagtgtag

SEQ ID NO: 5 - protein, 731 aa, Homo sapiens
MSLFLSNLSTNDSSLWKENHNSTDLLNPPGTLNIYLFCLTCLMTFAALVGSIYSLISLLKMQNRTVVSMLVASWSVDDLMSVLSVTIFMFLQWPNEVPGYFQFLCTTSALMYLCQGLSSNLKATLLVSYNFYTMHRGVGSQTASRRSGQVLGVVLTVWAASLLLSALPLCGWGAFVRTPWGCLVDCSSSYVLFLSIVYALAFGLLVGLSVPLTHRLLCSEEPPRLHSNYQEISRGASIPGTPPTAGRVVSLSPEDAPGPSLRRSGGCSPSSDTVFGPGAPAAAGAEACRRENRGTLYGTRSFTVSVAQKRFALILALTKVVLWLPMMMHMVVQNVVGFQSLPLETFSFLLTLLATTVTPVFVLSKRWTHLPCGCIINCRQNAYAVASDGKKIKRKGFEFNLSFQKSYGIYKIAHEDYYDDDENSIFYHNLMNSECETTKDPQRDNRNIFNAIKVEISTTPSLDSSTQRGINKCTNTDITEAKQDSNNKKDAFSDKTGGDINYEETTFSEGPERRLSHEESQKPDLSDWEWCRSKSERTPRQRSGYALAIPLCAFQGTVSLHAPTGKTLSLSTYEVSAEGQKITPASKKIEVYRSKSVGHEPNSEDSSSTFVDTSVKIHLEVLEICDNEEALDTVSIISNISQSSTQVRSPSLRYSRKENRFVSCDLGETASYSLFLPTSNPDGDINISIPDTVEAHRQNSKRQHQERDGYQEEIQLLNKAYRKREEESKGS

SEQ ID NO: 6 - DNA, 2855 bp, Homo sapiens
tttttttttttatgcttgaaatggaacctaatttttaaatatagcttgagtcagatctaaaggagacatggctgaccattttctgcaggactgacaaggagaacatctagaggggaacttggtaggaggaatgaaatctgatttgcagcagccggtctttcttttgagaaaattatcagactcattgataagggaaattaaatattgaccaaggacaatgtctttatttctcagtaacttatcaacaaatgactctagcctgtggaaagagaatcataattctacggaccttttaaatccgccaggaaccctgaatatctatcttttttgcttgacatgtctcatgacttttgcagccttggtgggcagcatttattcactaatttccctgctgaaaatgcagaacagaactgttgtgtccatgcttgtggcttcctggtctgtggatgatctcatgagcgtcctgtcggtgaccatcttcatgtttttgcagtggccaaacgaggtccccggttacttccaatttctgtgcaccacctctgccttaatgtatttatgccagggcctctctagcaacttgaaggcgactctcctagtctcttacaacttttatacgatgcacagaggtgtggggagccagacagcctccagaagatcgggccaggtgctcggcgtggtgctgaccgtgtgggcagccagtctgctgctctcggcgctcccgctgtgcggctggggcgccttcgtgcgcacgccctggggctgcctggtggactgctccagctcctacgtactattcctctctatcgtgtacgctttggccttcggactcctcgtgggcctctcagtcccactcactcaccgattgctgtgttcggaggagccgccgagactccactccaactaccaggaaatttcccgtggagcttcaattcctgggacccctcctactgcggggagagtggtttccctgtccccagaggatgctccaggcccgagtctgcggcgctctgggggatgctctccgagctccgacaccgtgttcggaccgggtgcgcccgctgccgctggggctgaagcctgcaggcgtgagaaccgggggactctctatggcaccaggagcttcaccgtgagcgtagcgcagaagcgcttcgctttgatcctagcgcttacaaaagtcgtcctttggctgcccatgatgatgcacatggtggtccagaacgtcgtggggtttcagagccttcccttggagacattcagctttctacttaccctgctggccaccactgtaaccccagtgtttgtcttgtccaaacgctggacccacttgccctgtggctgcatcatcaactgcaggcagaacgcatatgcagtggcgtccgatgggaaaaaaatcaagagaaaaggctttgaattcaatctatcattccaaaaaagttatgggatttataaaatagcacatgaagattactatgatgatgatgaaaattccatattctatcacaacctgatgaactctgagtgtgaaactacaaaagaccctcagagagacaaccgtaacatcttcaatgctataaaagtagaaatcagcaccacgccctctctggacagctccacacaaagaggcatcaacaaatgcacaaatactgatattacagaagctaaacaggattccaacaacaaaaaggatgcgttttctgacaaaacaggaggtgatattaactatgaagaaactaccttttctgaagggccagaaagaagactgtctcatgaagagagtcagaaaccagatctttcagactgggagtggtgtaggagtaaatcagaaagaacccctcgtcagcgttccggttatgcccttgccattcccttgtgtgcattccaggggactgtgtctctccatgcacctacagggaaaaccctatctctttctacctatgaggtaagcgcagaagggcaaaaaataactccagcctctaagaaaatagaagtctatcgatccaaaagtgttggccatgaaccaaactcagaagattcttcatccacgtttgtggacaccagtgtgaaaatacacttggaggttcttgaaatttgtgataatgaagaggccttggacactgtgtcaatcattagtaacatcagtcagtcctccacacaagtcagatctccatccctacgttactccaggaaagaaaacagatttgtttcatgtgacctaggggaaacagcctcatactccctctttttgcccaccagtaatcctgatggtgatattaatatctccattccagacacagtagaagcacacaggcagaacagtaaaaggcagcatcaagagagggatggctaccaggaggaaatccagttgttaaataaagcttacagaaaaagagaggaagaaagcaagggtagttagtgggtatttggtctaacaggagcaagaatggatctgcaacgtcaactgtgaaactaacacctttgttatgagactgatttccttttatttgttggcttacattagttttactgatttaatagttaatttttttgtgggaacaactggaactagtgtaaacacttaagtgcatttgatgtgttacctaaagatcacacactgtggtaatgaaaagattttacttcttatctgacttctaaaaaatattttctaaatcaaatcttggcctagtttaccaatgtttttgcttgtcaacttcctagtaaacagaaaattgtataaactcagtgaatatactgttccatgcatatgtttctatatacaatgttggcctttactgcaaaggggaaaaaagaggaattctgggaatggaagaaatgtaacaaaaccccaaattatattt

SEQ ID NO: 7 - protein, 732 aa, Mus musculus
MSFFLSNLTNDSNLWKASHNSTETDLMNSPATLTLSLFCLICIMTLAALVGSIFSLVSLLTMQYRTVLSILVTSWSVDDLLSVLSVAIFMVLQWPKEAQGYFQSLCTTSALLYMCQGLSSNLKATLIVCYNFYTMNRTVESQSSSWRLGQVLGVTLTVWAVSLLLASLPLCGWGVFVRTPWGCLTDCSSPYVLLLFAVYASAFGLLAVLSVPLTHQLLCSEEPLRLHANYQEISRGASTPGTPAAAGRVLCLPPEDVEIPALRCTGGCSPSSDVVFAPGQPAASGAGAGRRENPGTPQGTNSFPLSLAQKRFSLILALTKVILWLPMMIHMVVKHVVGFQSLPVDMLSFLLSLLASSVTPVFVLSKRWAHLPCGCIINCQPDTYSVAFDGKKCKRKGFEFNLSFQQSYGLYKIPHADCYDDDENSISYHNPKNYECEATKEPWGDNRSVFNTITVEISTTPPLDSATLTGVHKCTNTDIPESKQAMKEEKGAFSVKTESDINYGETTSFEGPERRLSHEENQKPDLSDWEWCRSKSERTPRQRSGGGLAIPICAFQGTVSLQAPTGKTLSLSTYEVSAEGQKITPASKKIEVYRSKSVGHEPNSEESPSTFADTSVKIHLEVLEICDNDEALDTVSIISNISQSSTKVRSPSLRYSRKENRFVSCDLGETASYSLFLPTSDPDGDINISIPDTVEAHRQNSRRQHEERDGYQEEIQLLNKAYRKREAESKGD

SEQ ID NO: 8 - DNA, 2196 bp, Mus musculus
atgtctttctttctcagcaacttaacaaatgactctaacctgtggaaagcaagtcataattctacggagacggaccttatgaattcaccagcaactctgactctttctctcttttgcctgatctgtataatgactctcgcagctctggtgggcagcattttctcactggtttcgctgctgaccatgcaatacagaactgttttgtccatacttgtgacatcttggtctgtggatgatctcttgagcgtcttgtccgtggccatcttcatggttttacagtggccaaaagaggcacagggctacttccagtctctgtgcaccacctctgccctactgtatatgtgccagggcctctccagcaacttgaaggcgactctcatagtctgctacaacttttatacgatgaacaggacggtggagagtcagtcaagctcctggcgattaggacaggtacttggtgtgactttaaccgtttgggcagtcagcctgctgctggcttcgctcccgctctgtggctggggtgtcttcgtgcgcacgccttggggctgcctgaccgactgctccagcccatacgtgctgctcctcttcgcggtatacgcttccgctttcgggctcctggcggttctctctgtccctctcactcaccagctgctgtgttcggaggaaccgctgagactccatgccaactaccaggaaatttctcgtggcgcctctactcctgggacccctgctgctgcgggaagagtgctctgtctgccgccagaggatgttgagatccctgctctgcgatgcactgggggatgctccccgagctccgacgtggtgtttgccccgggtcagccggctgcctccggcgctggagccggcaggcgagagaatcccgggactccccagggcaccaacagcttccccttgagcttggcacagaagcgcttttctttgattctagcgctgacgaaagtcatcctttggctacccatgatgatccacatggtggtaaaacacgtggtggggtttcagagccttccggtcgatatgctcagctttctactaagcctgctggccagcagtgtaacaccagtgtttgtcttatccaaacgttgggcccacttgccttgtggctgcatcatcaactgccagccagacacctactccgttgccttcgatgggaaaaagtcgaagaggaaaggctttgaattcaatctatcattccaacaaagttatggactctataaaataccacatgcagattgctatgatgatgatgaaaattccatatcctatcacaacccaaagaattatgagtgtgaagctacaaaggagccttggggagacaaccgcagtgtcttcaataccatcacagtagaaatcagcaccacgccaccgctggacagcgccacactgacgggtgtccacaagtgtaccaatactgacatcccagaatccaaacaggccatgaaagaggaaaagggtgctttttctgttaaaacagaaagcgatattaactatggagaaaccacctcttttgaaggtccagagagacgactgtcccatgaggagaatcagaaaccagatctttcagactgggaatggtgcaggagtaagtctgaacgaacgcctcgccagcgttccggtggtgggctggctattcccatatgcgcgttccaggggactgtgtctctccaagcacctactgggaaaacgctctctctttctacttatgaggtcagcgcagaagggcaaaagataaccccagcctctaagaaaatagaagtctatcgatctaaaagtgttggccatgaaccgaactcagaggagtctccctccacgtttgcggacaccagtgtaaaaatacacttggaagttcttgaaatttgtgacaacgatgaggctctagacactgtgtcaattatcagcaacatcagccaatcctccacaaaagtcaggtctccttctctgcgctactcacggaaggaaaacagattcgtctcctgcgacttaggagaaactgcctcatactcgctctttttacccacaagtgatcctgatggtgatattaacatctctatccctgacacggtggaggcccacagacagaacagcaggcggcagcatgaagagagggatggctaccaggaagagatccagttgttaaacaaagcctacaggaaaagagaggcagaaagcaagggtgat

SEQ ID NO: 9 - protein, 434 aa, Homo sapiens
MEDLFSPSILPPAPNISVPILLGWGLNLTLGQGAPASGPPSRRVRLVFLGVILVVAVAGNTTVLCRLCGGGGPWAGPKRRKMDFLLVQLALADLYACGGTALSQLAWELLGEPRAATGDLACRFLQLLQASGRGASAHLVVLIALERRRAVRLPHGRPLPARALAALGWLLALLLALPPAFVVRGDSPSPLPPPPPPTSLQPGAPPAARAWPGERRCHGIFAPLPRWHLQVYAFYEAVAGFVAPVTVLGVACGHLLSVWWRHRPQAPAAAAPWSASPGRAPAPSALPRAKVQSLKMSLLLALLFVGCELPYFAARLAAAWSSGPAGDWEGEGLSAALRVVAMANSALNPFVYLFFQAGDCRLRRQLRKRLGSLCCAPQGGAEDEEGPRGHQALYRQRWPHPHYHHARREPLDEGGLRPPPPRPRPLPCSCESAF

SEQ ID NO: 10 - DNA, 1705 bp, Homo sapiens
gacaaatcacgaggacaatcgacaaaaacaactaagcgcaaagccgcccgaatccatctccctctctgtgcgtgtgccttttcaactaactttgggaactcgtatagacccagcgtcgctccccgcgccgcctcgcctccactttggtttcccgcgtcctgcccgccctcttcggtgcctcctcttcctccgggacaaggatggaggatctctttagcccctcaattctgccgccggcgcccaacatttccgtgcccatcttgctgggctggggtctcaacctgaccttggggcaaggagcccctgcctctgggccgcccagccgccgcgtccgcctggtgttcctgggggtcatcctggtggtggcggtggcaggcaacaccacagtgctgtgccgcctgtgcggcggcggcgggccctgggcgggccccaagcgtcgcaagatggacttcctgctggtgcagctggccctggcggacctgtacgcgtgcgggggcacggcgctgtcacagctggcctgggaactgctgggcgagccccgcgcggccacgggggacctggcgtgccgcttcctgcagctgctgcaggcatccgggcggggcgcctcggcccacctcgtggtgctcatcgccctcgagcgccggcgcgcggtgcgtcttccgcacggccggccgctgcccgcgcgtgccctcgccgccctgggctggctgctggcactgctgctggcgctgcccccggccttcgtggtgcgcggggactccccctcgccgctgccgccgccgccgccgccaacgtccctgcagccaggcgcgcccccggccgcccgcgcctggccgggggagcgtcgctgccacgggatcttcgcgcccctgccgcgctggcacctgcaggtctacgcgttctacgaggccgtcgcgggcttcgtcgcgcctgttacggtcctgggcgtcgcttgcggccacctactctccgtctggtggcggcaccggccgcaggcccccgcggctgcagcgccctggtcggcgagcccaggtcgagcccctgcgcccagcgcgctgccccgcgccaaggtgcagagcctgaagatgagcctgctgctggcgctgctgttcgtgggctgcgagctgccctactttgccgcccggctggcggccgcgtggtcgtccgggcccgcgggagactgggagggagagggcctgtcggcggcgctgcgcgtggtggcgatggccaacagcgctctcaatcccttcgtctacctcttcttccaggcgggcgactgccggctccggcgacagctgcggaagcggctgggctctctgtgctgcgcgccgcagggaggcgcggaggacgaggaggggccccggggccaccaggcgctctaccgccaacgctggccccaccctcattatcaccatgctcggcgggaaccgctggacgagggcggcttgcgcccaccccctccgcgccccagacccctgccttgctcctgcgaaagtgccttctaggtgcttggtggtcagagacgggtcatctgtcgctaaggcgcaacctccagggaactcgaggcctgccagggtctgtccagatcacaaggggcaggagagtctgtgagagagtgacactgaagttgtccccttcctccactctcctattcccttctcatgtttacatttccctatgctcttccagtttctcttcttcccta

SEQ ID NO: 11 - protein, 427 aa, Mus musculus
MEDPFSLAILNPASNLSVPTQPSWSLNLTSEQGASVPGPHSPPRGPPSHRIHLVFLGIILVAAVAGNTTVLCRLCGGSSGPWPGPKRRKMDFLLVQLAAADLYASGGTALSQLAWELLGDPRPALGDLACRLSHLLQASGRGASAHLVALIALERQLAVRIPQGPQLPARALAALSWLLALLLALPPTFVVRWDAPPSSTANAWPGKHCCRGIFAPLPRWHLQVYALYEAIVGFAAPVALLGFSCGHLLCVWWQRGSQAPVARMPWSPSMARASLPSALPQAKVQSLKMSLALALLFVGCDLPYFAARLAAAWSSKPAGDWERESLVAAMRVLEVANSAINPLIYLFFQAGDCRLWRRLRRRLGVLCCVREEEADISEWAGDHQALHRHRWPHPHYHHARREERNQGCLRPPPPRPRPPPCSCESAF

SEQ ID NO: 12 - DNA, 1284 bp, Mus musculus
atggaagatcctttcagcctcgcaattctgaatcccgcatccaacctttctgtacccactcagccaagctggagtctcaacctgacttctgagcaaggagcctctgtcccaggaccgcattcgcctccacgcgggccacccagccaccggatccatctggtcttcttggggatcatcctggtggccgcggtagctggcaacaccactgtgctctgccgcctgtgcggcggtagcagcggaccctggccgggtcccaagcgtcgcaagatggacttcctgcttgtgcagctagcagcggctgacctgtacgcaagtggaggaacagcattgtcgcagctggcttgggagctgctgggcgacccgagaccggctctgggcgacttggcttgtcgcctttcccatctgctgcaggcatcggggcggggcgcctccgcccacctggtggcgctcattgccttggagcgccagctcgcggtgcgcattcctcagggccctcagttgccagcacgtgccctggctgccctgagctggctgctggctctgctactggcgctgcctccgaccttcgtggtgcgctgggatgctcctccatcttcaaccgccaatgcctggccagggaagcattgctgcaggggcatcttcgcgcccctgccgcgctggcacctgcaggtctacgcgctctatgaagctatcgtgggcttcgcggcgccggtcgctctcttaggcttctcttgcggccacctgctgtgtgtctggtggcagcgtgggtctcaggctccggtggctaggatgccctggtcgcccagtatggccagagcctccttgcccagcgcgttgccccaagccaaggtgcaaagcttgaaaatgagcctggcgctggcactgctcttcgtgggctgcgacctgccctacttcgccgctcgcttggcagccgcctggtcatcgaagcccgcgggtgactgggagagagagagcctggtggcggcgatgcgcgtcctagaggtggccaacagcgccatcaaccctttgatctaccttttcttccaggcgggcgactgccgtctctggcggaggctgcggaggcgcctaggagttctgtgctgcgtgcgggaggaagaagccgatatcagcgaatgggctggggaccaccaggcactccaccgccatcgctggccccaccctcattatcaccatgcccggcgggaggagcggaaccagggctgcctgcgcccacccccgccacgccccagaccgccgccctgctcctgtgaaagtgccttctag

SEQ ID NO: 13 - protein, 315 aa, Homo sapiens
LFFLVGILSTFGNGYVLYMSSRRKKKLRPAEIMTINLAVCDLGISVVGKPFTIISCFCHRWVFGWIGCRWYGWAGFFFGCGSLITMTAVSLDRYLKICYLSYGVWLKRKHAYICLAAIWAYASFWTTMPLVGLGDYVPEPFGTSCTLDWWLAQASVGGQVFILNILFFCLLLPTAVIVFSYVKIIAKVKSSSKEVAHFDSRIHSSHVLEMKLTKVAMLICAGFLIAWIPYAVVSVWSAFGRPDSIPIQLSVVPTLLAKSAAMYNPIIYQVIDYKFACCQTGGLKATKKKSLEGFRLHTVTTVRKSSAVLEIHEEV

SEQ ID NO: 14 - DNA, 1028 bp, Homo sapiens
ttatttttccttgtagggattctgtccacatttggaaatggatatgtcctttacatgtcttctagacgaaagaagaagctgagacccgctgaaataatgactatcaatttagcagtctgtgatctggggatttcagttgtaggcaagccgttcaccatcatctcttgcttttgtcaccgctgggtgtttggctggatcggctgccgctggtatggatgggctggatttttctttggctgtggaagccttatcaccatgactgctgtcagcctggatcgatatttgaaaatctgctatttatcttatggggtttggctgaaaagaaagcacgcctacatctgcctggcagccatctgggcctatgcttccttctggaccaccatgcccttggtaggtctgggggactacgtacctgagcccttcggaacctcgtgcaccctggactggtggctggcccaggcctcggtagggggccaggttttcatcctgaacatcctcttcttctgcctcttgctcccaacggctgtgatcgtgttctcctacgtaaagatcattgccaaggttaagtcctcttccaaagaagtagctcatttcgacagtcggatccatagcagccatgtgctggaaatgaaactgacaaaggtagcgatgttgatttgtgctggattcctgattgcctggattccttatgcagtggtgtctgtgtggtcagcttttggaaggccagactccattcccatacagctctctgtggtgccaaccctacttgcaaaatctgcagcgatgtacaatcccatcatttaccaagttattgattacaaatttgcctgttgccaaactggtggtttgaaagcaaccaagaagaagtctctggaaggcttcaggctgcacaccgtaaccacagtcaggaagtcttctgctgtgctggaaattcatgaagaggtatgaagatggatacagcatcactatggacactcgtattcacttatttgcctcttcactgctgtaaacatttgattgtggccaca

SEQ ID NO: 15 - protein, 339 aa, Mus musculus
LFFFVGILSTFGNGYVLYMSSRRKKKLRPAEIMTINLAVCDLGISVVGKPFTIISCFCHRWVFGWFGCRWYGWAGFFFGCGSLITMTAVSLDRYLKICYLSYGVWLKRKHAYICLAVIWAYASFWTTMPLVGLGDYAPEPFGTSCTLDWWLAQASGGGQVFILSILFFCLLLPTAVIVFSYAKIIAKVKSSSKEVAHFDSRIHSSHVLEVKLTKVAMLICAGFLIAWIPYAVVSVWSAFGRPDSIPIQLSVVPTLLAKSAAMYNPIIYQVIDYRFACCQAGGLRGTKKKSLEDFRLHTVTAVRKSSAVLEIHPESSSRFTSAHVMDGESHSNDGDCGKK

SEQ ID NO: 16 - DNA, 1379 bp, Mus musculus
ttattcttctttgtagggattctctctacatttggaaatgggtatgtcctttatatgtcttctagacgcaagaagaagctgagacctgcggaaataatgactatcaatttagcagtctgtgatctggggatatcagttgtaggcaagccgttcaccatcatctcttgcttctgccaccgctgggtgtttggctggtttggctgccgctggtatggctgggctggatttttctttggctgtggaagcctgattaccatgactgctgtcagcctggaccgctatctgaagatctgttatctgtcttatggggtctggctgaagagaaagcatgcctacatctgcctggcagtcatctgggcttatgcttccttctggaccaccatgcccttggtgggcctgggggactatgcacctgagcccttcggaacctcatgcaccctggactggtggctggcccaggcttcaggtgggggtcaggtgttcatcctgagcatcctcttcttctgcctcctgctgccaacggctgtgattgttttctcatatgctaagatcatcgccaaggtgaagtcttcttctaaagaggtagcccatttcgacagtcgaatccatagcagccatgtacttgaggtgaagctgaccaaggtggcaatgctgatttgtgctggtttcctgattgcctggattccttatgcggtcgtctctgtgtggtcagcttttggaaggccagactccatccccatacagctctccgtggtgcccacactccttgcaaaatcagcagcgatgtacaatccaatcatctaccaggtcattgattacagatttgcctgttgccaggctggtggtttgagaggaacgaagaagaaatctttggaagactttaggctgcatactgtaaccgcagtcaggaagtcttctgctgtgctggagatccatccagagagcagttccagatttactagtgcccatgttatggatggagagagtcacagtaatgatggtgactgtggcaagaaataagcacctgtgttctgaggccgagaaaccccgcacctgtccatcagggcttcagaaataagtggccagcttcaatatactctttgaaatgctgaaaaaaaaaagctgtagtgtattctttgcatttgtttttaagtttgagaaaacatatggtcagcgttgactgcagtgttgatattgaagtttaatcatgaatacatagcatgtgaagtgtccactctttaggctttataagacgattaaagtgttctaaggagaaagcacatcctaagcttgggaagtgcatcaccccttaagcttcctattcatcgtgatagtaatggagcttatcgatgcattcatgactgtgaacatgcctttga

SEQ ID NO: 17 - protein, 305 aa, Homo sapiens
MPGHNTSRNSSCDPIVTPHLISLYFIVLIGGLVGVISILFLLVKMNTRSVTTMAVINLVVVHSVFLLTVPFRLTYLIKKTWMFGLPFCKFVSAMLHIHMYLTFLFYVVILVTRYLIFFKCKDKVEFYRKLHAVAASAGMWTLVIVIVVPLVVSRYGIHEEYNEEHCFKFHKELAYTYVKIINYMIVIFVIAVAVILLVFQVFIIMLMVQKLRHSLLSHQEFWAQLKNLFFIGVILVCFLPYQFFRIYYLNVVTHSNACNSKVAFYNEIFLSVTAISCYDLLLFVFGGSHWFKQKIIGLWNCVLCR

SEQ ID NO: 18 - DNA, 918 bp, Homo sapiens
atgcctggccacaatacctccaggaattcctcttgcgatcctatagtgacaccccacttaatcagcctctacttcatagtgcttattggcgggctggtgggtgtcatttccattcttttcctcctggtgaaaatgaacacccggtcagtgaccaccatggcggtcattaacttggtggtggtccacagcgtttttctgctgacagtgccatttcgcttgacctacctcatcaagaagacttggatgtttgggctgcccttctgcaaatttgtgagtgccatgctgcacatccacatgtacctcacgttcctattctatgtggtgatcctggtcaccagatacctcatcttcttcaagtgcaaagacaaagtggaattctacagaaaactgcatgctgtggctgccagtgctggcatgtggacgctggtgattgtcattgtggtacccctggttgtctcccggtatggaatccatgaggaatacaatgaggagcactgttttaaatttcacaaagagcttgcttacacatatgtgaaaatcatcaactatatgatagtcatttttgtcatagccgttgctgtgattctgttggtcttccaggtcttcatcattatgttgatggtgcagaagctacgccactctttactatcccaccaggagttctgggctcagctgaaaaacctattttttataggggtcatccttgtttgtttccttccctaccagttctttaggatctattacttgaatgttgtgacgcattccaatgcctgtaacagcaaggttgcattttataacgaaatcttcttgagtgtaacagcaattagctgctatgatttgcttctctttgtctttgggggaagccattggtttaagcaaaagataattggcttatggaattgtgttttgtgccgttag

SEQ ID NO: 19 - protein, 305 aa, Mus musculus
MDGYNTSENSSCDPILAHHLTSIYFIVLIGGLVGLISILFLLVKMNSRSVTTMAVINLVVVHGVFLLTVPFRLAYLIKGTWTFGLPFCKFVSAMLHIHMYLTFLFYVVILVIRYLIFFKRRDKVEFYRKLHAVAASSAMWLLVIVIVVPLVVSQYGNSEEYNEQQCFRFHKELGHDSVRVINYMIVIVVIAVALILLGFQVFITLSMVRKFRHSLLSHQEFWAQLKNLFFIGIIIICFLPYQFFRIYYLYVVAHSKSCKNKVAFYNEILLSTTAISCCDLLLFVFGGSHWVKQKIVDMWNCLLCH

SEQ ID NO: 20 - DNA, 918 bp, Mus musculus
atggatggatataatacctctgagaattcctcttgtgaccctatactggcacaccacttaacatcgatttacttcatagtgctcattggaggactggtaggcctcatctccatcctgttcttgctggtgaaaatgaactcacgttcagtgaccaccatggctgtcatcaacctcgtggtggttcatggggtcttcctactgacggtgcctttccgcttggcatacctcatcaaagggacttggacgtttggattacccttctgcaaatttgtgagtgccatgttacatatccacatgtacctcacgttcctcttctacgtggtgatactagtcatcagatacctcatcttcttcaagcgtagagacaaagtagaattctatagaaaattgcatgcagttgctgcaagttctgccatgtggcttctggtgattgttattgttgtgcccttggtggtttctcagtatggaaatagcgaagaatacaatgagcaacagtgctttagattccataaagaacttggccatgattctgtgcgagttatcaactatatgatagtcattgttgtcatagctgttgcgttgattctcttgggtttccaggtcttcatcacattgtccatggtgcggaagtttcgccactccttactatcccaccaggagttctgggcacaactgaaaaatcttttctttataggtatcattattatttgttttcttccctaccagttcttcaggatttattacttgtatgttgtggcacattccaagagctgtaaaaacaaagttgcattttacaatgaaatcctattgagcacaacagccatcagctgctgtgatttgctgctttttgtctttggaggaagccattgggttaagcaaaagattgtcgacatgtggaattgcctcttatgccattag

SEQ ID NO: 21 - protein, 371 aa, Homo sapiens
MPANFTEGSFDSSGTGQTLDSSPVACTETVTFTEVVEGKEWGSFYYSFKTEQLITLWVLFVFTIVGNSVVLFSTWRRKKKSRMTFFVTQLAITDSFTGLVNILTDINWRFTGDFTAPDLVCRVVRYLQVVLLYASTYVLVSLSIDRYHAIVYPMKFLQGEKQARVLIVIAWSLSFLFSIPTLIIFGKRTLSNGEVQCWALWPDDSYWTPYMTIVAFLVYFIPLTIISIMYGIVIRTIWIKSKTYETVISNCSDGKLCSSYNRGLISKAKIKAIKYSIIIILAFICCWSPYFLFDILDNFNLLPDTQERFYASVIIQNLPALNSAINPLIYCVFSSSISFPCREQRSQDSRMTFRERTERHEMQILSKPEFI

SEQ ID NO: 22 - DNA, 1609 bp, Homo sapiens
aggaggcaagctggactccctcactcagctgcaggagcaaggacagtgaggctcaaccccgcctgagccatgccagccaacttcacagagggcagcttcgattccagtgggaccgggcagacgctggattcttccccagtggcttgcactgaaacagtgacttttactgaagtggtggaaggaaaggaatggggttccttctactactcctttaagactgagcaattgataactctgtgggtcctctttgtttttaccattgttggaaactccgttgtgcttttttccacatggaggagaaagaagaagtcaagaatgaccttctttgtgactcagctggccatcacagattctttcacaggactggtcaacatcttgacagatattaattggcgattcactggagacttcacggcacctgacctggtttgccgagtggtccgctatttgcaggttgtgctgctctacgcctctacctacgtcctggtgtccctcagcatagacagataccatgccatcgtctaccccatgaagttccttcaaggagaaaagcaagccagggtcctcattgtgatcgcctggagcctgtcttttctgttctccattcccaccctgatcatatttgggaagaggacactgtccaacggtgaagtgcagtgctgggccctgtggcctgacgactcctactggaccccatacatgaccatcgtggccttcctggtgtacttcatccctctgacaatcatcagcatcatgtatggcattgtgatccgaactatttggattaaaagcaaaacctacgaaacagtgatttccaactgctcagatgggaaactgtgcagcagctataaccgaggactcatctcaaaggcaaaaatcaaggctatcaagtatagcatcatcatcattcttgccttcatctgctgttggagtccatacttcctgtttgacattttggacaatttcaacctccttccagacacccaggagcgtttctatgcctctgtgatcattcagaacctgccagcattgaatagtgccatcaaccccctcatctactgtgtcttcagcagctccatctctttcccctgcagggagcaaagatcacaggattccagaatgacgttccgggagagaactgagaggcatgagatgcagattctgtccaagccagaattcatctagaccctagggcagtgccagtgctaggctgagcaccatcagctctcccaggtccttgtcacctgcttgggcacgtgcatggaacccgagccaacttcaccccaccctcgtcattacctgggagatgcacaagacaaatgttctaatgactgcatgcactgcttaagtattggccaacacgaactccccagttattcatgccagccaggaaggaaacgccttccttccccaccattcccagccctccttcccactggccagcacctgaacccagtgaacacaggcattagtggtccagggtcctggcttggagccagtgagtagacaggcaagcagaggggacaaaggtagctgggttatacatgaatattctcattacaatagaagaaaataaaagacttaattaagcccaaaaaaaaaaaaaaaa

SEQ ID NO: 23 - protein, 371 aa, Mus musculus
MPANLTEGSFHANQTVPMLDSSPVACTEIVTFTEALVAEEWGSFYSSFKTEQLITLWVLFVVTIVGNSVVLFSTCRRKRKSRMTFFVTQLAITDSFTGLINILTDIIWRFTGDFMAPDLVCRVVRYLQVVLLYASTYVLVSLSIDRYHAIVYPMKFLQGEKQAKVLIGIAWSLSFLFSIPTLIIFGKRTLSNGEVQCWALWPDDSYWTPYMTIVAFLVYFIPLAIISVIYGLVIRTIWMKSKTHETVISNCSDGKLCCSYNRGLISKAKIKAIKYSIVIILAFICCWSPYFLFDILDNFNVLPDTKERFYASVIIQNLPALNSAINPLIYCIFSSSICSPCRMQRSQDSRMTYRERSERHEMQILSKPEFI

SEQ ID NO: 24 - DNA, 1113 bp, Mus musculus
atgccagccaacctcacagagggcagctttcatgccaaccagactgtgccgatgctagattcttccccagtagcttgcactgaaattgtgacgttcactgaagcactggtggctgaggagtggggctccttctactcctcctttaagacagaacagctgataaccctgtgggtcctgtttgtcgtcactattgtgggaaactctgttgtgctgttctccacgtgcagaagaaaaagaaagtccagaatgaccttctttgtgacacaattggccatcacagactccttcacgggcctgatcaacatcttgacagacattatttggcgattcacaggagacttcatggcccctgacctggtttgcagagtcgtccgctacttgcaggttgtcctgctgtatgcctctacctacgtcctggtgtccctcagcatagacagataccatgccatcgtttaccccatgaagtttcttcaaggagagaagcaagccaaagtcctcatcggaatagcgtggagcctctcgttcctgttctccattcccacgctgatcatatttgggaaaaggacactttccaatggtgaggtgcagtgctgggcactgtggccggatgactcctactggaccccgtacatgaccatcgtcgcctttctggtgtacttcattcccttggcaattatcagcgttatctatggccttgtgatccgaactatttggatgaaaagcaaaacccatgagacggtgatttccaactgctcagatggcaaactatgctgcagctacaaccgagggctcatctctaaggcaaaaatcaaggccatcaagtatagcatcgtcataatccttgctttcatctgctgctggagcccatacttcctctttgacatattagacaacttcaacgtccttccagacaccaaggagcgtttctatgcctctgtgattatccagaacctgcccgccttgaacagtgccattaaccccctcatctactgcatcttcagcagctccatctgctccccctgcaagatgcaaagatcacaggattccagaatgacataccgagagagaagcgagagacacgagatgcagattctctccaagccggaattcatc

SEQ ID NO: 25 - protein, 299 aa, Homo sapiens
SQDEQVQFWLVIGYTVVIFVAILGNCVLNHLIMKYERVHTATGLFIVNISVTNMMLAFLISPFIMVHYLCNSLVFGKMTGHFSRFAQYSCAYVTVITMASISLDKYQICVMLHPLKSWITPIQDNVSIIIISIVSTCAPLSHSICQKFYQVEIGNIAEETVCLPSFPYTSKSSGKYLDLLFLLFLILPLMALVVVYGHVAKKLWIHNAVDDISIHTYIWQHGEKKETLKMLMTMVLVYTISWLPLNLYLVLPCREFISSHNGLCFFFHWLAISSSCYNPYIHFWLSNNFWIVQKVIMEI

SEQ ID NO: 26 - DNA, 897 bp, Homo sapiens
tctcaggatgaacaggtgcaattttggttagtaatagggtacacggtggtgatctttgttgccattttaggcaactgtgtcttaaaccatctgattatgaagtacgaaagggtgcacaccgccactggcctcttcattgtcaatatctctgtgaccaacatgatgctggcttttcttatttcccccttcatcatggtgcattatctgtgtaattccttggtgtttgggaagatgacaggccacttcagtcgctttgcccaatactcttgtgcctatgtaactgtgattaccatggcttctatttccctagacaaatatcagatatgtgtgatgctacatcccctgaaatcttggattactccaatacaagacaatgttagcatcattatcatctcgattgtgagtacctgtgctcctttgtcacattccatttgccagaagttttaccaggtggagattggaaacatagctgaagaaactgtctgcctacccagtttcccgtatacttcaaaatcttcagggaaataccttgacctgttgtttttgctcttcctcatcttgccattaatggcactagtggttgtttatggtcatgtggccaaaaagctgtggatccataatgctgttgatgacatcagcatccacacctatatctggcagcatggggagaagaaggagaccctgaagatgctgatgacaatggtgcttgtctacacaatcagctggctccctcttaacctctacctggtgctgccatgcagagaattcatctcaagccacaatggcctctgcttcttcttccactggctggcaattagcagctcctgctacaacccctacatccacttctggctcagcaataacttctggattgttcagaaagttatcatggaaatt

SEQ ID NO: 27 - protein, 455 aa, Mus musculus
MDAPTTDVPPEDFQSPGTMGFGDELTPEALSVPSGFDDLITSTTSQVLQAASNAGRNGMLSKMDKLADHMSNSGDLADTSGPLDLEIVSQDEQVQFWLVVGYTIVVFAAIIGNWVLNHIIMKYKRVHTATGLFVVNISVTNMMLALLSSPFTMVRYLCNSLVFGKMTCHLSRFAQYSCAYVTVMSMAAISLDRHRVMLYPLKARITPMQGNVCIIIIWIVSTCAALPHAVYQKLYQVEFGNTTEESACLPSFPYTSKSTWKYLDLGTFLLFFILPLLVLVAVYGHVAKKLWIHDAVDDINIHTYICQRGKKKQTLKMLMTVVLLYTISWLPLNVYLVLLSSESISSHNGLYFFLHWLAISSSCYNPYIYCWLSDSFRIEVQKVIMEIQKMLLDKISRLRGEHRRLSSVSHSQTPGSVDPNPGVPKFPRFRDFDELPSPPPSPTVEISFLHSVPRV

SEQ ID NO: 28 - DNA, 1365 bp, Mus musculus
atggatgctccaaccacagacgtgcccccagaggatttccagagccctggcaccatgggctttggggacgagctgactccagaagctctgagtgtacctagtggttttgatgacttgatcacttctaccacctcccaggtgcttcaggctgcatccaatgctggccgcaatggcatgctgtcaaagatggataagttggcagaccacatgtcaaactcgggggacctggctgacacatcgggtcccctagatttggaaattgtatcccaggatgagcaggtgcaattctggttagtggtagggtacaccatagtggtctttgctgccatcataggcaactgggtcttaaaccacataattatgaagtataagagggtacacactgccaccggcctcttcgttgtcaacatttctgtgaccaacatgatgctcgctcttctcagctctcccttcactatggtgcgctatctgtgtaattccttggtgtttggaaagatgacatgtcacctcagtcgctttgcccagtactcatgtgcctatgtaactgtgatgagcatggcagctatttctctggatcgacatagggtgatgctatatcctctgaaggcccggattactcccatgcaaggcaatgtttgcatcatcatcatctggatcgtgagcacttgtgctgctttgcctcatgccgtttaccagaagctttaccaagtagaatttggcaacacaacagaggaatctgcctgcctcccaagtttcccatatacttctaaatccacgtggaaataccttgacctgggcacctttctgctgttctttatcttgcctttgctggttctggtggctgtctatggtcatgtggccaaaaagctgtggatccatgatgctgttgatgacatcaatatccacacttacatctgccagcgtgggaagaagaagcagaccctaaagatgctgatgacagtggtgcttctgtatacaatcagctggctccccctcaacgtgtacctggtgctcctgtccagtgaatccatctcaagccacaatggtctctactttttcctccactggctagcaattagtagttcctgctacaacccctacatttattgctggctcagtgatagtttccgtattgaagttcagaaagtcatcatggaaatccagaagatgctactagataaaatcagccgcctcaggggagagcatcgccgactgagctctgtatctcacagccaaacccctggcagtgtggatcccaatccaggagtgcccaaattcccacgattcagagattttgatgagctgcccagtccccctccctccccaacagtggaaatctcctttctccattcagtgcctagagtt

SEQ ID NO: 29 - protein, 2481 aa, Homo sapiens
MKEHIIYQKLYGLILMSSFIFLSDTLSLKGKKLDFFGRGDTYVSLIDTIPELSRFTACIDLVFMDDNSRYWMAFSYITNNALLGREDIDLGLAGDHQQLILYRLGKTFSIRHHLASFQWHTICLIWDGVKGKLELFLNKERILEVTDQPHNLTPHGTLFLGHFLKNESSEVKSMMRSFPGSLYYFQLWDHILENEEFMKCLDGNIVSWEEDVWLVNKIIPTVDRTLRCVPENMTIQEKSTTVSQQIDMTTPSQITGVKPQNTAHSSTLLSQSIPIFATDYTTISYSNTTSPPLETMTAQKILKTLVDETATFAVDVLSTSSAISLPTQSISIDNTTNSMKKTKSPSSESTKTTKMVEAMATEIFQPPTPSNFLSTSRFTKNSVVSTTSAIKSQSAVTKTTSLFSTIESTSMSTTPCLKQKSTNTGALPISTAGQEFIESTAAGTVPWFTVEKTSPASTHVGTASSFPPEPVLISTAAPVDSVFPRNQTAFPLATTDMKIAFTVHSLTLPTRLIETTPAPRTAETELTSTNFQDVSLPRVEDAMSTSMSKETSSKTFSFLTSFSFTGTESVQTVIDAEATRTALTPEITLASTVAETMLSSTITGRVYTQNTPTADGHLLTLMSTRSASTSKAPESGPTSTTDEAAHLFSSNETIWTSRPDQALLASMNTTTILTFVPNENFTSAFHENTTYTEYLSATTNITPLKASPEGKGTTANDATTARYTTAVSKLTSPWFANFSIVSGTTSITNMPEFKLTTLLLKTIPMSTKPANELPLTPRETVVPSVDIISTLACIQPNFSTEESASETTQTEINGAIVFGGTTTPVPKSATTQRLNATVTRKEATSHYLMRKSTIAAVAEVSPFSTMLEVTDESAQRVTASVTVSSFPDIEKLSTPLDNKTATTEVRESWLLTKLVKTTPRSSYNEMTEMFNFNHTYVAHWTSETSEGISAGSPTSGSTHIFGEPLGASTTRISETSFSTTPTDRTATSLSDGILPPQPTAAHSSATPVPVTHMFSLPVNGSSVVAEETEVTMSEPSTLARAFSTSVLSDVSNLSSTTMTTALVPPLDQTASTTIVIVPTHGDLIRTTSEATVISVRKTSMAVPSLTETPFHSLRLSTPVTAKAETTLFSTSVDTVTPSTHTLVCSKPPPDNIPPASSTHVISTTSTPEATQPISQVEETSTYALSFPYTFSGGGVVASLATGTTETSVVDETTPSHISANKLTTSVNSHISSSATYRVHTPVSIQLVTSTSVLSSDKDQMTISLGKTPRTMEVTEMSPSKNSFISYSRGTPSLEMTDTGFPETTKISSHQTHSPSEIPLGTPSDGNLASSPTSGSTQITPTLTSSNTVGVHIPEMSTSLGKTALPSQALTITTFLCPEKESTSALPAYTPRTVEMIVNSTYVTHSVSYGQDTSFVDTTTSSSTRISNPMDINTTFSHLHSLRTQPEVTSVASFISESTQTFPESLSLSTAGLYNDGFTVLSDRITTAFSVPNVPTMLPRESSMATSTPIYQMSSLPVNVTAFTSKKVSDTPPIVITKSSKTMHPGCLKSPCTATSGPMSEMSSIPVNNSAFTPATVSSDTSTRVGLFSTLLSSVTPRTTMTMQTSTLDVTPVIYAGATSKNKMVSSAFTTEMIEAPSRITPTTFLSPTEPTLPFVKTVPTTIMAGIVTPFVGTTAFSPLSSKSTGAISSIPKTTFSPFLSATQQSSQADEATTLGILSGITNRSLSTVNSGTGVALTDTYSRITVPENMLSPTHADSLHTSFNIQVSPSLTSFKSASGPTKNVKTTTNCFSSNTRKMTSLLEKTSLTNYATSLNTPVSYPPWTPSSATLPSLTSFVYSPHSTEAEISTPKTSPPPTSQMVEFPVLGTRMTSSNTQPLLMTSWNIPTAEGSQFPISTTINVPTSNEMETETLHLVPGPLSTFTASQTGLVSKDVMAMSSIPMSGILPNHGLSENPSLSTSLRAITSTLADVKHTFEKMTTSVTPGTTLPSILSGATSGSVISKSPILTWLLSSLPSGSPPATVSNAPHVMTSSTVEVSKSTFLTSDMISAHPFTNLTTLPSATMSTILTRTIPTPTLGGITTGFPTSLPMSINVTDDIVYISTHPEASSRTTITANPRTVSHPSSFSRKTMSPSTTDHTLSVGAMPLPSSTITSSWNRIPTASSPSTLIIPKPTLDSLLNIMTTTSTVPGASFPLISTGVTYPFTATVSSPISSFFETTWLDSTPSFLSTEASTSPTATKSTVSFYNVEMSFSVFVEEPRIPITSVINEFTENSLNSIFQNSEFSLATLETQIKSRDISEEEMVMDRAILEQREGQEMATISYVPYSCVCQVIIKASSSLASSELMRKIKSKIHGNFTHGNFTQDQLTLLVNCEHVAVKKLEPGNCKADETASKYKGTYKWLLTNPTETAQTRCIKNEDGNATRFSISINTGKSQWEKPKFKQCKLLQELPDKIVDLANITISDDFPRQCPCGRDFGFHIFA

SEQ ID NO: 30 - DNA, 8194 bp, Homo sapiens
ttcttctttcatttcacatcaaacataggaatttagagacaagatctggtcatttgagggtgggaagttaaaagagtccagttctcagacttagacaatgaaagaacacatcatatatcagaagctttatggattgattctcatgtcgagttttatctttctctcagatacactttcactaaaaggaaaaaagctggatttttttggaagaggtgacacatatgtaagcctgatagataccattcctgaactcagccgattcacagcatgcattgatctggtattcatggatgacaactcaaggtattggatggccttctcttatattactaataacgccctcctgggcagagaagacatagaccttggacttgcaggagaccatcagcagctaatactatacagattgggaaagaccttttctatccgtcaccacctggcttcatttcaatggcatacaatatgcttgatatgggatggtgtgaagggcaaattagaactcttcctgaataaagaaaggatactggaagtaacggatcaaccacacaacctgacacctcatgggactctgttcctagggcactttctcaagaatgagagcagcgaggttaaaagcatgatgcgtagctttcctggcagcttgtactactttcaactctgggaccacatcctggaaaacgaagagtttatgaagtgtttagatggaaatatagttagttgggaagaagacgtctggcttgtcaacaagatcatcccaactgttgacaggacactgcgctgcgttcctgaaaatatgacaattcaagaaaaaagtacaactgtttcacaacagatagatatgaccactccatcccaaattactggagtaaaaccacaaaatactgcacattcctctacactattgtctcaaagcatacctatatttgcaactgattacacaaccatatcatattccaatacaacatctccacctctggaaacaatgactgcacaaaaaatcttaaagacactggtagatgagacagctacatttgcagtggatgttttatcaacttcatcagccatctctctgcctacccagagtatatccatagacaatactaccaattccatgaaaaaaacgaaatctccatcttcagaaagcacaaagacaacaaaaatggttgaagccatggctactgaaatctttcaaccacctacaccttctaatttcctatccacatccagatttaccaagaattcagttgtatctacaacttcagcaattaaatctcagtcggctgttacgaagacaacatctttattttcaactattgagtcaacatctatgtctacaacaccttgtctcaaacaaaaatccacaaatactggggcactccctatctccacagctggccaggagttcattgaatctacagctgccggaactgtaccttggtttacagtggaaaagacttcacctgcatctactcatgttgggactgcatcatcattcccacctgagcctgtgctcatctccacagctgctccagtagattctgtatttcctagaaaccagacagcatttccattggcaacaactgatatgaaaatagcatttacagtccattcattgactctcccaactaggcttattgagaccacacctgccccaaggacagctgaaacagaattgacatctacaaattttcaggatgtctctttacccagagtggaagatgccatgtctacttccatgtcgaaagagacctcctctaagaccttttctttcttaacatccttttcatttactgggactgagagtgtacagacagttattgatgctgaagctacacgtacagccttaactcctgaaatcacacttgcatctacagtggctgaaactatgctttcctccacaatcacaggacgagtttacacccagaatacacctacagctgatggacacttgcttactttgatgtccactagatcagcttccacatccaaggcacctgagtcaggtcccacatccacaactgatgaagctgcccatctgttctccagcaatgagaccatttggacttctaggccagaccaggccctgctggcatctatgaacacaaccaccatactcacatttgtgcctaatgaaaattttacatcagcatttcatgagaatactacttatacagaatatttatccgcaactaccaatatcaccccactgaaagcatctccagagggcaaaggtaccactgccaatgatgctactacagccagatatacaacagctgtatccaaattgacatcaccatggtttgctaatttctccatagtttctggaaccacatccataaccaatatgcctgaatttaaacttaccactttactactaaaaacaatacctatgtctacaaaacctgcaaatgaacttcctttgacaccaagggagactgttgttccatcagtagatataatatctactcttgcttgcattcaaccaaatttttctactgaggaaagtgcttctgagaccacacaaacagaaataaatggtgcaattgtatttggaggtacaacgacccctgtaccaaagtcagcaacaacacaaagattaaatgccactgtgacaagaaaagaagcaacttcccattatcttatgagaaaatcaactatagcagcagtggctgaggtttctccattttcaacaatgctggaagtgacagacgaatcagcacaaagggtgacagcttctgtcactgtttcctcttttcctgatatagaaaagctaagtaccccattggataataaaactgcaacaactgaggtgagagaaagttggcttttgacaaaattggtgaaaaccacacctaggagttcatacaatgaaatgacagaaatgtttaattttaaccacacctatgtagcacattggacttcagagacatctgagggaatttcagctggatctcccacttctgggagcacacatatattcggtgaacccctgggtgcttctaccacaaggatatcagaaaccagtttctccactacccctacagacaggacagctacgtccttgtctgatggtatcttacctccacagcctacagctgctcattcctcagcaacccctgtgcctgttactcatatgttctcattgccagttaatggcagttctgtggtggctgaggagactgaggttaccatgtctgagccttctacactggccagggctttttctacatctgtgctctcagatgtctcaaatctatcctcaactacaatgaccacagcattggtaccacctttggatcagactgcttccacaaccattgttattgtgcctacccatggagacttgattcgtaccacttcagaggccacggtaatctctgtcaggaagacatccatggcagttccttctctgacagaaacaccatttcattcactgagactctccactcctgtgacagctaaggctgagaccacccttttctctacctcagttgatacagtaaccccatctacacacactcttgtctgctcaaaacctccccctgacaacattcctcctgcgtcctccactcatgtgatctcaactacgtctacaccagaagcaactcaaccaatatctcaagtagaggagacttctacctatgctctcagcttcccatatactttcagtggtggtggagttgttgccagcttggctactggcaccacagagacctctgttgttgatgagaccacaccctcacacatctctgccaataagttgactacttcagtaaacagtcacatttcttcatctgccacatatcgtgtacacacaccagtgtccatccagttggtgactagcacctctgtcttatcttccgacaaagaccagatgaccatatccctgggaaaaacccctagaactatggaggtgacagaaatgtccccatcaaagaattcttttatttcatactcccggggtactccatctttggaaatgacagatacaggatttcctgagaccacaaaaatttccagtcaccaaacacattcgccttcagagattccacttgggactccctctgatggaaatttggcttcatctcccacttctggaagcacacagattacaccaaccttgacctcaagtaacacagtaggtgttcacattccagaaatgtctaccagtcttgggaaaacagctctcccctcacaagctctgacaatcaccacttttttgtgtcctgaaaaggaaagcacgagtgcccttccagcatatactcccaggactgtggaaatgatagtaaactccacctatgtgactcactctgtctcatatggccaggatacttcatttgtagataccacaacttccagctcaacaaggatatcaaatcctatggacatcaatacaactttttcacacttgcattcacttaggacacaacctgaggtgacttcagttgcctctttcatttctgaaagcacacagactttccctgagtccttgtctctttccacagctggactatataatgacggttttacagttctctccgacaggatcactacagccttttctgttccaaatgtacctacaatgcttcctagagaatcctctatggcaacgtccactcctatttaccagatgtcctcattgccagttaatgtaactgccttcacctccaaaaaagtttctgacactcccccaatagtgataactaaatcttctaaaacaatgcatccaggttgtttgaaaagtccctgtacagccacttctgggcctatgtctgagatgtcctcaataccagttaataactctgctttcacacctgcaacagtctcttctgacacttccacaagagttgggttattctctactttattgtcttcagttacccccaggactactatgaccatgcaaacatctacattggatgtcacacctgtgatatatgctggggctacttcaaaaaacaaaatggtttcctctgctttcactacagaaatgatagaggcaccttccaggatcacacctacgacctttctctctccaacagagccaactttgccctttgtaaaaaccgttcccaccaccattatggctgggatagtgactccatttgtaggcaccactgccttctctccactcagttctaagagcactggagctatttcctccattccaaagaccacattttcaccatttctatcagcaactcaacagtcatcacaagcagatgaggctacaactttgggcatattatctgggattactaacaggtccctatctactgtgaacagtggtacaggggtagctctcacagatacttattccagaatcactgttcctgaaaatatgctttcacctactcatgcagatagtctccatacttccttcaatattcaggtttccccatctctgactagctttaagagtgcttctggacccacaaaaaatgttaaaacaaccaccaattgcttttcttctaatactagaaagatgacttccttgttagaaaagacttccttaacaaactatgccacatctttgaatacccctgtttcataccctccatggaccccatccagtgcaactctaccctctttgacatcatttgtttattcacctcatagtactgaagctgagatctctactccaaagacctctcctcctcccacatcccaaatggttgaatttccagttctgggaacaagaatgacatctagtaatacccaacctctgcttatgacttcctggaacatacccacagctgaaggttctcagtttccaatttccaccactattaatgtacctacatccaatgagatggaaacagagactctacaccttgttcctgggcctttgtcaacattcacagcctctcagactggtctagtatctaaagatgtcatggcaatgtcatcaattcctatgtcaggaattcttcctaaccatgggctttctgagaacccttcattatcaacatctttaagagctatcacttccacattggctgacgttaagcacacatttgagaaaatgaccacatctgtaactcctgggaccacactcccatcaattctttctggtgccacttcaggatctgtaatttcaaagtcacccattctgacatggctcttatctagtctcccttctggctcccctccggcaactgtatctaatgcccctcatgttatgacttcctctacagtagaggtgtcaaaatcaacatttctgacatctgacatgatatcagcgcacccattcactaacttgacaacactaccctctgctactatgagcaccatactcacccgaaccattcctacacctacactgggtggtatcactactggcttcccaacttctctccctatgtctataaatgtcacagatgacattgtgtacatttccacacaccctgaggcatcctccagaaccacaataactgccaaccccaggactgtgtctcatccttcatccttcagcagaaagactatgtcaccttctacaactgaccacactctatctgttggtgccatgcctctgcctagctctacaataacatcttcatggaacagaattccaactgcatcatcaccctctactttaattattcctaagcccacactggactcccttctaaatataatgactactacatccactgttcctggagcctcatttccactcatatccactggggtgacatatccttttacagcaactgtgtcttcaccaatatcgtccttttttgaaacaacttggctggactccacaccttcctttctatctacggaagcatcgacttcgcctactgccaccaagtccacagtttccttctacaatgttgaaatgagcttctctgtctttgttgaagagccaaggatccctattaccagtgttataaatgaatttacggaaaattcgttgaattctatatttcagaacagtgaattttctcttgctactctggaaacccaaattaaaagcagggacatttcagaggaagagatggtcatggatcgagctattttggaacagagagaaggacaagaaatggctacaatttcctatgtaccatacagttgtgtttgtcaggtcatcataaaagccagctcttccttagcatcctctgaattgatgagaaaaatcaaaagtaaaatacatggcaacttcacacatggaaacttcacacaagatcaattgacgttattagtaaactgtgaacacgttgcagtgaaaaaactagagcctggaaattgcaaagctgatgaaacagcctctaaatacaaagggacctataagtggctattaaccaaccctacggagacagcccaaaccagatgcataaaaaatgaggatggaaatgccacaagattctcaatcagcatcaacacgggcaaatctcagtgggaaaagccaaagtttaaacaatgcaaattgcttcaagaacttcctgacaagattgtggatcttgctaatattaccataagtgatgattttcctaggcaatgtccctgtgggagggattttggcttccatatatttgcctaaatcactgacggagagaattcctcttagcaacttacaaacgatcttgtttaatttctttggccaaacttcactctttaagaccaaaaatgtcactaaagcattaaccacctatgttgtgagtgccagcatttcagatgatatgttcattcaaaacttagctgacccagtggttatcactctgcagcatattggaggaaaccagaattatggtcaagttcactgtgccttttgggattttgagaataatgggctgggtggatggaattcgtcaggctgtaaagtaaaggaaacaaatgtaaattacacaatctgtcagtgtgaccacctcacccattttggagtcttaatggaaacttcgaaaagattatcctgccaaaattctgatcaacctgtgcacagcactactgatgctaaacctggtatttttgatcaattcttggttgtcatcatttcagaaagtgggagtttgtatcacagctgcagtggcacttcattacttcctgcttgtttcttttacttggatgggcctggaggcagtccacatgtatttggctctagtcaaagtcttcaacatatacattccaaattatatccttaaattttgtctagttggttggggaatcccggctatcatggtggcaatcacagtca

SEQ ID NO: 31 - protein, 2590 aa, Mus musculus
MQCGLENRQGTDGSIQADICNAQQNDMQRHKWPLKQALERPTGKGCLLSETEGPKPCSLCRSPASSEPCQKPGDSLSLKGKRLDFYGEGKAYVSLTYTMPELSRLTACIDLISMTNSSHYWMAFIYITNNTLLGREDVDLGLAGDHQQLILYSFGKTFYVSYHLIPFHWHTLCLVWDGVKGRLELFRNKERILAIMDQPHRLSPNGTLVLGHFPRNGEGQIKTVIPRFTSSLYYFQLWDRILENEEFMTCFYGNVVSWEDDVWLIHKISPTVDRRLRCFVSENMTIQETSTNVSQQIDLTTSSQTTGLNPHKTSHSSTLLPEGMADSTINSTAISYANTVPSPLATVSAAKDLKTSTTETATFLTDTLFTSTATPLPTQTVTEHSYLGKTRTSKRVEAMATEIFHSATATDLIDTSVFTKNYTVSETSTTKSKSAVGKTTLFLNESTSIAPTPCPKHKSTDVAILHTSKSGQEFLVSSAARTVSWSTLEETSPITTDVGIVSTFPPESLLTSTASPVSSTFPEIQLASTLSTTDSEMASTVHSVLPMQTIPTPRTVKPESGSTNFQDVFSPSMEDALSVSMPKETTFMAFSSITSSPITRTQDEQIAIDAESTHLTIIPGTKFVPTLAEASLFPTIEGQAYTQDTPTTDEPMLTLTSTKSPSTYNASESVLTSITIKSDYQFFTNETTWTSKSGQNLLTSMNTTTIPTFTSNKTLTLPFQGNATNRDHSSMTTNVSPIEASTESKVTTSSDATTASYTTALFKPTSQWLSHFTSVSGITSIASQPESKLTTLLLKSNSMPTVATNEFPSIPSEPVAPSVNTSTLTDIKPNFSTEKSISETIQIETNGVSSFGDTLAPLPMSATTQRVYTTVTKETTSRHPKVKSTISTVAEASPFSTMLEVTDESEQMVTASVTISPFTDIEKLTTALSKETATAEVGVSWLSTKLKESMPESSHNGTTESFNSTHTYTVDWTSEKSKGNSASSPNSASTQALPELPSSSTMKTMGVTFSTNSSQRTAASLSAGILSPQTASTHALVTPQLLTHTFSLPVNISAVTSPKTTMVFFDETKVTLSQPSTLARDFTTSMPSVGSTLPTVTMTTELVPPVSPTASTISDSMFTHRDLLHTTSEVTTISSTTAHMAISSLRETLVSSLRPPTPVITKAISTIPSISSDSVSPSIHTLVCSRPSPNNVTIVSSTYVSSTTSTSVATPSESHFSFPYAFSSGGDVTMASGPTGTSAGGEAMPPNTFVNKFITSVDHESTTYFVNTPVSTQSVFATSMVSSDKEQTNISMEKTLRTTGVAEISPSKNSFILDSQSTFPWEMTDTELSETTEISSHQTHLPSEILPGYSDSGNLTTFSTSGSTQSAQTLSSSTIIGVRVSEGSTSLEKTALPSQVQTVTKSLTHDKERTSALSEYPPRTVEKIMSSSPVTHQATGHLATSMIALSTSGSTENFPNSFSPFTTGLMSTNFTMITPNGSTTVLSIPNEPTNLPKKTSMEASTPISQMDLLALNVTAFTSKKVSDTHTMLMTKSSRTIHIGTLKSVSIGTFGLKSEKSEMPVNNSDFSTTVLYSDTSTRLGEFFTSSSSLPPKATKTTQASTLNTTPVAHAGPTSQRTVFSSTFSNSSVVEVPLNYTTAHFSSPTQRGFLSMKTIPTTSMAGISTSVIGATSSSLSSSKNTEPISSIPKTMFSLLLSTTQQPSQENGAPTLDILPGITVSSGGATDLINANSRATIPANELSTTPSDNFYTFLNTQDSPTLTNSKVTPRPTESVKSTPTHLSFDTRKMNILTELTKSGPCVTTPVLYPLWTQTSTAPPLTSHLYSPHSTKAKFPLASQMAEYPAWATGITPSITQALLTTSRNTQRVEDSPFPVFTTKDKDGSLHTSTFLESSLRTTGADSSTDMSERMSFGRTSISPSLTRHDLSIGSLTVSSPTNTSPWSKVPVTSESHTLFPSKSTLDSVMSTATTTSTAIGTSFPLMSTEMAHPSTATGFSLVSSSFETTWMDSIFSSLFTQPSTSPTAKESTVSFYNIKMSFSVFDEEPRVLVTTVIHDLTKDWLNFMFQNSEFSLANLAIQIKSSCACWVIIKAKSSLESVELISSIRTKIHGNLTHGNFTQDQLTLLVKSDHVVVEKLEPGKCEADETPSKYKGTYKWPLTDPTETAQERCIKNENRNATRICSISIQTGKCQWEKPRLKQCKLLQGLPDKIVDLANITISDENADDVAEHILNLVNESPPLDEEETKIIVSKVADISNCDEISINLTQIILQILNTVTEKQSDSASNLPPVSNEILRIIERVGHKMEFAGRTANLTVAKLALAVLRVDHKFEGMAFSIQSSEEVIAPQIFLGDIPLRKALASIYLPKSLREKVPLDGLQTILFNFFGQTSLFKLLALSALNLTFKLEAMKCGENYDQVYCAFWDFDTNNGLGGWNPSGCKLKESNINYTICQCNHLTHFGVLMDLSRSTVDAVNERILVIITYTGCGISSIFLGIAMVTYIAFHKLRKDYPSKILINLCTALLMLNLAFLVNSWLTSFQKVGLCITAAVALHYFLLVSLTWMGLEAVHMYFALVKVFNTYIPNYILKFCLAGWV

SEQ ID NO: 32 - DNA, 7710 bp, Mus musculus
atgcaatgtggacttgagaatcgccagggaacagatggcagcatccaagcagacatctgcaatgcacagcaaaatgatatgcaaagacacaagtggcctttgaagcaggcccttgagagacccactggaaaaggctgcctgcttagtgaaacagaagggccaaagccctgttcactttgtcgtagtcctgcctcctctgaaccctgccagaagcctggagattcactttcattgaaaggaaaaaggcttgatttttatggagaaggcaaggcatatgtcagcctgacctacacgatgcccgaactcagccgactcacagcatgtattgatctgatatcgatgactaacagctcacattactggatggccttcatctacattactaataacactctcctgggcagagaagatgtagaccttggactcgcaggagaccatcagcagctgatactgtacagctttggcaagaccttctatgtcagttatcacctgattccatttcattggcataccctgtgcttggtatgggatggtgtgaagggcagattagagctcttccggaacaaagaaaggatacttgcaataatggatcagccacacagactgtctcctaatgggactttggtcttgggacactttcccaggaatggagagggtcagattaaaactgtgatacctcgctttacaagcagcctgtattactttcagctctgggaccgcatcctggaaaatgaggagtttatgacatgtttctatggaaatgtagttagttgggaagatgatgtttggctcatccacaagataagtccaactgttgacaggagactgcgctgcgtttctgaaaatatgacaattcaagaaacaagtacaaatgtttcacagcaaatagacctaacaacttcttcccaaactactggacttaacccacacaagacttcacattcatccacactgttgccagaaggcatggctgattctacaatcaacagtacagccatatcatatgctaatacagtaccctcacctctagcaacagtaagtgcagccaaagatttgaagacatctacaaccgagacagctacatttttaacagataccttgtttacttcaacagccacccctctgcctacccagactgtaacagaacactcatatctaggaaaaacaaggacatcaaaaagggtggaggccatggctactgagatctttcattcagctacagctactgatttaattgacacatctgtgtttactaagaattatactgtatctgaaacttcaacaactaagtccaagtcagctgttgggaagacaactttattcttgaatgaatcaacatccatagctccaacaccttgtcccaagcacaaatccacagatgttgctatactccatacctctaaatctgggcaagaatttcttgtatcttcagctgccagaactgtgtcttggtccacattagaagagacttcacctattactactgatgttgggattgtatcaaccttcccaccagagtctttgcttacctccacagcttctcctgtgagttctacatttcctgaaattcagttagcatctaccttgtcaacaactgattcagaaatggcatcaacagtccattcagtgttgcctatgcagaccatacctaccccaagaacagtgaaaccagagtcaggctctacaaatttccaagatgtcttttcacccagcatggaggatgctctatctgtctccatgcctaaagaaaccactttcatggccttttcttccattacctcctctccaatcaccagaactcaagatgaacagatagctattgatgctgagagtacacatctaaccataatccccggaaccaaatttgtccctacattggctgaagcttcactcttccctaccattgaagggcaagcatacactcaggatacacccacaacggatgagcccatgcttactttgacttctactaaatcaccttctacatataacgcatctgaatcagttctcacatctataacaattaaaagtgactatcagttcttcaccaatgagaccacttggacttctaagtcaggtcagaacctgttgacctctatgaatacaaccactatacccacattcacatctaataaaactctcacattaccattccaaggtaatgccactaatagagatcattcatccatgactactaacgtctcaccaattgaagcatccacggagagcaaagtgactaccagctctgatgctactacagccagttatacaacagctttattcaaaccaacatcccagtggcttagtcatttcacgagtgtttctggaatcacatctatagccagccagcctgaatctaaactcaccaccttattattgaaaagcaactctatgcccacagtagctacaaatgaatttccctcaataccaagtgagccagttgctccatcagtgaatacgtctaccctcactgacattaaaccaaatttttctacagagaagagcatttctgagacaatacaaatagaaacaaatggtgtgagctcatttggtgatactctggcccctctgcccatgtctgcaacaacacagagagtctataccactgtgacaaaagaaaccacttcccgtcatcctaaggtaaagtcaactatatcaacagtagctgaggcttctccattttcaacaatgctggaagtgacagatgaatcagaacaaatggtgacagcttctgtcactatttccccctttacagatatagaaaaattgactactgcattgagtaaagaaactgcaactgcagaggtgggagtgagttggctttcaaccaaattaaaggaaagcatgcctgagagttcacacaatggaaccacagaaagctttaactcgacccatacctacacagtagattggacttcagaaaaatccaagggtaactcagcttcatcacccaattctgcaagcacccaggcactacctgaacttccaagttcttcaacaatgaagacgatgggagtcactttctccactaattcttcacagaggacagctgcatctttgtctgctggtatcttgtctccacagactgcctctactcatgccttagtaactccccaactgcttacacacacgttttcactgccagttaatatctctgctgtcacctctcctaaaaccactatggtgttttttgatgagactaaggtgaccctgtctcagccttctacattggccagggatttcactacatctatgccctcagttggttcaactctaccaacagtgacaatgaccacagagttggtgccaccagtgagtccaacagcttccacaattagtgatagcatgtttactcacagagacttacttcataccacttcagaggtcacaacgatctcttccacaacagcacacatggcaatttcctctctgagagagactttggtatcctcactgagacctcccactcctgtgataactaaggctataagtaccattccctccatctcatctgactcagtaagtccatccatacacactcttgtctgctcaaggccttcccctaataacgttactattgtatcctctacttatgttagctcaactacatccacatcagtagcaacaccatctgaatctcattttagttttccctatgcttttagtagtggtggagatgtcactatggcttctggacccacagggacctctgctggtggtgaggccatgccccctaacacctttgtcaataaatttattacctcagtagaccatgaatctaccacatattttgtgaatacaccagtctccacacagtcagtgtttgccacctctatggtatcttctgacaaagaacagaccaacatctccatggagaaaaccctcagaactacaggggtggcagagatttctccatccaaaaattcctttattttggactcccagagcactttcccttgggaaatgacagacacagaactttctgagaccacagaaatctccagccaccaaacacatttgccttcagaaattcttcctggttattcagattctgggaatttaaccacattttctacttctgggagcacacagtctgcccaaaccttgtcctcaagcaccataataggtgttcgtgtttcagaggggtcaactagtcttgagaaaacggcactcccttcacaagttcagacagtaaccaaatctttgactcatgataaagaaaggacaagtgccctttcagaatatcctcccaggactgtagaaaagatcatgagctcctctcctgtgactcatcaagccacaggtcacctagctacttcaatgattgctctttccacttctggaagcacagagaatttccctaactccttctctcctttcacaactggacttatgagcaccaattttacaatgatcactcccaatgggagcactacagtcctttctattccaaatgaaccaacaaaccttcctaagaagacttctatggaggcgtcaactcctatttcccaaatggatttgttggccctcaatgtcactgctttcacctctaaaaaagtttctgacacccatacaatgctaatgaccaagtcttctagaacaatacacataggcactttgaaaagtgtctctataggtacctttgggcttaagtctgaaaagtctgaaatgccagttaataactctgatttctcaactacagtgctttattctgacacttccacaagacttggggaattctttacttcatcgtcttcacttccccctaaggctactaaaaccacccaagcatccacattgaataccacaccagtggcacatgctgggcctacttcacaaagaacagtgttttcctctactttctcgaattcctcagtggtagaggtaccactcaattacacaactgcacacttttcctctccaacacagagaggttttttatctatgaaaactattccaaccactagtatggctggaatatcaacttcagttataggtgctacttcttcctctctgtccagttctaagaatactgaacctatttcctccattccaaagaccatgttttcattgttactttcaacaacccagcaaccatcacaagaaaatggggctcccactctggacatattacctgggatcactgtgagcagtggtggggcgacagatctcattaatgccaattccagagccaccatccctgcaaatgagctttcaactactccttcagataatttttatactttcttgaatactcaggattccccaactttgactaactctaaagtgacccctagacctacagaaagtgtaaaatccacacctactcacctttcctttgatactagaaagatgaacattttaactgaactaacaaagagtggtccatgtgtgactactcctgttttataccctttgtggacccagaccagtacagctccacctttgacatcacatctttactcacctcatagtaccaaggccaagtttccacttgcatctcaaatggctgaatatccagcatgggctacaggaatcacacctagtatcacccaggctctgcttaccacgtccagaaacacacaaagagttgaagactctccctttccagttttcacaacgaaggacaaagatggcagtctacacacttctacattccttgaatcatctctgagaactactggggctgacagctccacagatatgtctgaacgcatgtcctttggtagaacgagtatatcaccttctctaacaaggcatgacctatctattggttctctgaccgtatctagccctacaaatacatctccatggagtaaagtcccagttacatcagaatctcacactttatttccttctaaatctacactggactctgttatgagtacagccactactacatccacagctataggaacctcatttcccctgatgtctactgagatggcacatccttctacagcaactgggttttcactagtgtcttcatcttttgagacaacatggatggactccatattttcctctctatttacacaaccatctacttcaccaactgccaaagagtctacagtttccttctacaatattaaaatgagcttctctgtctttgatgaagagccaagggtcctcgttaccactgttatacatgaccttacaaaagattggttgaattttatgtttcagaacagtgaattttctcttgctaatctggctattcaaattaaaagcagttgtgcctgttgggttatcataaaagccaagtcttctttagaatctgtggaactgatcagcagcatccgaactaaaatacatgggaacctcacacatgggaacttcacacaagatcaattgactctattggtaaagtctgaccatgttgtagtggaaaagctagagccaggaaaatgtgaagcagatgaaacaccctcaaaatacaaagggacatataagtggccattaactgaccctactgagacagcccaagaaaggtgcattaaaaatgagaataggaacgccacaagaatttccatcagcatccagactggcaagtgtcaatgggaaaaaccaaggcttaagcagtgcaagttgctccaaggactccctgataagattgtggatcttgctaatatcaccataagtgatgagaatgcggatgatgtcgcagagcacattttaaatctggtcaatgagtctccacctttggatgaagaagagacaaagattattgtttctaaagtagctgatatttctaactgtgatgagataagtatcaacctaacccagatcatactccaaatcctcaacactgtgacggaaaagcagagtgattcagcttccaacctgcctccagtaagcaatgagattctgaggataattgagcgtgttggtcacaagatggaatttgcagggagaacagcaaatctcactgtagctaagctggctttggctgtgctgcgggtagaccacaagtttgaaggtatggccttcagcatccaatcctctgaagaagtcatagccccccagattttcctcggtgatatccctctaaggaaggctttggcttccatctatttgcctaaatcattgagggaaaaggttcctcttgatggcttgcaaactatcttgtttaatttttttggccaaacctcactctttaagcttctagctctgagtgctctaaacctcacctttaaactagaggcaatgaaatgtggtgaggggctaggtggatggaatccatcaggctgtaaactcaaggaaagcaatataaattatacaatctgtcagtgtaaccacctcacccactttggagtcttaatggatttgtccaggtctacagtggatgcagtaaatgaacggatattagtgattataacatatacaggatgtgggatctcctccattttcctggggattgccatggtgacatacatagctttcaaacttcgaaaagattatccttccaaaatcctgatcaacctatgcacagcgttactgatgctcaacctagcctttctggtgaactcctggctgacatcatttcagaaagtaggactatgtatcacggctgcagtggcactccattactttctcctcgtgtctttgacttggatgggcctggaagcagtccacatgtactttgctttagtcaaagtcttcaacacatacattccaaattatatccttaagttttgtctggctggctgg

SEQ ID NO: 33 - protein, 416 aa, Homo sapiens
MDPSVVSNEYYDVAHGAKDPVVPTSLQDITAVLGTEAYTEEDKSMVSHAQKSQHSCLSHSRWLRSPQVTGGSWDLRIRPSKDSSSFRQAQCLRKDPGANNHLESQGVRGTAGDADRELRGPSEKATVSLLTAVALARLATRTRRPSYYYLLALTASDIIIQVVIVFAGFLLQGAVLARQVPQAVVRTANILEFAANHASVWIAILLTVDRYTALCHPLHHRAASSPGRTRRAIAAVLSAALLTGIPFYWWLDMWRDTDSPRTLDEVLKWAHCLTVYFIPCGVFLVTNSAIIHRLRRRGRSGLQPRVGKSTAILLGITTLFTLLWAPRVFVMLYHMYVAPVHRDWRVHLALDVANMVAMLHTAANFGLYCFVSKTFRATVRQVIHDAYLPCTLASQPEGMAAKPVMEPPGLPTGAEV

SEQ ID NO: 34 - DNA, 2770 bp, Homo sapiens
  misc_feature (2504)..(2504): n is a, c, g, or t
atgagcccaggagctcgagaccagcctaggcaacatggcgaaacaccgtctctacaaaaaatacgaaaattagctgggcgtgttggtgcttgcctgtaatgccagctatttgggaggctgagatgggaggatcacttgagcctgggagttcgaggctgcagtgagctatgatcacaccactgtaccacagcctgggtgacagagtgagaccctgtcttgaggggtagggaggcagaaggaaaaaaaagagagagagagaccctggtgctcaggcctggtggctctggctggactgatcagggctgaagacttcagagaccaaaaaggtcaaggtgtggccgggtgcggtggctcacacctgtgatcccagcatttttgggagacccaggtgggcatatcacctgaggccaggagctcaggaccagcctggctaacacggtgaaaccccgtctctactaaaaatacaaaaattagccaggcatggtggcaggcacctgtaatcccagctacttgggaggctgaggcaggagaatcactggaacccaggaggcagaggttgcagtgagccgagatagcaccattgcactccagcctgggtgacagagcgagactctgtctcaaaaagaaaagaaaaaaaaagtcaaggtgtgcggctgggtcttcataacatctttcaccttgcccaggctggctcagaggtgactgccttagtggataggatcccttccaccgtgggctagcagcctaccctggtcactgacaccacaccatgtaggaaagaatcgccaccaccaagaaggggcctctcacctctgtataggctgtgtgctggctgatgacgtggttgccctgtcctgtctgctgctgccactgagctggacatctccaggctccatctcttgaaccatggatcccagcgttgttagcaatgagtattatgatgttgcccatggagcaaaagatccagtggtccccacttccctgcaggacatcactgctgtcctgggtacagaagcatatactgaggaagacaaatcaatggtgtcccatgcacagaaaagccagcattcttgtctcagccattccaggtggctgaggtctccacaggtcacagggggaagctgggacctccgaataaggccatccaaggactccagcagtttccgccaggctcagtgtctgcgtaaggatcctggggcaaacaaccacttggagagccaaggggtgagaggtacagctggcgatgctgacagggagctgcggggaccctcagaaaaagccacagtcagcctcctgaccgcagtggccctggcgcgccttgccaccaggaccaggaggccctcctactactaccttctggcgctcacagcctcggatatcatcatccaggtggtcatcgtgttcgcgggcttcctcctgcagggagcagtgctggcccgccaggtgccccaggctgtggtgcgcacggccaacatcctggagtttgctgccaaccacgcctcagtctggatcgccatcctgctcacggttgaccgctacactgccctgtgccaccccctgcaccatcgggccgcctcgtccccaggccggacccgccgggccattgctgctgtcctgagtgctgccctgttgaccggcatccccttctactggtggctggacatgtggagagacaccgactcacccagaacactggacgaggtcctcaagtgggctcactgtctcactgtctatttcatcccttgtggcgtgttcctggtcaccaactcggccatcatccaccggctacggaggaggggccggagtgggctgcagccccgggtgggcaagagcacagccatcctcctgggcatcaccacactgttcaccctcctgtgggcgccccgggtcttcgtcatgctctaccacatgtacgtggcccctgtccaccgggactggagggtccacctggccttggatgtggccaacatggtggccatgctccacacggcagccaacttcggcctctactgctttgtcagcaagactttccgggccactgtccgacaggtcatccacgatgcctacctgccctgcactttggcatcacagccagagggcatggcggcgaagcctgtgatggagcctccgggactccccacaggggcagaagtgtagaggagggggcccagctagggagctcagggtggctcatggccacatgtactggggcctttgaggttgtacccaaaacacgtttatcaacagcttgctttccttgggtgggggtggaggctcctcctttgggtgtggctcccaggtagagaggaggacaacttagccagctcttatgtttgcttcaccagcaatccctatttcctgggaagatgaaagggcactgccaggcacaggctaatagcatcagtgctgtgggcattcctttgcggggggcattttgcctggctcatcgtgaatgccagattaatgttggttgaatggatagaaaaacggacagatggaggccngggtgcggtggctcacgcctgtaatcccagcacgttgggaggctgaggcaggcggatcacgaggtcaggagatcgagaccacagtgaaaccctgtctctactaaaaatacaaaaaattagctggacgcagtggcgggcgcctgtagtcccagctactcgggaggctgaggcaggagaatggcgtgaacccggaaggcggagcttgcggtgagccgagatcccgccactgcactccagcctgggcgacagagtgagactccgtctca

SEQ ID NO: 35 - protein, 340 aa, Mus musculus
AVQPQVTLLPTVNGSNPRYDGVDGHWPESPERSPCVAGIIPVIYYSVLLSLGLPVNVLTSVALARLAARTRKPSYHYLLALTASDIVTQVIIVFVGFLLQGAVLARQVPQAVVRTANILEFAANHASVWIAVLFTVDRYNALCRPLRHRATSSPGRTHRAIAAVIGVTLLTGIPFYWWLDVWRDADPPSTMDKLLKWAHCLIVYFIPCNVFLVTNSAIILRLRKRGQRGLRPLVSKSTAILLGVTSLFALLWAPRIIVMLYHLYVAPVHRDWRVHLALDIANMLAMLNTEVNFGLYCFISKTFRATVRQVICDVHMACALKSQPKQTVVELMLKSVGTEL

SEQ ID NO: 36 - DNA, 1023 bp, Mus musculus
gctgtgcagccacaagtgaccctgctgcctacagtcaatggtagtaacccaagatacgatggtgtggatggccactggccagagagcccagagaggtcaccctgtgtggctggtatcatacctgtcatctattacagcgtcctgctgagcctggggctgcctgtcaacgtcctgacttcagtggcactggcccgtcttgctgccaggaccaggaaaccctcctatcactatctcctggcactcacggcttcagatatcgtcacccaagtgatcatcgtcttcgtaggcttcctcctgcagggagctgtgctggcccgccaggtgccccaggccgtggtgcgcacagctaacatcctggagtttgctgccaatcacgcctcagtctggattgcagtcttgttcacggtggatcgctacaatgccctgtgccgccctctacgccatcgggccacctcgtccccaggccggacccaccgcgctattgctgctgtcattggcgttaccctcctgaccggcatcccattctactggtggctggatgtgtggagggatgcagaccctcctagcactatggacaaactcctcaagtgggctcactgcctcatcgtctacttcattccctgcaatgttttcctggtcaccaactctgccatcatccttcggctacggaagagaggccagagagggctgcggccattggtgagcaagagcacagccatcctcctgggtgtcacctccctcttcgccctcctctgggcaccacgtattattgtcatgctgtaccatctgtatgtggcccctgttcaccgggattggagggtccacctggccttggacatagccaacatgttggccatgctcaacacagaggtcaactttggcctctattgcttcatcagcaagactttcagagccactgtccgacaggtcatctgtgatgtccatatggcttgcgccttaaagtcacagccaaagcaaacggtggtggaactcatgctgaagtccgtagggacagagctgtag

SEQ ID NO: 37 - protein, 578 aa, Homo sapiens
MGFSCRQKTWHKITDTCQTLNALNIFEEDSRLVQPFEDNIKISVYTGKSETITDMLLQKCPTDLSCVIRNIQQSPWIPGNIAVIVQLLHNISTAIWTGVDEAKMQSYSTIANHILNSKSISNWTFIPDRNSSYILLHSVNSFARRLFIDKHPVDISDVFIHTMGTTISGDNIGKNFTFSMRINDTSNEVTGRVLISRDELRKVPSPSQVISIAFPTIGAILEASLLENVTVNGLVLSAILPKELKRISLIFEKISKSEERRTQCVGWHSVENRWDQQACKMIQENSQQAVCKCRPSKLFTSFSILMSPHILESLILTYITYVGLGISICSLILCLSIEVLVWSQVTKTEITYLRHVCIVNIAATLLMADVWFIVASFLSGPITHHKGCVAATFFVHFFYLSVFFWMLAKALLILYGIMIVFHTLPKSVLVASLFSVGYGCPLAIAAITVAATEPGKGYLRPEICWLNWDMTKALLAFVIPALAIVVVNLITVTLVIVKTQRAAIGNSMFQEVRAIVRISKNIAILTPLLGLTWGFGVATVIDDRSLAFHIIFSLLNAFQVSPDASDQVQSERIHEDVL

SEQ ID NO: 38 - DNA, 1912 bp, Homo sapiens
aggaaacaagaaagtcagctgtgtggaagacaatgactcatatacttttgctgtactacttggtgtttcttttgcccacagagtcctgtaggacattgtatcaggtgtatgcgatggtgtctgtacagactactcccagtgtactcaaccttgccctccagacactcagggaaatatggggttttcatgcaggcaaaagacatggcacaagatcactgacacctgccggactcttaatgccctcaacatctttgaggaggattcacgtttggttcagccatttgaagacaatataaaaataagtgtatatactggaaagtctgagaccataacagatatgttgctacaaaagtgtcccacagatctgtcttgtgtaattagaaacattcagcagtctccctggataccaggaaacattgccgtaattgtgcagctcttacacaacatatcaacagcaatatggacaggtgttgatgaggcaaagatgcagagttacagcaccatagccaaccacattcttaacagcaaaagcatctccaactggactttcattcctgacagaaacagcagctatatcctgctacattcagtcaactcctttgcaagaaggctattcatagataacatccctgttgacatatcagatgtcttcattcatactatgggcaccaccatatctggagataacattggaaaaaatttcactttttctatgagaattaatgacaccagcaatgaagtcactgggagagtgttgatcagcagagatgaacttcggaaggtgccttccccttctcaggtcatcagcattgcatttccaactattggggctattttggaagccagtcttttggaaaatgttactgtaaatgggcttgtcctgtctgccattttgcccaaggaacttaaaagaatctcactgatttttgaaaagatcagcaagtcagaggagaggaggacacagtgtgttggctggcactctgtggagaacagatgggaccagcaggcctgcaaaatgattcaagaaaactcccagcaagctgtttgcaaatgtaggccaagcaaattgtttacctctttctcaattcttatgtcacctcacatcttagagagtctgattctgacttacatcacatatgtaggcctgggcatttctatttgcagcctgatcctttgcttgtccattgaggtcctagtctggagccaagtgacaaagacagagatcacctatttacgccatgtgtgcattgttaacattgcagccactttgctgatggcagatgtgtggttcattgtggcttcctttcttagtggcccaataacacaccacaagggatgtgtggcagccacattttttgttcatttcttttacctttctgtatttttctggatgcttgccaaggcactccttatcctctatggaatcatgattgttttccataccttgcccaagtcagtcctggtggcatctctgttttcagtgggctatggatgccctttggccattgctgccatcactgttgctgccactgaacctggcaaaggctatctacgacctgagatctgctggctcaactgggacatgaccaaagccctcctggccttcgtgatcccagctttggccatcgtggtagtaaacctgatcacagtcacactggtgattgtcaagacccagcgagctgccattggcaattccatgttccaggaagtgagagccattgtgagaatcagcaagaacatcgccatcctcacaccacttctgggactgacctggggatttggagtagccactgtcatcgatgacagatccctggccttccacattatcttctccctgctcaatgcattccaggtaagtccagatgcttctgaccaagtgcaaagtgagagaattcatgaagatgttctgtga

SEQ ID NO: 39 - protein, 581 aa, Mus musculus
MKFACKAKKWHKVTETCHTLNTHSIFEEDKELYSVQSSDSTIRTHMFHRELKTIMDTLMEKCPKDLSCVIKGIERSPRMPGNIAVVVQLLHNISTTLTKDVNEEKMQSYSAMANHILNSKSISNWTFIQDRNSSCVLLQSIHSFASKLFMKEHLINISHVFIHTLGTVVSRGSLGKNFTFSMRINETSDKVTGRLLLSPEELQKVPSAFQVISIAFPTLGAILEASLLENVTVNGLVLSVILPEELKNISLIFEKIRKSGERKSQCVGWHSLESRWDWRACKTIQENSRQAVCRCRPNKLYTSFSILMSPNTLESPVLTYITYIGLGISICSLIICLAIEVLVWSQVTKTEISYLRHLCIANIAATLLMADAWFIVASFLSGPVLHHNGCVAATFFVHFFYLSVFFWMLAKALLILYGILIVFHTLPKSCLVASLFSVGYGCPLVIAIITLAVTEPGKGYLRPEACWLNWDMTKALLAFVVPALAIVVVNLITVTMVIIKTQRAAIGSSMFQEVRAIVRICKNIAILTPLLGLTWGFGIATVINGHSLAFHIIFSLLNALQVSPDAAVDSELRECVHRFCG

SEQ ID NO: 40 - DNA, 1746 bp, Mus musculus
atgaaatttgcctgtaaggccaagaaatggcacaaagtcactgaaacctgccacactctcaatacccacagcatctttgaggaggataaggaactatattcagttcaatcatctgattcaaccatacgtacacacatgtttcatagagaacttaaaaccataatggatacgttgatggaaaagtgtccaaaggatttgtcttgtgtgatcaaaggcattgagagatctcctcggatgccagggaacattgctgtggtggtgcagctcttacacaacatctcaacaactctaaccaaagacgtcaatgaggaaaagatgcagagttacagtgccatggctaaccacattcttaacagtaaaagcatatcaaattggaccttcatccaagacagaaacagcagctgtgtcttgcttcaatcaatccattcatttgcaagcaagctatttatgaaggaacatctcatcaacatatcacatgtctttattcataccttggggacggtcgtgtccaggggcagccttgggaagaatttcacgttctcaatgcgaattaatgagacaagtgataaggtcactgggaggctactgctcagccctgaagagcttcagaaggtgccttctgctttccaggtcatcagcattgctttcccaactcttggggccatcctggaggccagtcttttggaaaatgtgactgtgaatgggctcgtcctgtctgtcattttgcccgaggagcttaaaaacatctcactgatatttgaaaagatcagaaaatctggagagaggaagtcccagtgtgtgggatggcactccttggagagcagatgggactggagggcttgtaaaacgattcaagaaaactccaggcaagctgtttgccgttgtcggccgaataagttatatacttctttctccattctaatgtctcccaacacgttggaaagccctgttctaacttatattacatacataggcctgggcatttccatctgcagcttgatcatctgcctggccattgaggtcttagtctggagtcaagtgacaaagacagagatctcatatttacgtcacctgtgcatcgctaacattgcggccaccttgctgatggctgatgcgtggttcatcgtggcgtctttcctcagtggcccagtactacaccacaatggatgtgtggccgccacgttttttgttcacttcttttacctgtccgtgtttttctggatgcttgccaaggctctccttatcctctatggaattctcattgtgtttcatacactgcccaagtcgtgcctggtggcctctctgttttccgtgggctatgggtgccctttggtcatcgccattatcacacttgccgttacagagcctggaaaaggctacctccggcccgaggcctgctggcttaattgggacatgaccaaggctctcctggcctttgtagtaccagctctggccattgttgtagtaaacctgattacagtcacaatggtcatcatcaagacccagagagctgccatcggtagttccatgttccaggaagtaagagccatcgtgaggatctgtaagaacattgccatcctcacaccactgctggggctgacctggggatttgggatagccacagtcattaatggtcactccctggccttccacattatcttctccttactcaatgcactccaggtaagtccggatgctgcagtagactctgaattgagagagtgtgtgcatcggttttgtgggtag

SEQ ID NO: 41 - protein, 870 aa, Homo sapiens
MNSNLPAENLTIAVNMTKTLPTAVTHGFNSTNDPPSMSITRLFPALLECFGIVLCGYIAGRANVITSTQAKGLGNFVSRFALPALLFKNMVVLNFSNVDWSFLYSILIAKASVFFIVCVLTLLVASPDSRFSKAGLFPIFATQSNDFALGYPIVEALYQTTYPEYLQYIYLVAPISLMMLNPIGFIFCEIQKWEDTQNASQNKIKIVGLGLLRVLQNPIVFMVFIGIAFNFILDRKVPVYVENFLDGLGNSFSGSALFYLGLTMVGKIKRLKKSAFVVLILLITAKLLVLPLLCREMVELLDKGDSVVNHTSLSNYAFLYGVFPVAPGVAIFATQFNMEVEIITSGMVISTFVSAPIMYVSAWLLTFPTMDPKPLAYAIQNVSFDISIVSLISLIWSLAILLLSKKYKQLPHMLTTNLLIAQSIVCAGMMIWNFVKEKNFVGQILVFVLLYSSLYSTYLWTGLLAISLFLLKKRERVQIPVGIIIISGWGIPALLVGVLLITGKHNGDSIDSAFFYGKEQMITTAVTLFCSILIAGISLMCMNQTAQAGGYEGFDQSQSHKVVEPGNTAFEESPAPVNEPELFTSSIPETSCCSCSMGNGELHCPSIEPIANTSTSEPVIPSFEKNNHCVSRCNSQSCILAQEEEQYLQSGDQQLTRHVLLCLLLIIGLFANLYSCLWWLFNQEPGRLYVELQFFCAVFNFGQGFISFGIFGLDKHLIILPFKRRLEFLWNNKDTAENRDSPVSEEIKMTCQQFIHYHRDLCIRNIVKERRCGAKTSAGTFCGCDLVSWLIEVGLASDRGEAVIYGDRLVQGGVIQHITNEYEFRDEYLFYRFLQKSPEQSPPAINANTLQQERYKEIEHSSPPSHSPKT

SEQ ID NO: 42 - DNA, 3945 bp, Homo sapiens
agcggactttatcggaacgtgcctaagctgctgcagctggcacccggttgcgctcggcgaagagggctgggggcgggagatgacggtggtcttctccctgcttggcaccctgcgagcaccagctcccttctcctcgccactccaaggttgcagacgaagcaggtactgtcctagatgttaaggacacaacattgagcaaaaacatgcatagtccctgcttccgtgacacttgagtgaactgaatgtgcaaagtccctgtggcacaaagtccctggggccagtgtgtgtggcgggtgtagaaggagctaaagagatctggttggagttggagggtgagagaaaatgaattctaatttacctgcagagaacttaaccattgcagtcaatatgaccaagactttgcctacagcagtaacgcatggatttaattccactaatgacccaccttcaatgtcaattacaaggctttttccagccttactggaatgctttggcattgtcctttgtggctacatagcaggaagggccaatgtcataacatcaacccaggccaaaggactaggaaattttgtctccagatttgcacttccagctttattattcaaaaacatggttgtacttaatttttccaatgtggactggtccttcctatatagtatcttaattgccaaagcttctgtatttttcattgtatgtgtattaaccttattggttgccagtcctgatagtcgatttagcaaagctggactattccctatttttgctacacaaagtaatgactttgcattgggataccctatagttgaagctttatatcaaactacatacccagaatatctccagtacatttatttggtggcaccaatatctcttatgatgttaaaccctatagggtttattttctgtgaaatccaaaagtgggaagacactcaaaatgcttctcaaaataaaataaaaattgtgggactcggactcctgcgtgtattacagaacccaatagtatttatggtcttcattggcatcgccttcaattttattcttgatcgaaaggtacctgtatatgtcgaaaattttcttgatggacttggaaattctttttctggatcagccctattttatcttggtctcacgatggtgggaaaaataaagagactgaagaagtcggcatttgtagtactaattcttctcatcacagctaaacttctggtgctgccacttctgtgcagagaaatggtggaactcttggacaagggcgacagtgtggtgaaccatacaagtttatcaaattatgcatttctgtatggtgtatttcctgtagcaccaggagtggctatctttgcaacacaattcaacatggaagtagaaattataacctcagggatggtgataagcacatttgtgtctgctcccatcatgtacgtttctgcctggttactgacctttcccactatggaccctaagccattggcatatgccatccagaatgttagttttgatataagtattgtcagcctgatctccttgatctggtctctggctattcttcttttgagtaagaaatataaacagcttcctcatatgcttacaactaatttactcattgctcagtctattgtctgtgctggaatgatgatatggaattttgttaaagaaaaaaattttgttggacaaattttggtgtttgttctattgtacagctccctctatagcacctacctgtggacaggccttctagcaatttctttgtttcttttgaaaaagcgagagagggtacaaattcctgttggaataatcataatatctggctggggaattcctgctctccttgttggtgttcttttgataactggaaaacacaatggagatagcattgactcagccttcttttatggaaaagaacagatgatcaccacagcagtcaccctgttctgcagcatcctgatagctggcatatccctcatgtgcatgaaccagactgcccaagcaggaggctatgaaggtttcgatcagtctcagagccacaaagtggtggagcctggaaatactgcttttgaggagagtccagcaccagtaaatgaaccagaactttttacaagctctattccagaaacaagttgctgctcctgctccatgggaaatggtgaattacactgcccatcaatagagccaatagcaaacacaagcaccagtgagcctgtgattccttcgtttgagaaaaacaatcattgtgtgagtcgctgtaactcccagagctgcatattagcccaggaagaagaacagtatctacagagtggagaccagcaactgacccgacatgtgttgctgtgtttacttctcatcattggcctgttcgctaatctttacagttgtttatggtggctattcaaccaagagcctggaagactttatgttgagttacagtttttctgtgccgtgtttaactttggtcagggatttatttcatttggaatctttggattagataaacatttaatcatcctgcctttcaaaagaagacttgaattcctatggaacaataaagacacagcagaaaacagggattctcctgtttcagaggaaataaaaatgacctgtcaacaatttatccattatcaccgtgacctctgtatccgaaacattgtcaaagaaagaaggtgtggtgcaaagacttctgctggaactttctgtggctgtgacctggtgagctggctaattgaagtcggccttgcctccgaccgtggtgaagctgtgatatacggagacaggctggtacaagggggagtcatccaacatattaccaatgagtatgaattccgggatgagtacttgttttacagatttcttcaaaagagtcctgaacagagtcctcctgctattaatgcaaacactctccaacaggaaagatataaagaaattgagcattcatccccaccctcacattcccctaagacctaaattatgcaggggagaaccctacatggaatcatattctagccgcgtattcattagtttttagctgggtgaccttgggcaagttaacagaggcaacctctctgagcctcagttgtctcttctgtaaaatgtgaaaagatgtgctcccaccacatgcgcagggtctgtgattttacatgtatgtaaaacacataggaagctgacttaggaaaaagagaaaaccaaattaaagttctgataatgaatataatatagtcatcctttagtacccaaggggattggttccaggactcctgaagatcccaaaatctgaggatactcaagtcccttatataaaatggtgtaggccgggcatggtggctcacgcctgtaatcccagtactttgggaggccgagtcaggtggatcacctgaggtcaggagttcaagaccagcctggccaacatggcgaaaccccgtctctactataaaatacaaaaaattagttgggtgtggtggcgggtgcctgtaatcccagctactcaggaggctgaggcaggagaatcgcttgaatctgggaggcagaggttgctgtgagccgagatcgtgccactgcactccagcctgagcaacagagcaagactctatctcaaaaataaaataaaataaaataaaataaaataattaataaaatggtgtagtatttgcatataacctatgcacattctcccatatagtttaatcatctttagatacttataatgcctaatacaatgtaaatgctatgtaaatagttgttgttatactgtattgtttagggaataacaataagaaaaacagtctgtacatgttcactacagatgcaaccattgttaagcctgactacatctttttatctgcagttgattgaatctatggatgtggaacctgtgcatatggagggtcaactgtactataaataatacgaatatgccaacattatataatcattgctttctgcaaaaaaaaaaaaaaa

SEQ ID NO: 43 - protein, 693 aa, Mus musculus
MMLNPIGFIFCEIQKSKDTQNASQNKAKIVGLGFLRVLQNPIVFMVFVGIAFNFILDKKIPVYMENFLDGLANSFSGSALFYLGLTMVGKIRRLKKSAFVVLTLLITAKLLVLPLLCREMVELLDKGDSVVNHTSLSNYAFLYGVFPVAPGVAIFATQFNMEVEIITSGMVISTFVSAPIMYVSAWLLTFPTMDAKPLAYAIQNVSFDISIISLVSLIWSLSILLLSKKYKQLPHMLTANLLIAQTIVCAGMMIWNFVKEKNFVGQILVFVLLYSSLYSTYLWTGLLAVSLFLLKKRESVQLPVGIIIISGWGIPALLVGVLLITGKHNGDSIDSAFFYGKEQMITTAVTLFCSILIAGVSLMCMNRTTQAGHYEGFGQSQNHKPVEPGSTAFEENPAPTNEPELFPSSIPETSCCSCSLGNGELRCPSIEPVTNSSASGPMPSSFEKTDHCVSRCDSQSCILAQEEEQYLQSGDPQLTRHVLLCLLLIIGLFANLSSCLWWLFNHETGRLYVELQFFCAVFNFGQGFISFGIFGLDKHLIILPFKRRLEFLWNNKEAAADRESPVSEEIKMTCQQFVHYHRDLCIRNIVRERRCGAKTSAGTFCGCDLVNWLIEVGLASDRGEAVIYGDRLVQGGVIQHITNEYEFRDEYLFYRFLQKSPEQSPPARTLRDHQEESYKEIGHSSPPSVSPKT

SEQ ID NO: 44 - DNA, 2079 bp, Mus musculus
atgatgctaaaccccatagggtttatcttctgtgaaatccagaagtcaaaagacactcaaaatgcttctcaaaataaagcaaaaattgtgggacttggatttctacgcgtgttacagaacccgatagtatttatggtctttgttggcattgccttcaattttattcttgataaaaagatcccagtatatatggaaaactttctggatgggcttgcaaattccttctctggatcagccctgttttatcttggtctgaccatggtaggaaaaatcaggcgactgaagaagtcggcgtttgtggttcttactcttctcatcacagccaaactcctggtgctgcccctcctgtgcagagaaatggtggaactcctggacaagggggacagcgtagtgaaccatacaagcctgtccaactatgcgtttctatatggtgtcttccctgtggctccaggagtggctatctttgcaacacagttcaacatggaagtggagattataacctcaggcatggtaataagtacatttgtgtctgctccaatcatgtatgtttctgcctggttattaacctttcctaccatggatgccaagccactggcgtatgccattcagaatgttagctttgatataagtattatcagcctggtctccttgatctggtccctgtctattcttctcttgagtaagaaatataagcagctcccacatatgctcacagcgaacttactcatcgctcagactattgtttgtgctggaatgatgatatggaattttgttaaagaaaaaaattttgttggacaaattttggtgtttgttttattgtacagctccctgtacagcacctatctgtggacaggccttctagcagtttctttgtttcttttaaagaagcgcgagagcgttcagctcccggtgggaatcatcatcatctctggctgggggatccctgctctccttgtgggcgtgcttctgataactggaaaacacaacggagacagcattgactcagccttcttttatggaaaagagcagatgatcaccacggcagtcaccctgttctgcagcattctcatagctggggtgtcactcatgtgcatgaaccgcaccacccaagctggtcactacgaaggtttcggccagtctcagaaccacaaaccagtagagcctggaagcactgcgtttgaggagaacccagcaccaacaaatgaaccagaactcttcccaagttctatcccagaaacaagttgctgttcttgctccttgggaaatggtgaattacgctgcccatccatagagccagtaacgaactcaagtgctagtgggcctatgccttcttcctttgagaaaaccgaccactgtgtgagccgttgtgactcccagagctgcatcctcgcccaggaagaagagcagtacctgcagagcggagacccacagctgacccggcacgtcctgttgtgcttgctgcttatcatcggcctctttgctaatctctccagctgcctgtggtggttgttcaaccacgagacgggacggctctatgttgaattacagtttttctgtgccgtgtttaactttggccagggatttatttcctttggaatctttgggctggacaaacatctaatcatcctacctttcaaaagaaggcttgaattcctgtggaacaacaaagaagcagcagcagacagagaatcccccgtttccgaggaaataaaaatgacctgtcaacagtttgtgcattatcaccgcgacctgtgcatccgaaacatcgtcagagaaaggaggtgtggtgccaagacttctgccgggaccttctgtggctgtgacctggtgaactggctcatcgaagtcggccttgcttctgaccgcggcgaagctgtgatctacggagacagactggtgcaagggggggtcatccaacacatcaccaatgaatacgagttccgggacgagtatctcttttaccgattccttcagaagagtcctgagcagagtcctcctgcccgtactctaagagaccaccaggaggaaagctataaagaaatcggtcactcatctccaccctcagtctcccctaagact

SEQ ID NO: 45 - protein, 706 aa, Homo sapiens
MSYFTWKSKEGLKVYVNGTLSTSDPSGKVSRDYGESNVNLVIGSEQDQAKCYENGAFDEFIIWERALTPDEIAMYFTAAIGKHALLSSTLPSLFMTSTASPVMPTDAYHPIITNLTEERKTFQSPGVILSYLQNVSLSLPSKSLSEQTALNLTKTFLKAVGEILLLPGWIALSEDSAVVLSLIDTIDTVMGHVSSNLHGSTPQVTVEGSSAMAEFSVAKILPKTVNSSHYRFPAHGQSFIQIPHEAFHRHAWSTVVGLLYHSMHYYLNNIWPAHTKIAEAMHHQDCLLFATSHLISLEVSPPPTLSQNLSGSPLITVHLKHRLTRKQHSEATNSSNRVFVYCAFLDFSSGEGVWSNHGCALTRGNLTYSVCRCTHLTNFAILMQVVPLELARGHQVALSSISYVGCSLSVLCLVATLVTFAVLSSVSTIRNQRYHIHANLSFAVLVAQVLLLISFRLEPGTTPCQVMAVLLHYFFLSAFAWMLVEGLHLYSMVIKVFGSEDSKHRYYYGMGWGFPLLICIISLSFAMDSYGTSNNCWLSLASGAIWAFVAPALFVIVVNIGILIAVTRVISQISADNYKIHGDPSAFKLTAKAVAVLLPILGTSWVFGVLAVNGCAVVFQYMFATLNSLQGLFIFLFHCLLNSEVRAAFKHKIKVWSLTSSSARTSNAKPFHSDLMNGTRPGMASTKLSPWDKSSHSAHRVDLSAV

SEQ ID NO: 46 - DNA, 2139 bp, Homo sapiens
ggcccctattggactcatgtcctattttacatggaaatccaaggagggcctgaaagtctacgtcaacgggaccctgagcacctctgatccgagtggaaaagtgtctcgtgactatggagagtccaacgtcaacctcgtgatagggtctgagcaggaccaggccaagtgttatgagaacggtgctttcgatgagttcatcatctgggagcgggctctgactccggatgagatcgccatgtacttcactgctgccattggaaagcatgctttattgtcttcaacgctgccaagcctcttcatgacatccacagcaagccccgtgatgcccacagatgcctaccatcccatcataaccaacctgacagaagagagaaaaaccttccaaagtcccggagtgatactgagttacctccaaaatgtatccctcagcttacccagtaagtccctctcggagcagacagccttgaatctcaccaagaccttcttaaaagccgtgggagagatccttctactgcctggttggattgctctgtcagaggacagcgccgtggtactgagtctcatcgacactattgacaccgtcatgggccatgtatcctccaacctgcacggcagcacgccccaggtcaccgtggagggctcctctgccatggcagagttttccgtggccaaaatcctgcccaagaccgtgaattcctcccattaccgcttcccggcccacgggcagagcttcatccagatcccccacgaggccttccacaggcacgcctggagcaccgtcgtgggtctgctgtaccacagcatgcactactacctgaacaacatctggcccgcccacaccaagatcgcggaggccatgcatcaccaggactgcctgctgttcgccaccagccacctgatttccctggaggtgtccccaccacccaccctgtctcagaacctgtcgggctctccactcattacggtccacctcaagcacagattgacacgtaagcagcacagtgaggccaccaacagcagcaaccgagtcttcgtgtactgcgccttcctggacttcagctccggagaaggggtctggtcgaaccacggctgtgcgctcacgagaggaaacctcacctactccgtctgccgctgcactcacctcaccaactttgccatcctcatgcaggtggtcccgctggagcttgcacgcggacaccaggtggcgctgtcgtctatcagctatgtgggctgctccctctccgtgctctgcctggtggccacgctggtcaccttcgccgtgctgtcctccgtgagcaccatccggaaccagcgctaccacatccacgccaacctgtccttcgccgtgctggtggcccaggtcctgctgctcattagtttccgcctcgagccaggcacgaccccctgccaagtgatggccgtgctcctacactacttcttcctgagtgccttcgcatggatgctggtggaggggctgcacctctacagcatggtgatcaaggtctttgggtcggaggacagcaagcaccgttactactatgggatgggatggggttttcctcttctgatctgcatcatttcactgtcatttgccatggacagttacggaacaagcaacaattgctggctgtcgttggcgagtggcgccatctgggcctttgtagcccctgccctgtttgtcatcgtggtcaacattggcatcctcatcgctgtgaccagagtcatctcacagatcagcgccgacaactacaagatccatggagaccccagtgccttcaagttgacggccaaggcagtggccgtgctgctgcccatcctgggtacctcgtgggtctttggcgtgcttgctgtcaacggttgtgctgtggttttccagtacatgtttgccacgctcaactccctgcagggactgttcatattcctctttcattgtctcctgaattcagaggtgagagccgccttcaagcacaaaatcaaggtctggtcgctcacgagcagctccgcccgcacctccaacgcgaagcccttccactcggacctcatgaatgggacccggccaggcatggcctccaccaagctcagcccttgggacaagagcagccactctgcccaccgcgtcgacctgtcagccgtgtgagc

SEQ ID NO: 47 - protein, 630 aa, Mus musculus
MYFTAAIGKHALLSSTPPAMPTAHTVIPTDAYHPIITNLTEERKRFQRPGTVLRYLQNVSLRLPNKSLSEETALNLTETFLRTVGEVLLLPSWTHESEDNAMTLGLVDTMDTVMGHISSNIQSRDPHVIVTGSSSSAEFTVAKVLPPALSAPHYRFPAHGHSYIEIPREALHSQAWTTIVGLLYHTMHYYLKNIHPTSTEIPEAVNCRDCLLSVASHLISLEVSPPPTLSQNLSGSPLITVHLRHKLTQKQYSDATNESNRLFLYCAFLNFSSGEGVWSSQGCALTEGNLTYSVCHCTHLTNFAILMQVVPLKLTHGHQVALSSISYVGCSLSVLCLAATLVTFAVLSSVSTIRNQRYHIHANLSFAVLVAQVLLLISFSMEPGTVPCQVLAVLLHYFFLTAFAWMLVEGLHLYSMVIKVFGSEDSKHLYYYGIGWGCPLLICIISISSSMDSYGTSDSCWLALGSGAIWAFVGPALLVIVVNIVILVAVTRVISHISTDSYKIHGDPSAFKLTAKAVAVLLPILGTSWVFGVLAVSDRALVFQYMFAILNSLRGLFIFLFHCLLNSEVRAAFKHKTKVWSLTSSSARTANTKPFSSDTVNGTRPGTASTKLSPWDKSSHSAHRVDLSAV

SEQ ID NO: 48 - DNA, 1890 bp, Mus musculus
atgtactttaccgctgccattggtaaacatgctctgttgtcttcaacaccaccagcgatgcccaccgcacacaccgtgatacccacagatgcctaccaccctatcatcaccaacctgaccgaggagagaaaacgcttccagagaccgggaactgtgctgagataccttcaaaatgtgtccctccgcttgcccaataaatccctctcagaggaaacggcgctgaacctcacagagaccttcttaagaacggtgggtgaggtcctcctactgcccagctggacccatgaatcagaggacaacgccatgacgctgggcctggttgacaccatggataccgtcatgggccacatatcatccaacatacagtccagagatccccatgtcatcgtcacaggctcgtcgtcctcggcagaattcactgtggccaaggtcctcccaccagcgctcagtgctccccactatagattcccagcccatgggcatagctacattgaaattccgagagaggcccttcacagccaagcctggaccacgattgtcggccttctctaccacaccatgcactattatctgaaaaacatccacccaaccagcacagagatccccgaggctgtgaactgcagagactgcctgctgtctgtcgccagccacctgatctccctggaggtgtccccaccacccactctgtcccagaacctatccggctctcctctgatcactgtgcatctcagacacaaactgactcaaaagcagtacagcgatgccaccaatgagagcaaccgtctcttcctgtattgcgccttccttaacttcagctccggggaaggcgtctggtccagccagggctgtgcactcacagaaggaaatctcacttattcagtgtgccactgcacacacctcaccaacttcgccatcctcatgcaagtggtcccactgaagctcacacatggacaccaggtggcgctgtcgtccatcagttacgttggctgctctctgtcagttctctgcctggctgccaccctggtcaccttcgcagtactgtcttctgtcagcaccattcggaaccagcgttaccacatccacgccaacctgtccttcgctgtcctggtagcccaggtcttgctgctgatcagcttcagcatggagcctggcacggtcccgtgccaggtgctggctgtcctcctacattacttcttcctgaccgcctttgcttggatgctggtggagggactacatctctacagcatggtgataaaggtcttcggctcagaggacagcaagcacctctactactatgggataggctgggggtgccctctcctcatctgcatcatctccatatcatcctctatggacagctatgggacaagtgacagctgctggctggctctggggagtggcgctatttgggcctttgtgggcccggctctgttggtcattgtggtcaacattgttatcctggttgctgtgacgagggtcatctcccacatcagcactgatagctacaagatacatggggaccccagtgccttcaagttgacagccaaggctgtggctgtgctgctacccattctggggacctcatgggtatttggggtgcttgccgtcagtgaccgggccctggtcttccaatacatgtttgctatactcaactctttacggggcctcttcatctttctctttcactgtctcctgaactcagaggtaagggctgccttcaagcacaagaccaaggtctggtccctcacgagcagctctgcccggaccgcgaacacgaagcctttcagttcagacaccgtcaatgggacccgtccaggcacggcatctacaaagctaagcccttgggataagagcagccattctgcccaccgtgtcgacctatccgctgtg

SEQ ID NO: 49 - protein, 549 aa, Homo sapiens
MATPRGLGALLLLLLLPTSGQEKPTEGPRNTCLGSNNMYDIFNLNDKALCFTKCRQSGSDSCNVENLQRYWLNYEAHLMKEGLTQKVNTPFLKALVQNLSTNTAEDFYFSLEPSQVPRQVMKDEDKPPDRVRLPKSLFRSLPGNRSVVRLAVTILDIGPGTLFKGPRLGLGDGSGVLNNRLVGLSVGQMHVTKLAEPLEIVFSHQRPPPNMTLTCVFWDVTKGTTGDWSSEGCSTEVRPEGTVCCCDHLTFFALLLRPTLDQSTVHILTRISQAGCGVSMIFLAFTIILYAFLRLSRERFKSEDAPKIHVALGGSLFLLNLAFLVNVGSGSKGSDAACWARGAVFHYFLLCAFTWMGLEAFHLYLLAVRVFNTYFGHYFLKLSLVGWGLPALMVIGTGSANSYGLYTIRDRENRTSLELCWFREGTTMYALYITVHGYFLITFLFGMVVLALVVWKIFTLSRATAVKERGKNRKKVLTLLGLSSLVGVTWGLAIFTPLGLSTVYIFALFNSLQGVFICCWFTILYLPSQSTTVSSSTARLDQAHSASQE

SEQ ID NO: 50 - DNA, 1650 bp, Homo sapiens
atggcgacgcccaggggcctgggggccctgctcctgctcctcctgctcccgacctcaggtcaggaaaagcccaccgaagggccaagaaacacctgcctggggagcaacaacatgtacgacatcttcaacttgaatgacaaggctttgtgcttcaccaagtgcaggcagtcgggcagcgactcctgcaatgtggaaaacttgcagagatactggctaaactacgaggcccatctgatgaaggaaggtttgacgcagaaggtgaacacgcctttcctgaaggctttggtccagaacctcagcaccaacactgcagaagacttctatttctctctggagccctctcaggttccgaggcaggtgatgaaggacgaggacaagccccctgacagagtgcgacttcccaagagcctttttcgatccctgccaggcaacaggtctgtggtccgcttggccgtcaccattctggacattggtccagggactctcttcaagggcccccggctcggcctgggagatggcagcggcgtgttgaacaatcgcctggtgggtttgagtgtgggacaaatgcatgtcaccaagctggctgagcctctggagatcgtcttctctcaccagcgaccgccccctaacatgaccctcacctgtgtattctgggatgtgactaaagggaccactggagactggtcttctgagggctgctccacggaggtcagacctgaggggaccgtgtgctgctgtgaccacctgacctttttcgccctgctcctgagacccaccttggaccagtccacggtgcatatcctcacacgcatctcccaggcgggctgtggggtctccatgatcttcctggccttcaccattattctttatgcctttctgaggctttcccgggagaggttcaagtcagaagatgccccaaagatccacgtggccctgggtggcagcctgttcctcctgaatctggccttcttggtcaatgtggggagtggctcaaaggggtctgatgctgcctgctgggcccggggggctgtcttccactacttcctgctctgtgccttcacctggatgggccttgaagccttccacctctacctgctcgctgtcagggtcttcaacacctacttcgggcactacttcctgaagctgagcctggtgggctggggcctgcccgccctgatggtcatcggcactgggagtgccaacagctacggcctctacaccatccgtgatagggagaaccgcacctctctggagctatgctggttccgtgaagggacaaccatgtacgccctctatatcaccgtccacggctacttcctcatcaccttcctctttggcatggtggtcctggccctggtggtctggaagatcttcaccctgtcccgtgctacagcggtcaaggagcgggggaagaaccggaagaaggtgctcaccctgctgggcctctcgagcctggtgggtgtgacatgggggttggccatcttcaccccgttgggcctctccaccgtctacatctttgcacttttcaactccttgcaaggtgtcttcatctgctgctggttcaccatcctttacctcccaagtcagagcaccacagtctcctcctctactgcaagattggaccaggcccactccgcatctcaagaatag

SEQ ID NO: 51 - protein, 542 aa, Mus musculus [sequence omitted]

SEQ ID NO: 52 - DNA, 1982 bp, Mus musculus
atggcgacagccaggagtctgggcctcctgttctttctgctgctgacttcagatgaggagaccacggaagagccgaggaatgtctgccgtcggcttcaggagggccacgagtatgacaccttcgacttgaatgacactgctcagtgtttcaccaagtgtgggcaatcggagcacagcccctgtgacgtggggaacctgcagagatactggttgaactatgagtcctacctgctggagaattccatggagactgtggacatgccttttgttaaggcattgatccagaacatcagcacggatgtctcagaagacctgctgtactctctgatgctttcccagatcccgaggcaggtgatgcagggtgaggacgagcctgctgatggagtccgacttcccaagagcctgtttggagccctgcctggcaacaggtctgcagtccggttggccataactgttctagacattggtgcagggaatgtctttaagggccccaagctccttgaggacaagggcagcagcgtgttgaacaaccgcatggtgggtttgagcgtgggccagatgcacgccaccgggctgtcggaacctgtagagatcaccttctcccatgagcgtcaaccacctaacgtgatcctcacctgtgtattctgggatatggctaaaggagactgggattcccacggctgctccacggtgcccggggatgggagaactgtctgccgttgcgaccacttgaccttcttcgccttgctgctgaggccgatcttggacctggccacggcacagactctcactcgcatctcccaggcaggcagtgccgtctccatgatcttcctggccttcaccatggtgctctatgttgccttcaggttctctctgcagaggttcaagtctgaagatgcccctaagatccacatggctctgagcatcagcctgtttctcctgaatcttaccttcctgatcaatgtggggagcagctcccaaggccccccagcctcctgctgggtccgagctgccattttccactactttctgctctgtgtcttcacctggatgggtctggaggccttccacctctacctgctggccatcagagtcttcaatacctactttggacactatttcctgaagctgagcctgctggcctggggcctgcctgttcttgtagttattggtgctggaagtagcaacagttatggagtttacaccattcgcgaccaggagaaccgcacatcactggagttgtgctggttccagaaagagcctgctctttatgctactgtccacggctacttccttgttaccttcctcttcggtgctgtggtactggctttggtggcctggaagatcttcactctgcccagtgtcacagcgggcaaaggacaggggccgacctggaagtcggtcctcaccgtgctgggcctctccagtctggtgggcatgacctgggggctggctgttctcacccccctcggcttgtctaccatctacgtcttcaccctcttaaactctctacaagggctcttcatcttctgctggttcatcatcctctacttccctactcagagcaccacagcctcctcctccggcaccgcccgcctggaccaggcccactccgtgtcccaggagtagatgatgggtggctgcagtttgctctcacttctggctggtttgtgtgaccttgaacagctccctacttccttctgggctccactgtcttctctgtacaggatgtccaaggacggagagggtgaggaccaagccaggccctgtggcttcaaagttcccattcaggaggctggagacttgacttgaagaggacactggttcagttcccagcacccacataacatctctcagctgtctgtgactctagttccaagagatctgacgctgtcctctggtctccaaagagtaccaggcatgaatgtgctggatatatacatgtgccactcatacatataaaatagaaaaaaaaaaaaaaa

SEQ ID NO: 53 - protein, 353 aa, Homo sapiens
MEHTHAHLAANSSLSWWSPGSACGLGFVPVVYYSLLLCLGLPANILTVIILSQLVARRQKSSYNYLLALAAADILVLFFIVFVDFLLEDFILNMQMPQVPDKIIEVLEFSSIHTSIWITVPLTIDRYITVCHPLKYHTVSYPARTRKVIVSVYITCFLTSIPYYWWPNIWTEDYISTSVHHVLIWIHCFTVYLVPCSIFFILNSIIVYKLRRKSNFRLRGYSTGKTTAILFTITSIFATLWAPRIIMILYHLYGAPIQNRWLVHIMSDIANMLALLNTAINFFLYCFISKRFRTMAAATLKAFFKCQKQPVQFYTNHNFSITSSPWISPANSHCIKMLVYQYDKNGKPIKVSP

SEQ ID NO: 54 - DNA, 2273 bp, Homo sapiens
ctgcatcttctcccctgaaagtggagccaagcgaggcggctgggaccccctcctcttccgcatccctcccaccccacacacactccgcttccaggcagccgctgattggctgcggggagcggcgtcccagccccccggctttgaggcgggagtggagcgggtccgaggtgggaggcgcacagacgggctccgggagcccctcccgaggccccgcgcagcgcgccccgcaccctgcgccccgcgccctgcgggagggctgagccaagactccaggcgggcaggtgcggagcgagcagaggggatcacggccaagggtaggagccagtcctgcggggagagaggcgctgctgctccagctgccgctgcctccgccgccgccaccaccgagccggcgaccagagtcgggctggcaggccgggcgcgaagcggcaaggggagcgaggggcgcgctcatggagcacacgcacgcccacctcgcagccaacagctcgctgtcttggtggtcccccggctcggcctgcggcttgggtttcgtgcccgtggtctactacagcctcttgctgtgcctcggtttaccagcaaatatcttgacagtgatcatcctctcccagctggtggcaagaagacagaagtcctcctacaactatctcttggcactcgctgctgccgacatcttggtcctctttttcatagtgtttgtggacttcctgttggaagatttcatcttgaacatgcagatgcctcaggtccccgacaagatcatagaagtgctggaattctcatccatccacacctccatatggattactgtaccgttaaccattgacaggtatatcactgtctgccacccgctcaagtaccacacggtctcatacccagcccgcacccggaaagtcattgtaagtgtttacatcacctgcttcctgaccagcatcccctattactggtggcccaacatctggactgaagactacatcagcacctctgtgcatcacgtcctcatctggatccactgcttcaccgtctacctggtgccctgctccatcttcttcatcttgaactcaatcattgtgtacaagctcaggaggaagagcaattttcgtctccgtggctactccacggggaagaccaccgccatcttgttcaccattacctccatctttgccacactttgggccccccgcatcatcatgattctttaccacctctatggggcgcccatccagaaccgctggctggtacacatcatgtccgacattgccaacatgctagcccttctgaacacagccatcaacttcttcctctactgcttcatcagcaagcggttccgcaccatggcagccgccacgctcaaggctttcttcaagtgccagaagcaacctgtacagttctacaccaatcataacttttccataacaagtagcccctggatctcgccggcaaactcacactgcatcaagatgctggtgtaccagtatgacaaaaatggaaaacctataaaagtatccccgtgattccataggtgtggcaactactgcctctgtctaatccatttccagatgggaaggtgtcccatcctatggctgagcagctctccttaagagtgctaatccgatttcctgtctcccgcagactgggcaattctcagactggtagatgagaagagatggaagagaagaaaggagagcatgaagcttgtttttacttatgcatttatttccacagagtcgtaatgacagcaaaagctcctaccagtttgaagatgccattggagcttgtgtcatcatcctgtgaccagttaggacacaaagtagagaagtagtctgtgatttcgccctggtaccatccacagtcactgggaacccttcatttatgggacttaccaagccccagtagcacatagctgagcctgcactcttcttccgagagctgaggtcattcatcacttccctctgctgttcccaggagctaacaataatgactatttcaggatttttttcaaggtgccctttgtcctagagagggttgtggtcttgaattggctctggcactcctagcttcagaatgacactgtgggaatagaagagtattggatcccatccaaactgtggccagagcttcttcaggaaatctccaaacccgcatagctgtgacctcaaacctggggtctaaaaggcagttttctatttatcattatgtatagattttctctatctcctccaaaacaaagaccctgcctggtgcgcagggggaaaggaggaattctcgagccc

SEQ ID NO: 55 - protein, 345 aa, Mus musculus
MEHTHAHLAANSSACGLGFVPVVYYSFLLCLGLPANILTVIILSQLVARRQKSSYNYLLALAAADILVLFFIVFVDFLLEDFILTMQMPLIPDKIIEVLEFSSIHTSIWITVPLTVDRYIAVCHPLKYHTVSYPARTRKVILSVYITCFLTSIPYYWWPNIWTEDYISTSMHHVLVWIHCFTVYLVPCSIFFILNSIIVYKLRRKSNFRLRGYSTGKTTAILFTITSIFATLWAPRIIMILYHLYGAPIQNPWLVHIMLDVANMLALLNTAINFFLYCFISKRFRTMAAATLKALFKCQKQPVQFYTNHNFSITSSPWISPANSHCIKMLVYQYDKHGKPIKVSP

SEQ ID NO: 56 - DNA, 1038 bp, Mus musculus
atggagcacacgcacgcccacctcgctgcgaatagctcggcttgcggcttaggcttcgtgccggtggtctactacagcttcttgctgtgcctcgggttaccagcaaatatcttgacagtcattatcctctctcaactggtagccagaagacagaagtcctcctacaactatcttctggcacttgctgctgctgacatcttggtcctctttttcattgtctttgtggatttcttgttagaagatttcattttgaccatgcagatgcctctgatccctgacaagatcatagaagttctagagttctcctccatccacacttctatttggattacggtccccttaacggttgacaggtatatcgctgtctgtcacccactcaaataccacacagtttcctacccagccaggacccggaaagtcattctgagtgtttacataacttgcttcctgaccagtatcccctactactggtggcctaacatctggaccgaagactacatcagcacctccatgcatcatgtccttgtctggatccactgtttcaccgtgtacctggtgccctgctccatcttcttcatcttgaactccatcattgtgtacaagcttaggagaaagagcaatttccgcctccgtggctattccacagggaagaccactgccatcttgtttaccattacctccatcttcgccaccctctgggccccccgcatcatcatgattctctaccacctctacggagcacccatccagaacccttggctggtccacatcatgttggatgttgccaacatgctagcccttctgaacacagccatcaacttctttctctactgcttcatcagcaagcgcttccgtaccatggcagctgccacactcaaggccttgttcaagtgtcagaagcagcctgtacagttctataccaaccataacttttccataacaagtagtccctggatctcaccagcaaactcacactgcatcaagatgctggtgtaccagtatgacaaacatggaaagcctataaaagtatccccgtga

SEQ ID NO: 57 - protein, 470 aa, Homo sapiens
MDTTMEADLGATGHRPRTELDDEDSYPQGGWDTVFLVALLLLGLPANGLMAWLAGSQARHGAGTRLALLLLSLALSDFLFLAAAAFQILEIRHGGHWPLGTAACRFYYFLWGVSYSSGLFLLAALSLDRCLLALCPHWYPGHRPVRLPLWVCAGVWVLATLFSVPWLVFPEAAVWWYDLVICLDFWDSEELSLRMLEVLGGFLPFLLLLVCHVLTQATACRTCHRQQQPAACRGFARVARTILSAYVVLRLPYQLAQLLYLAFLWDVYSGYLLWEALVYSDYLILLNSCLSPFLCLMASADLRTLLRSVLSSFAAALCEERPGSFTPTEPQTQLDSEGPTLPEPMAEAQSQMDPVAQPQVNPTLQPRSDPTAQPQLNPTAQPQSDPTAQPQLNLMAQPQSDSVAQPQADTNVQTPAPAASSVPSPCDEASPTPSSHPTPGALEDPATPPASEGESPSSTPPEAAPGAGPT

SEQ ID NO: 58 - DNA, 1413 bp, Homo sapiens
atggacactaccatggaagctgacctgggtgccactggccacaggccccgcacagagcttgatgatgaggactcctacccccaaggtggctgggacacggtcttcctggtggccctgctgctccttgggctgccagccaatgggttgatggcgtggctggccggctcccaggcccggcatggagctggcacgcgtctggcgctgctcctgctcagcctggccctctctgacttcttgttcctggcagcagcggccttccagatcctagagatccggcatgggggacactggccgctggggacagctgcctgccgcttctactacttcctatggggcgtgtcctactcctccggcctcttcctgctggccgccctcagcctcgaccgctgcctgctggcgctgtgcccacactggtaccctgggcaccgcccagtccgcctgcccctctgggtctgcgccggtgtctgggtgctggccacactcttcagcgtgccctggctggtcttccccgaggctgccgtctggtggtacgacctggtcatctgcctggacttctgggacagcgaggagctgtcgctgaggatgctggaggtcctggggggcttcctgcctttcctcctgctgctcgtctgccacgtgctcacccaggccacagcctgtcgcacctgccaccgccaacagcagcccgcagcctgccggggcttcgcccgtgtggccaggaccattctgtcagcctatgtggtcctgaggctgccctaccagctggcccagctgctctacctggccttcctgtgggacgtctactctggctacctgctctgggaggccctggtctactccgactacctgatcctactcaacagctgcctcagccccttcctctgcctcatggccagtgccgacctccggaccctgctgcgctccgtgctctcgtccttcgcggcagctctctgcgaggagcggccgggcagcttcacgcccactgagccacagacccagctagattctgagggtccaactctgccagagccgatggcagaggcccagtcacagatggatcctgtggcccagcctcaggtgaaccccacactccagccacgatcggatcccacagctcagccacagctgaaccctacggcccagccacagtcggatcccacagcccagccacagctgaacctcatggcccagccacagtcagattctgtggcccagccacaggcagacactaacgtccagacccctgcacctgctgccagttctgtgcccagtccctgtgatgaagcttccccaaccccatcctcgcatcctaccccaggggcccttgaggacccagccacacctcctgcctctgaaggagaaagccccagcagcaccccgccagaggcggccccgggcgcaggccccacgtga

SEQ ID NO: 59 - protein, 511 aa, Mus musculus
MDTAVEANLGAAGHGPRTELSDEDYYPQGSWDTVFLVALLLLGLPANGLMAWLAGSQARHGAGTRLALLLLSLALSDFLFLAAATFQILEIQHGGHWPLGTAACRFYYFLWGVSYSSGLFLLTALSLDRCLLALCPRWYPGHRPARLPLWVCAGVWVLATLFSVPWLVFPEAAVWWYDLVICLDFWDTEELPLRMLEILGGFLPFLLLLVCHVLTQATACRTCCGHQPRRMACHGFARVAKTILSAYVVLRLPYQLAQLLYLAFLWDVYPGYLLWEALVYSDYLILLNSCLSPFLCLAASADLRALLRTVLSSFAAAVCEERPGSFIPAEPQTLPGPTSEGQSRLDSVVQPQVNPSVQLQSDSVVQPEVSPSAQPQSDSVAQPTVGSLIQPPLDTVVQLEVNPLTQPQLDPMAQPQVNPSAQPQSKSVVQPQVDPLTQPQLDPVAQPQSNTETPIPAFGDESASNPGEENSSGPCPDPTPGTPENLDRPAVPQEKSPSNVPPEEAPSAGPT

SEQ ID NO: 60 - DNA, 1536 bp, Mus musculus
atggacactgctgtggaagccaacctgggcgctgctggccacggtccccgtacagagctcagtgatgaggactactaccctcagggcagctgggacacagtctttctggtggccttgctgctcctgggactgccagccaatgggctgatggcatggctcgctggttcacaggcccggcacggagctggcacaagattggccttgctcctgctcagcttggccctctctgacttcttattcctggcagcagcaactttccaaatcctggaaatccagcatggagggcattggccactgggcactgctgcctgccgcttctactacttcctgtggggtgtgtcctattcctctggcctcttcctattgacagcgctcagcctggaccgctgcttgctggcactgtgccctcgatggtaccctgggcaccgtccagcccgcctgcccctctgggtgtgcgctggggtctgggtgctggccacactcttcagtgtgccctggttggtcttccctgaggctgctgtctggtggtatgacctggtcatctgcctggacttctgggacaccgaggagctgcctctgcggatgcttgagatcttggggggcttcctgcccttcctcttgctgctggtctgccatgtgctcacccaagccactgcttgtaggacctgttgtggacatcagcctaggcgcatggcctgccacggctttgcccgtgtggccaagaccattttgtcagcctatgtggtcctgaggctaccttaccagctggcacagctgctctatctggctttcttatgggatgtctaccccgggtacctgctctgggaagccctggtctattctgactacctgatcctgcttaacagctgcctgagccccttcctgtgcctggcagccagcgctgacctccgggccctgctgcgaactgtgctctcctcctttgcggctgctgtctgcgaggaacgacctggaagcttcatacctgccgagccacagactctgccgggaccaacatctgaaggccagtcaaggttggattctgtggtccagcctcaggtgaatccttctgtccagctacagtcagattctgtggtccagcctgaggtgagcccctcagcccagccacagtcagattctgtggcccagcctacggtgggctccctgatccagccaccgttggatactgtagttcaacttgaggtgaaccctctgacccagccacagttggatcccatggctcaacctcaagtgaacccctcagcccaaccacaatcaaagtctgtggtccagcctcaagtggaccccctgacccagccacagttggatcctgtagcccagccacagtcaaacacagagaccccaatccctgccttcggggacgagtcagcctctaaccctggtgaggaaaactcctctggcccatgcccagatcccactcctgggacccctgagaacctagacagaccagctgttccccaggaaaaaagccctagcaatgtccccccagaagaagcccccagtgcaggacctacttga

SEQ ID NO: 61 - protein, 609 aa, Homo sapiens
MSDERRLPGSAVGWLVCGGLSLLANAWGILSVGAKQKKWKPLEFLLCTLAATHMLNVAVPIATYSVVQLRRQRPDFEWNEGLCKVFVSTFYTLTLATCFSVTSLSYHRMWMVCWPVNYRLSNAKKQAVHTVMGIWMVSFILSALPAVGWHDTSERFYTHGCRFIVAEIGLGFGVCFLLLVGGSVAMGVICTAIALFQTLAVQVGRQADHRAFTVPTIVVEDAQGKRRSSIDGSEPAKTSLQTTGLVTTIVFIYDCLMGFPVLVVSFSSLRADASAPWMALCVLWCSVAQALLLPVFLWACDRYRADLKAVREKCMALMANDEESDDETSLEGGISPDLVLERSLDYGYGGDFVALDRMAKYEISALEGGLPQLYPLRPLQEDKMQYLQVPPTRRFSHDDADVWAAVPLPAFLPRWGSGEDLAALAHLVLPAGPERRRASLLAFAEDAPPSRARRRSAESLLSLRPSALDSGPRGARDSPPGSPRRRPGPGPRSASASLLPDAFALTAFECEPQALRRPPGPFPAAPAAPDGADPGEAPTPPSSAQRSPGPRPSAHSHAGSLRPGLSASWGEPGGLRAAGGGGSTSSFLSSPSESSGYATLHSDSLGSAS

SEQ ID NO: 62 - DNA, 1830 bp, Homo sapiens
atgagtgatgagcggcggctgcctggcagtgcagtgggctggctggtatgtgggggcctctccctgctggccaatgcctggggcatcctcagcgttggcgccaagcagaagaagtggaagcccttggagttcctgctgtgtacgctcgcggccacccacatgctaaatgtggccgtgcccatcgccacctactccgtggtgcagctgcggcggcagcgccccgacttcgagtggaatgagggtctctgcaaggtcttcgtgtccaccttctacaccctcaccctggccacctgtttctctgtcacctccctctcctaccaccgcatgtggatggtctgctggcctgtcaactaccggctgagcaatgccaagaagcaggcggtgcacacagtcatgggtatctggatggtgtccttcatcctgtcggccctgcctgccgttggctggcacgacaccagcgagcgcttctacacccatggctgccgcttcatcgtggctgagatcggcctgggctttggcgtctgcttcctgctgctggtgggcggcagcgtggccatgggcgtgatctgcacagccatcgccctcttccagacgctggccgtgcaggtggggcgccaggccgaccaccgcgccttcaccgtgcccaccatcgtggtggaggacgcgcagggcaagcggcgctcctccatcgatggctcggagcccgccaaaacctctctgcagaccacgggcctcgtgaccaccatagtcttcatctacgactgcctcatgggcttccctgtgctggtggtgagcttcagcagcctgcgggccgacgcctcagcgccctggatggcactctgcgtgctgtggtgctccgtggcccaggccctgctgctgcctgtgttcctctgggcctgcgaccgctaccgggctgacctcaaagctgtccgggagaagtgcatggccctcatggccaacgacgaggagtcagacgatgagaccagcctggaaggtggcatctccccggacctggtgttggagcgctccctggactatggctatggaggtgattttgtggccctagataggatggccaagtatgagatctccgccctggaggggggcctgccccagctctacccactgcggcccttgcaggaggacaagatgcaatacctgcaggtcccgcccacgcggcgcttctcccacgacgatgcggacgtgtgggccgccgtcccgctgcccgccttcctgccgcgctggggctccggcgaggacctggccgccctggcgcacctggtgctgcctgccgggcccgagcggcgccgcgccagcctcctggccttcgcggaggacgcaccaccgtcccgcgcgcgccgccgctcggccgagagcctgctgtcgctgcggccctcggccctggatagcggcccgcggggagcccgcgactcgccccccggcagcccgcgccgccgccccgggcccggcccccgctccgcctcggcctcgctgctgcccgacgccttcgccctgaccgccttcgagtgcgagccacaggccctgcgccgcccgcccgggcccttccccgctgcgcccgccgcccccgacggcgcagatcccggagaggccccgacgcccccaagcagcgcccagcggagcccagggccacgcccctctgcgcactcgcacgccggctctctgcgccccggcctgagcgcgtcgtggggcgagcccggggggctgcgcgcggcgggcggcggcggcagcaccagcagcttcctgagttccccctccgagtcctcgggctacgccacgctgcactcggactcgctgggctccgcgtcctag

SEQ ID NO: 63 - protein, 631 aa, Mus musculus
MSDERRLPSSAVGWLACGGLSLLANAWGILSVGAKQKKWKPLEFLLCTLAATHMLNVAVPIATYAVVQLRRQRPDYEWNEGLCKVFVSTFYTLTLATCFSVTSISYHRMWMVRWPVNYRLSNAKKQAVHTVMGIWMVSFILSALPAVGWHDTSERFYTHGCRFIVAEIGLGFGVCFLLLVGGSVAMGMVCTAIALFQTLATQVGHRADRRTFTVPTIVVEDAQGKRRSSIDGSEPARTSLQITGLVATIVVIYDCLMGFPVLVVSFSSLRADASAPWMALCVLWCSVTQALLLPLFLWTCDRYRADLKAVWEKCVALMANDEDSDNETSLEGSISPDMVLERSLDYSYGGDFVALDRMAKYELSALEGGLPQLYPLRPLQEDRMQYLQGAGRHRCGFPGGQPCFSPAGCSQVPPTRRFSHDDADVWAAVPLPTFLPRWSSGEDLAALAHLMLPAGSDRRRGSLLAFAEDAPPFRPRRRSAESLLSLQPSSLDGGPRHAQDSPPGSPRRRPGPGARSASVSLLPDAFALTAFEREPQALRRVPAPAQPFPAARDSAEPAEVPTPPGGRTQRSQGRRAARTHVGPLQSSLSASWGEPGGLHAAGCGSISSFLSSPSESSGYVTLHSDSLGSAS

SEQ ID NO: 64 - protein, 633 aa, Homo sapiens
MHTEYFCFSAASCPPCPKYASCHNSTHCTCEDGFRARSGRTYFHDSSEKCEDINECETGLAKCKYKAYCRNKVGGYICSCLVKYTLFNFLAGIIDYDHPDCYENLRRNGSREDFARRATQLIQSVELSIWNASFASPGKGQISEFDIVYETKRCNETRENAFLEAGNNTMDINCADALKGNLREHCSCPITYQSLGDILNASFFSKRKGMQEVKLNSYVVSGTVGLKEKISLSEPVFLTFRHNQPGDKRTKHICVYWEGSEGGHWSTEGCSHVHSNGSYTKCKCFHLSSFAVLVALAPKEDPVLTVITQVGLTISLLCLFLAILTFLLCRPIQNTSTSLHLELSLCLFLAHLLFLTGINRTEPEVLCSIIAGLLHFLYLACFTWMLLEGLHLFLTVRNLKVANYTSTGRFKKRFMYPVGYGIPAVIIAVSAIVGPQNYGTFTHCWLKLDKGFIWSFMGPVAVIILINLVFYFQVLWILRSKLSSLNKEVSTIQDTRVMTFKAISQLFILGCSWGLGFFMVEEVGKTIGSIIAYSFTIINTLQGVLLFVVHCLLNRQVRMEYKKWFSGMRKGVETESTEMSRSTTQTKTVRSAPSECFIGIRHLMPLEAFWFLDLKEKRNCIRFLYYAAEVSGF

SEQ ID NO: 65 - DNA, 1896 bp, Homo sapiens
atgcatactgaatatttctgtttctctgcagcttcctgtcctccatgccctaaatatgccagctgccacaacagcacccactgtacttgtgaagatggctttcgggccaggtctggcaggacatactttcatgattcctctgagaagtgtgaagatattaatgaatgtgaaaccgggctggcaaagtgcaagtataaagcatattgtaggaataaagttggaggttacatctgtagctgtttggtaaaatatactttattcaactttctggctggtattatagattatgatcatccggattgttacgaaaatctgagaagaaatggaagcagagaggactttgcaagaagggctactcaactaattcaaagcgtggagttgagcatctggaatgcgagttttgcttctccaggaaagggtcaaatttctgaatttgatatagtctatgaaaccaagaggtgcaatgagacaagggagaatgcttttctggaagctggaaataacaccatggatatcaactgtgctgatgctttaaaaggaaacctaagagagcactgcagttgccctatcacttatcaatctcttggggatattctgaatgcatccttttttagtaaacgaaaagggatgcaggaagtaaaactgaactcttacgttgtgagcggcaccgtcggtttgaaggaaaaaatttccctctctgaacctgtgttcctgacttttcgccataatcagcctggtgacaagagaacaaaacatatctgtgtctactgggagggatcagagggaggccactggtccacggagggctgctctcatgtgcacagcaacggttcttacaccaaatgcaagtgcttccatctgtccagctttgccgtcctcgtggctcttgcccccaaggaggaccctgtgctgaccgtgatcacccaggtggggctgaccatctctctgctgtgcctcttcctggccatcctcaccttcctcctgtgccggcccatccagaacaccagcacctccctccatctagagctctccctctgcctcttcctggcccacctcctgttcctgacgggcatcaacagaactgagcctgaggtgctgtgctccatcattgcagggctgctgcacttcctctacctggcttgcttcacctggatgctcctggaagggctgcacctcttcctcaccgtcaggaacctcaaggtggccaactacaccagcacgggcagattcaagaagaggttcatgtaccctgtaggctacgggatcccagctgtgattattgctgtgtcagcaatagttggaccccagaattatggaacatttacttgttggctcaagcttgataaaggattcatctggagcttcatggggccagtagcagtcattatcttgataaacctggtgttctacttccaagttctgtggattttgagaagcaaactttcctccctcaataaagaagtttccaccattcaggacaccagagtcatgacatttaaagccatttctcagctatttatcctgggctgttcttggggccttggtttttttatggttgaagaagtagggaagacgattggatcaatcattgcatactcattcaccatcatcaacacccttcagggagtgttgctctttgtggtacactgtctccttaatcgccaggttcgaatggaatataaaaagtggtttagtgggatgcggaaaggggtagaaactgaaagcactgagatgtctcgctctactacccaaaccaaaacggtaagatcagctccttctgagtgctttattggaatccgacatctcatgcctctagaagctttctggttccttgatctgaaagaaaagagaaattgcattaggttcctgtattatgcagctgaagtttctgggttt

SEQ ID NO: 66 - protein, 689 aa, Mus musculus
MLMGATRDMGSRCLLHASVPGMLLIWSILQMMNISASCPQCNENASCFNSTHCVCKEGFWTGSENRRIIEPHEKCQDINECLLKELVCKDVSYCRNKIGTYICSCVVKYPLFNWVAGIINIDHPDCYVNKSKNTGSKTHTLGVLSEFKSKEEVAKGATKLLRKVEHHILNENSDIPKKDENPLLDIVYETKRCKTMTLLEAGNNTMKVDCTSGFKEHNSGGETAVAFIAYKSLGNLLNGSFFSNEEGFQEVTLNSHIVSGAIRSEVKPVLSEPVLLTLQNIQPIDSRAEHLCVHWEGSEEGGSWSTKGCSHVYTNNSYTICKCFHLSSFAVLMALPHEEDGVLSALSVITYVGLSLSLLCLFLAAITFLLCRPIQNTSTTLHLQLSICLFLADLLFLTGINRTKPKVLCSIIAGMLHYLYLASFMWMFLEGLHLFLTVSNLKVANYSNSGRFKKRFMYPVGYGLPAFIVAVSAIAGHKNYGTHNHCWLSLHRGFIWSFLGPAAAIILINLVFYFLIIWILRSKLSSLNKEVSTLQDTKVMTFKAIVQLFVLGCSWGIGLFIFIEVGKTVRLIVAYLFTIINVLQGVLIFMVHCLLNRQVRMEYKKWFHRLRKEVESESTEVSHSTTHTKMGLSLNLENFCPTGNLHDPSDSILPSTEVAGVYLSTPRSHMGAEDVNSGTHAYWSRTISD

SEQ ID NO: 67 - protein, 695 aa, Homo sapiens
MKMKSQATMICCLVFFLSTECSHYRSKIHLKAGDKLQSPEGKPKTGRIQEKCEGPCISSSNCSQPCAKDFHGEIGFTCNQKKWQKSAETCTSLSVEKLFKDSTGASRLSVAAPSIPLHILDFRAPETIESVAQGIRKNCPFDYACITDMVKSSETTSGNIAFIVELLKNISTDLSDNVTREKMKSYSEVANHILDTAAISNWAFIPNKNASSDLLQSVNLFARQLHIHNNSENIVNELFIQTKGFHINHNTSEKSLNFSMSMNNTTEDILGMVQIPRQELRKLWPNASQAISIAFPTLGAILREAHLQNVSLPRQVNGLVLSVVLPERLQEIILTFEKINKTRNARAQCVGWHSKKRRWDEKACQMMLDIRNEVKCRCNYTSVVMSFSILMSSKSMTDKVLDYITCIGLSVSILSLVLCLIIEATVWSRVVVTEISYMRHVCIVNIAVSLLTANVWFIIGSHFNIKAQDYNMCVAVTFFSHFFYLSLFFWILFKALLIIYGILVIFRRMMKSRMMVIGFAIGYGCPLIIAVTTVAITGPVKGYMRPEACWLNWDNTKALLAFAIPAFVIVAVNLIVVLVVAVNTQRPSIGSSKSQDVVIIMRISKNVAILTPLLGLTWGFGIATLIEGTSLTFHIIFALLNAFQGFFILLFGTIMDHKIRDALRMRMSSLKGKSRAAENASLGPTNGSKLMNRQG

SEQ ID NO: 68 - DNA, 2322 bp, Homo sapiens
cccatttcaaaaatggagaagacagatcactgccactgaccaggaccgtgggaggtgccacgtgatggtgaggcatcatgctagggagctgagctctgaccttcctgctgggtgattctccacctctgggctgctagatctacttcctggatgccgtgaagatcctcatgtatgaaaatgaagtcccaggcaaccatgatttgctgcttagtgttctttctgtccacagaatgttcccactatagatccaagattcacctaaaagctggagataaacttcaaagccctgaagggaaacccaagactggaaggatccaagagaaatgcgaaggaccttgtatttcttcttccaactgcagccagccctgtgctaaggactttcatggagaaataggatttacatgtaatcaaaaaaagtggcaaaaatcagctgaaacatgtacaagcctttctgtggaaaaactctttaaggactcaactggtgcatctcgcctttctgtagcagcaccatctatacctctgcatattctagactttcgagctccagagaccattgagagtgtagctcaaggaatccgtaagaactgcccctttgattatgcctgcatcactgacatggtgaaatcatcagaaacaacatctggaaatattgcatttatagtggagttattaaaaaatatttctacagacttgtctgataatgttactcgagagaaaatgaagagctatagtgaagtggccaaccacatcctcgacacagcagccatttcaaactgggctttcattcccaacaaaaatgccagctcggatttgttgcagtcagtgaatttgtttgccagacaactccacatccacaataattctgagaacattgtgaatgaactcttcattcagacaaaagggtttcacatcaaccataatacctcagagaaaagcctcaatttctccatgagcatgaacaataccacagaagatatcttaggaatggtacagattcccaggcaagagctaaggaagctgtggccaaatgcatcccaagccattagcatagctttcccaaccttgggggctatcctgagagaagcccacttgcaaaatgtgagtcttcccagacaggtaaatggtctggtgctatcagtggttttaccagaaaggttgcaagaaatcatactcaccttcgaaaagatcaataaaacccgcaatgccagagcccagtgtgttggctggcactccaagaaaaggagatgggatgagaaagcgtgccaaatgatgttggatatcaggaacgaagtgaaatgccgctgtaactacaccagtgtggtgatgtctttttccattctcatgtcctccaaatcgatgaccgacaaagttctggactacatcacctgcattgggctcagcgtctcaatcctaagcttggttctttgcctgatcattgaagccacagtgtggtcccgggtggttgtgacggagatatcatacatgcgtcacgtgtgcatcgtgaatatagcagtgtcccttctgactgccaatgtgtggtttatcataggctctcactttaacattaaggcccaggactacaacatgtgtgttgcagtgacatttttcagccactttttctacctctctctgtttttctggattctcttcaaagcattgctcatcatttatggaatattggtcattttccgtaggatgatgaagtcccgaatgatggtcattggctttgccattggctatgggtgcccattgatcattgctgtcactacagttgctatcacagggccagtgaaaggctacatgagacctgaggcctgttggcttaactgggacaataccaaagcccttttagcatttgccatcccggcgttcgtcattgtggctgtaaatctgattgtggttttggttgttgctgtcaacactcagaggccctctattggcagttccaagtctcaggatgtggtcataattatgaggatcagcaaaaatgttgccatcctcactccactgctgggactgacctggggttttggaatagccactctcatagaaggcacttccttgacgttccatataatttttgccttgctcaatgctttccagggttttttcatcctgctgtttggaaccattatggatcacaagataagagatgctttgaggatgaggatgtcttcactgaaggggaaatcgagggcagctgagaatgcatcactaggcccaaccaatggatctaaattaatgaatcgtcaaggatgaaatgctgccccatttctcatggatgtcctgagaccaagaggggagatccaggagaaagaggcc

SEQ ID NO: 69 - protein, 698 aa, Mus musculus
MKPWIAMVCCLVFFLTTECSHSKPKTHRKDEDKFQISLQKHEFRPRQGKCDGLCSSSSSCNQSCPWNFRGEIVFTCNQNKWQKTIETCTSLSVDTLFQRIHPAASLSLASSSVFPMSLIGNAAPVHIGNVFQGIQKYCPEDYVCIVDAVKSSAVTSGNIAFIVELLKNISSNLQTSGIHDNVNWKKMKNYGKVANHILGPTAISNWAFIANKNASSDLLESVNSFAKKLQIQGKSESIVDELFIQTKGSRISHSSSEHSLSLSVPRYNATEDVLVVIEIPRQALQELSFNASQAIVVAFPTLGAILKEVHRPNTNLQKPIDDLILSLVLPEGLNEIILTFDKINKSQSTSSQCVSWDPATGQWDESPCTVMSDINSTVKCRCRHTKAVTSFSILMSSKPVKNTILNHITFIGLSISIFSLVLCLVIEAIVWSRVVVTEISYMRHVCIVNIAVSLLTANVWFIIGSNFSANVQEDHKWCVAVTFLCHFFFLSLFFWMLFKALLIVYGILVVFRRMMKSRMMAIGFAIGYGCPLVIAVITVTVTEPGEGYTRKDACWLNWNQTKALFAFAIPALAIVAVNLLVVLAVAINTQRPLIGSSKSQDMAIVFRISKNVAILTPLLGLTWGFGLTTLLEGVHLVFHIIFALLNAFQGFFILLFGTIMDHKIRDALRMRVSSLKGKSRAAEKVSLSPANGSRILNR

SEQ ID NO: 70 - protein, 910 aa, Homo sapiens
MKVGVLWLVSFFTFTDGHGGFLGKNDGIKTKKELIVNKKKHLGPVEEYQLLLQVTYRDSKEKRDLRNFLKLLKPPLLWSHGLIRIIRAKATTDCNSLNGVLQCTCEDSYTWFPPSCLDPQNCYLHTAGALPSCECHLNNLSQSVNFCERTKIWGTFKINERFTNDLLNSSSAIYSKYANGIEIQLKKAYERIKGFESVQVTQFRNGSIVAGYEVVGSSSASELLSAIEHVAEKAKTALHKLFPLEDGSFRVFGKAQCNDIVFGFGSKDDEYTLPCSSGYRGNITAKCESSGWQVIRETCVLSLLEELNKNFSMIVGNATEAAVSSFVQNLSVIIRQNPSTTVGNLASVVSILSNISSLSLASHFRVSNSTMEDVISIADNILNSASVTNWTVLLREEKYASSRLLETLENISTLVPPTALPLNFSRKFIDWKGIPVNKSQLKRGYSYQIKMCPQNTSIPIRGRVLIGSDQFQRSLPETIISMASLTLGNILPVSKNGNAQVNGPVISTVIQNYSINEVFLFFSKIESNLSQPHCVFWDFSHLQWNDAGCHLVNETQDIVTCQCTHLTSFSILMSPFVPSTIFPVVKWITYVGLGISIGSLILCLIIEALFWKQIKKSQTSHTRRICMVNIALSLLIADVWFIVGATVDTTVNPSGVCTAAVFFTHFFYLSLFFWMLMLGILLAYRIILVFHHMAQHLMMAVGFCLGYGCPLIISVITIAVTQPSNTYKRKDVCWLNWSNGSKPLLAFVVPALAIVAVNFVVVLLVLTKLWRPTVGERLSRDDKATIIRVGKSLLILTPLLGLTWGFGIGTIVDSQNLAWHVIFALLNAFQGFFILCFGILLDSKLRQLLFNKLSALSSWKQTEKQNSSDLSAKPKFSKPFNPLQNKGHYAFSHTGDSSDNIMLTQFVSNE

SEQ ID NO: 71 - DNA, 3456 bp, Homo sapiens
cagtgagcctgtgttcatgccagtgagctgctgtggctcagatactgatactttctttccaaacagcataagaagtgattgagccacaagtatactgaaggaagggctccctcgagttgtggtgtgaagagataaatcaccagtcacagactatgcacccgactgctgctgttcagtccaggggaaatgaaagttggagtgctgtggctcgtttctttcttcaccttcactgacggccacggtggcttcctggggaaaaatgatggcatcaaaacaaaaaaagaactcattgtgaataagaaaaaacatctaggcccagtcgaagaatatcagctgctgcttcaggtgacctatagagactccaaggagaaaagagacttgagaaattttctgaagctcttgaagcctccattattatggtcacatgggctaattagaattatcagagcaaaggctaccacagactgcaacagcctgaatggagtcctgcagtgtacctgtgaagacagctacacctggtttcctccctcatgccttgatccccagaactgctaccttcacacggctggagcactcccaagctgtgaatgtcatctcaacaacctcagccagagtgtcaatttctgtgagagaacaaagatttggggcactttcaaaattaatgaaaggtttacaaatgaccttttgaattcatcttctgctatatactccaaatatgcaaatggaattgaaattcaacttaaaaaagcatatgaaagaattaaaggttttgagtcggttcaggtcacccaatttcgaaatggaagcatcgttgctgggtatgaagttgttggctccagcagtgcatctgaactgctgtcagccattgaacatgttgccgagaaggctaagacagcccttcacaagctgtttccattagaagacggctctttcagagtgttcggaaaagcccagtgtaatgacattgtctttggatttgggtccaaggatgatgaatataccctgccttgcagcagtggctacaggggaaacatcacagccaagtgtgagtcctctgggtggcaggtcatcagggagacttgtgtgctctctctgcttgaagaactgaacaagaatttcagtatgattgtaggcaatgccactgaggcagctgtgtcatccttcgtgcaaaatctttctgtcatcattcggcaaaacccatcaaccacagtggggaatctggcttcggtggtgtcgattctgagcaatatttcatctctgtcactggccagccatttcagggtgtccaattcaacaatggaggatgtcatcagtatagctgacaatatccttaattcagcctcagtaaccaactggacagtcttactgcgggaagaaaagtatgccagctcacggttactagagacattagaaaacatcagcactctggtgcctccgacagctcttcctctgaatttttctcggaaattcattgactggaaagggattccagtgaacaaaagccaactcaagaggggttacagctatcagattaaaatgtgtccccaaaatacatctattcccatcagaggccgtgtgttaattgggtcagaccaattccagagatcccttccagaaactattatcagcatggcctcgttgactctggggaacattctacccgtttccaaaaatggaaatgctcaggtcaatggacctgtgatatccacggttattcaaaactattccataaatgaagttttcctatttttttccaagatagagtcaaacctgagccagcctcattgtgtgttttgggatttcagtcatttgcagtggaacgatgcaggctgccacctagtgaatgaaactcaagacatcgtgacgtgccaatgtactcacttgacctccttctccatattgatgtcaccttttgtcccctctacaatcttccccgttgtaaaatggatcacctatgtgggactgggtatctccattggaagtctcattttatgcctgatcatcgaggctttgttttggaagcagattaaaaaaagccaaacctctcacacacgtcgtatttgcatggtgaacatagccctgtccctcttgattgctgatgtctggtttattgttggtgccacagtggacaccacggtgaacccttctggagtctgcacagctgctgtgttctttacacacttcttctacctctctttgttcttctggatgctcatgcttggcatcctgctggcttaccggatcatcctcgtgttccatcacatggcccagcatttgatgatggctgttggattttgcctgggttatgggtgccctctcattatatctgtcattaccattgctgtcacgcaacctagcaatacctacaaaaggaaagatgtgtgttggcttaactggtccaatggaagcaaaccactcctggcttttgttgtccctgcactggctattgtggctgtgaacttcgttgtggtgctgctagttctcacaaagctctggaggccgactgttggggaaagactgagtcgggatgacaaggccaccatcatccgcgtggggaagagcctcctcattctgacccctctgctagggctcacctggggctttggaataggaacaatagtggacagccagaatctggcttggcatgttatttttgctttactcaatgcattccagggattttttatcttatgctttggaatactcttggacagtaagctgcgacaacttctgttcaacaagttgtctgccttaagttcttggaagcaaacagaaaagcaaaactcatcagatttatctgccaaacccaaattctcaaagcctttcaacccactgcaaaacaaaggccattatgcattttctcatactggagattcctccgacaacatcatgctaactcagtttgtctcaaatgaataaggcaaggaatcataaaatcaagaaaaaatttccagaacaacttgacatttagagacaaatgtcaatgaagaaattatgctcagtattcgatcgggttttctgatttaggggtctgggaataaaacaagaatgtctcagtggcttcattactgctcccttttgtcttcaattaaatgaaaagaagatttatttccatgtgatttgattcaaagaaagtgctccataaatgcagaagagtaggttttgttggaaatcgtgtcagttgtaccctgaccataaaatatggtttctattttcataaaacagcattattcacatggcatttccaataatctggattgaaggaagaaaattttatgaaatagctttagataaattaataggccacgttcattttcttgtcaaaaagttactggtggggggatggtgggaaaaagttattagtgcaaatttcctagagaaaaaaccatttctctttcaaattttccagttgaattttatgttcgcttttgcttcttaggttcatactccgacaac

SEQ ID NO: 72 - protein, 908 aa, Mus musculus
MRIGLLWLVPLFTLTEGTDGFLQQKNDGRRTKEIVSMVEERHPVHEYEVLLQVTYRDPEEKRELKRFLKLLRSPSPSLRGPSKIIRVKATTYCRSRKGFLECACEDSYTWFPPSCLDPQNCCLHTTGPVPSCNCSLRGLRQSVNFCERAKVWGTFEIDENFPEDLWNSSSDVYAHYTVGIENQLKEAYRRVHGFESVRVTQFRKGSIVVGYEVTGSTSPPELLFAIEQEAEKAQEALRRQFPVKYGSFRVFGKAPCNSISFGFGSENDEYTVPCSSGFTGSMTVRCQSSGWQITRESCVLSQLEELKKELRMIAGKITEAGVASLVQNLSTILLQSPSTTVGNLGSVVSLLSNISSLSLANSLTVSNLTLMNVINIADHILDSASITNWTILLQDAKDASSQLLKTLESISSLIPSMALPLNFSGKFIDWKGTPVTQIQSTRGYNYQMEMRQNASLPIRGHVFIEPDQFQKSHPKTIISMASLTFGDILPITQRGNAWVNGPVISTLIQNYSISEIFLNFSKIKGNLTQPRCVFWDFSQLQWSNAGCQLVNETLDTVLCRCSHLTSFSMLMSPFVPSSVVPVVKWITYIGLSISIASLILCLIIESLFWKQTKRSQTSYTRNICLVNIAVSLLIADVWFIIAATVDPSVSPSGVCVAAVFFTHFFYLAVFFWMLVLGILLAYRIILVFHHMALTTMMAIGFCLGYGCPLLISIITLAVTQPSNSYKRNDVCWLNWSDKSKPLLAFVVPALTIVAVNLVVVLLVLRKLWRPAVGERLNQDDKATAIRMGKSLLVLTPLLGLTWGFGIGTMANSHNLAWHVLFALLNAFQGFFIFCFGILLDTKLRQLLSNKLTTLSSWKQTSKRNASDTVTQPKCLRTFNILQHRGMYALSHTGDSSSDITLTQFLSTE

SEQ ID NO: 73 - protein, 1124 aa, Homo sapiens
MHRWVKEKNITVRDTRCVYPKSLQAQPVTGVKQELLTCDPPLELPSFYMTPSHRQVVFEGDSLPFQCMASYIDQDMQVLWYQDGRIVETDESQGIFVEKNMIHNCSLIASALTISNIQAGSTGNWGCHVQTKRGNNTRTVDIVVLESSAQYCPPERVVNNKGDFRWPRTLAGITAYLQCTRNTHGSGIYPGNPQDERKAWRRCDRGGFWADDDYSRCQYANDVTRVLYMFNQMPLNLTNAVATARQLLAYTVEAANFSDKMDVIFVAEMIEKFGRFTKEEKSKELGDVMVDIASNIMLADERVLWLAQREAKACSRIVQCLQRIATYRLAGGAHVYSTYSPNIALEAYVIKSTGFTGMTCTVFQKVAASDRTGLSDYGRRDPEGNLDKQLSFKCNVSNTFSSLALKNTIVEASIQLPPSLFSPKQKRELRPTDDSLYKLQLIAFRNGKLFPATGNSTNLADDGKRRTVVTPVILTKIDGVNVDTHHIPVNVTLRRIAHGADAVAARWDFDLLNGQGGWKSDGCHILYSDENITTIQCYSLSNYAVLMDLTGSELYTQAASLLHPVVYTTAIILLLCLLAVIVSYIYHHSLIRISLKSWHMLVNLCFHIFLTCVVFVGGITQTRNASICQAVGIILHYSTLATVLWVGVTARNIYKQVTKKAKRCQDPDEPPPPPRPMLRFYLIGGGIPIIVCGITAAANIKNYGSRPNAPYCWMAWEPSLGAFYGPASFITFVNCMYFLSIFIQLKRHPERKYELKEPTEEQQRLAANENGEINHQDSMSLSLISTSALENEHTFHSQLLGASLTLLLYVALWMFGALAVSLYYPLDLVFSFVFGATSLSFSAFFVVHHCVNREDVRLAWIMTCCPGRSSYSVQVNVQPPNSNGTNGEAPKCPNSSAESSCTNKSASSFKNSSQGCKLTNLQAAAAQCHANSLPLNSTPQLDNSLTEHSMDNDIKMHVAPLEVQFRTNVHSSRHHKNRSKGHRASRLTVLREYAYDVPTSVEGSVQNGLPKSRLGNNEGHSRSRRAYLAYRERQYNPPQQDSSDACSTLPKSSRNFEKPVSTTSKKDALRKPAVVELENQQKSYGLNLAIQNGPIKSNGQEGPLLGTDSTGNVRTGLWKHETTV

SEQ ID NO: 74 - DNA, 3738 bp, Homo sapiens
ccagatactctgcccaaccgcacggtcaccctgattctgagtaacaataagatatccgagctgaagaatggctcattttctgggttaagtctccttgaaagattggacctccgaaacaatcttattagtagtatagatccaggtgccttctggggactgtcatctctaaaaagattggatctgacaaacaatcgaataggatgtctgaatgcagacatatttcgaggactcaccaatctggttcggctaaacctttcggggaatttgttttcttcattatctcaaggaacttttgattatcttgcgtcattacggtctttggaattccagactgagtatcttttgtgtgactgtaacatactgtggatgcatcgctgggtaaaggagaagaacatcacggtacgggataccaggtgtgtttatcctaagtcactgcaggcccaaccagtcacaggcgtgaagcaggagctgttgacatgcgaccctccgcttgaattgccgtctttctacatgactccatctcatcgccaagttgtgtttgaaggagacagccttcctttccagtgcatggcttcatatattgatcaggacatgcaagtgttgtggtatcaggatgggagaatagttgaaaccgatgaatcgcaaggtatttttgttgaaaagaacatgattcacaactgctccttgattgcaagtgccctaaccatttctaatattcaggctggatctactggaaattggggctgtcatgtccagaccaaacgtgggaataatacgaggactgtggatattgtggtattagagagttctgcacagtactgtcctccagagagggtggtaaacaacaaaggtgacttcagatggcccagaacattggcaggcattactgcatatctgcagtgtacgcggaacacccatggcagtgggatatatcccggaaacccacaggatgagagaaaagcttggcgcagatgtgatagaggtggcttttgggcagatgatgattattctcgctgtcagtatgcaaatgatgtcactagagttctttatatgtttaatcagatgcccctcaatcttaccaatgccgtggcaacagctcgacagttactggcttacactgtggaagcagccaacttttctgacaaaatggatgttatatttgtggcagaaatgattgaaaaatttggaagatttaccaaggaggaaaaatcaaaagagctaggtgacgtgatggttgacattgcaagtaacatcatgttggctgatgaacgtgtcctgtggctggcgcagagggaagctaaagcctgcagtaggattgtgcagtgtcttcagcgcattgctacctaccggctagccggtggagctcacgtttattcaacatattcacccaatattgctctggaagcttatgtcatcaagtctactggcttcacggggatgacctgtaccgtgttccagaaagtggcagcctctgatcgtacaggactttcggattatgggaggcgggatccagagggaaacctggataagcagctgagctttaagtgcaatgtttcaaatacattttcgagtctggcactaaagaatactattgtggaggcttctattcagcttcctccttcccttttctcaccaaagcaaaaaagagaactcagaccaactgatgactctctttacaagcttcaactcattgcattccgcaatggaaagctttttccagccactggaaattcaacaaatttggctgatgatggaaaacgacgtactgtggttacccctgtgattctcaccaaaatagatggtgtgaatgtagatacccaccacatccctgttaatgtgacactgcgtcgaattgcacatggagcagatgctgttgcagcccggtgggatttcgatttgctgaacggacaaggaggctggaagtcagatgggtgccatatactctattcagatgaaaatatcactacgattcagtgctactcccttagtaactatgcagttttaatggatttgacgggatctgaactatacacccaggcggccagcctcctgcatcctgtggtttatactaccgctatcattctcctcttatgtctcttagccgtcattgtcagttacatataccatcacagtttgattagaatcagcctcaagagctggcacatgcttgtgaacttgtgctttcatattttcctaacctgtgtggtctttgtgggaggaataacccagactaggaatgccagcatctgccaagcagttgggataattcttcactattccacccttgccacagtactatgggtaggagtgacagctcgaaatatctacaaacaagtcactaaaaaagctaaaagatgccaggatcctgatgaaccaccacctccaccaagaccaatgctcagattttacctgattggtggtggtatccccatcattgtttgcggcataactgcagcagcgaacattaagaattacggcagtcggccaaacgcaccctattgctggatggcatgggaaccctccttgggagccttctatgggccagccagcttcatcacttttgtaaactgcatgtactttctgagcatatttattcagttgaaaagacaccctgagcgcaaatatgagcttaaggagcccacggaggagcaacagagattggcagccaatgaaaatggcgaaataaatcatcaggattcaatgtctttgtctctgatttctacatcagccttggaaaatgagcacacttttcattctcagctcttgggggccagccttactttgctcttatatgttgcactgtggatgtttggggctttggctgtttctttgtattaccctttggacttggtttttagcttcgtttttggagccacaagtttaagcttcagtgcgttcttcgtggtccaccattgtgttaatagggaggatgttagacttgcgtggatcatgacttgctgcccaggacggagctcgtattcagtgcaagtcaacgtccagccccccaactctaatgggacgaatggagaggcacccaaatgccccaatagcagtgcggagtcttcatgcacaaacaaaagtgcttcaagcttcaaaaattcctcccagggctgcaaattaacaaacttgcaggcggctgcagctcagtgccatgccaattctttacctttgaactccacccctcagcttgataatagtctgacagaacattcaatggacaatgatattaaaatgcacgtggcgcctttagaagttcagtttcgaacaaatgtgcactcaagccgccaccataaaaacagaagtaaaggacaccgggcaagccgactcacagtcctgagagaatatgcctacgatgtcccaacgagcgtggaaggaagcgtgcagaacggcttacctaaaagccggctgggcaataacgaaggacactcgaggagccgaagagcttatttagcctacagagagagacagtacaacccaccccagcaagacagcagcgatgcttgtagcacacttcccaaaagtagcagaaattttgaaaagccagtttcaaccactagtaaaaaagatgcgttaaggaagccagctgtggttgaacttgaaaatcagcaaaaatcttatggcctcaacttggccattcagaatggaccaattaaaagcaatgggcaggagggacccttgctcggtaccgatagcactggcaatgttaggactggattatggaaacacgaaactactgtg

SEQ ID NO: 75 - protein, 1124 aa, Mus musculus
MHRWVKERNITVRDTRCVYPKSLQAQPVTGVKQELLTCDPPLELPSFYMTPSHRQVVFEGDSLPFQCMASYIDQDMQVLWYQDGRIVETDESQGIFVEKSMIYNCSLISTALTISNIQAGSTGNWGCHVQTKRGNNTRTVDIVVLESSAQYCPPERVVNNKGDFRWPRTLAGITAYLQCTRNTHSSGIYPGSAQDERKAWRRCDRGGFWADDDYSRCQYANDVTRVLYMFNQMPLNLTNAVATARQLLAYTVEAANFSDKMDVIFVAEMIEKFGRFTREEKSKELGDVMVDVASNIMLADERVLWLAQREAKACSRIVQCLQRIATHRLASGAHVYSTYSPNIALEAYVIKAAGFTGMTCSVFQKVAASDRAGLSDYGRRDPDGNLDKQLSFKCNVSSTFSSLALKNTIMEASIQLPSSLLSPKHKREARAADDALYKLQLIAFRNGKLFPATGNSTKLADDGKRRTVVTPVILTKIDGATVDTHHIPVNVTLRRIAHGADAVAAQWDFDLLNGQGGWKSDGCCILYSDENITTIQCGSLGNYAVLMDLTGTELYTPAASLLHPVVYTTAITLLLCLLAVIISYMYHHSLIRISLKSWHMLVNLCFHILLTCVVFVGGITQTRNASVCQAVGIILHYSTLATVLWVGVTARNIYKQVTKKAKRCQDPDEPPAPPRPMLRFYLIGGGIPIIVCGITAAANIKNYGSRPSAPYCWMAWEPSLGAFYGPASFITFVNCMYFLSIFIQLKRHPERKYELKEPTEEQQRLAANENGEINHQDSMSLSLISTSTLENEHSFQSQLLGASLTLLLYVILWMFGAMAVSLYYPLDLVFSFFFGATCLSFSAFMMVHHCINREDVRLAWIMMCCPGRSSYSVQVNVQPPNSSATNGEAPKCTNSSAESSCTNKSASSFKNSSQGCKLTNLQAAAAQYHSNALPVNATPQLDNSLTEHSMDNDIKMHVAPLDVQFRTNVHPSRHHKNRSKGHRASRLTVLREYAYDVPTSVEGSVQNGLPKSRPGSNEGHSRSRRAYLAYRERQYNPPQQDSSDACSTLPKSSRNVEKPVSTSSKKDAPRKPAAADLESQQKSYGLNLAVQNGPVKSNGQEGPLLATDVTGNVRTGLWKHETTV

SEQ ID NO: 76 - protein, 994 aa, Homo sapiens
MVCSAAPLLLLATTLPLLGSPVAQASQPGQSQAGGESGSGQLLDQENGAGESALVSVYVHLDFPDKTWPPELSRTLTLPAASASSSPRPLLTGLRLTTECNVNHKGNFYCACLSGYQWNTSICLHYPPCQSLHNHQPCGCLVFSHPEPGYCQLLPPVPGILNLNSQLQMPGDTLSLTLHLSQEATNLSWFLRHPGSPSPILLQPGTQVSVTSSHGQAALSVSNMSHHWAGEYMSCFEAQGFKWNLYEVVRVPLKATDVARLPYQLSISCATSPGFQLSCCIPSTNLAYTAAWSPGEGSKASSFNESGSQCFVLAVQRCPMADTTYTCDLQSLGLAPLRVPISITIIQDGDITCPEDASVLTWNVTKAGHVAQAPCPESKRGIVRRLCGADGVWGPVHSSCTDARLLALFTRTKLLQAGQGSPAEEVPQILAQLPGQAAEASSPSDLLTLLSTMKYVAKVVAEARIQLDRRALKNLLIATDKVLDMDTRSLWTLAQARKPWAGSTLLLAVETLACSLCPQDYPFAFSLPNVLLQSQLFGPTFPADYSISFPTRPPLQAQIPRHSLAPLVRNGTEISITSLVLRKLDHLLPSNYGQGLGDSLYATPGLVLVISIMAGDRAFSQGEVIMDFGNTDGSPHCVFWDHSLFQGRGGWSKEGCQAQVASASPTAQCLCQHLTAFSVLMSPHTVPEEPALALLTQVGLGASILALLVCLGVYWLVWRVVVRNKISYFRHAALLNMVFCLLAADTCFLGAPFLSPGPRSPLCLAAAFLCHFLYLATFFWMLAQALVLAHQLLFVFHQLAKHRVLPLMVLLGYLCPLGLAGVTLGLYLPQGQYLREGECWLDGKGGALYTFVGPVLAIIGVNGLVLAMAMLKLLRPSLSEGPPAEKRQALLGVIKALLILTPIFGLTWGLGLATLLEEVSTVPHYIFTILNTLQGVFILLFGCLMDRKIQEALRKRFCRAQAPSSTISLATNEGCILEHSKGGSDTARKTDASE

SEQ ID NO: 77 - DNA, 3207 bp, Homo sapiens
tgcagttcttccttgcggaaaatttgcatcgtgggcttgtagggactgtttcattgagccatggtctgttcggctgccccactgctgctcctggccacaactcttcccctgctggggtcaccagttgcccaagcatcccaacctggacagagtcaggctggaggggaatctggatctgggcagctcctggaccaagagaatggagcaggggaatcagcgctggtctccgtctatgtacatctggactttccagataagacctggccccctgaactctccaggacactgactctccctgctgcctcagcttcctcttccccaaggcctcttctcactggcctcagactcacaacagagtgtaatgtcaaccacaaggggaatttctattgtgcttgcctctctggctaccagtggaacaccagcatctgcctccattaccctccttgtcaaagcctccacaaccaccagccttgtggctgccttgtcttcagccatcccgaacccgggtactgccagttgctgccacctgtccccgggatcctcaacctgaactcccagctgcagatgcctggtgacacgctgagcctgactctccatctgagccaggaggccaccaacctgagctggttcctgaggcacccagggagccccagtcccatcctcctgcagccagggacacaggtgtctgtgacttccagccacggccaggctgccctcagcgtctccaacatgtcccatcactgggcaggtgagtacatgagctgcttcgaggcccagggcttcaagtggaacctgtatgaggtggtgagggtgcccttgaaggcgacagatgtggctcgacttccataccagctgtccatctcctgtgccacctcccctggcttccagctgagctgctgcatccccagcacaaacctggcctacaccgcggcctggagccctggagagggcagcaaagcttcctccttcaacgagtcaggctctcagtgctttgtgctggctgttcagcgctgcccgatggctgacaccacgtacacttgtgacctgcagagcctgggcctggctccactcagggtccccatctccatcaccatcatccaggatggagacatcacctgccctgaggacgcctcggtgctcacctggaatgtcaccaaggctggccacgtggcacaggccccatgtcctgagagcaagaggggcatagtgaggaggctctgtggggctgacggagtctgggggccggtccacagcagctgcacagatgcgaggctcctggccttgttcactagaaccaagctgctgcaggcaggccagggcagtcctgctgaggaggtgccacagatcctggcacagctgccagggcaggcggcagaggcaagttcaccctccgacttactgaccctgctgagcaccatgaaatacgtggccaaggtggtggcagaggccagaatacagcttgaccgcagagccctgaagaatctcctgattgccacagacaaggtcctagatatggacaccaggtctctgtggaccctggcccaagcccggaagccctgggcaggctcgactctcctgctggctgtggagaccctggcatgcagcctgtgcccacaggactaccccttcgccttcagcttacccaatgtgctgctgcagagccagctgtttggacccacgtttcctgctgactacagcatctccttccctactcggcccccactgcaggctcagattcccaggcactcactggccccattggtccgtaatggaactgaaataagtattactagcctggtgctgcgaaaactggaccaccttctgccctcaaactatggacaagggctgggggattccctctatgccactcctggcctggtccttgtcatttccatcatggcaggtgaccgggccttcagccagggagaggtcatcatggactttgggaacacagatggttcccctcactgtgtcttctgggatcacagtctcttccagggcagggggggttggtccaaagaagggtgccaggcacaggtggccagtgccagccccactgctcagtgcctctgccagcacctcactgccttctccgtcctcatgtccccacacactgttccggaagaacccgctctggcgctgctgactcargtgggcttgggagcttccatactggcgctgcttgtgtgcctgggtgtgtactggctggtgtggagagtcgtggtgcggaacaagatctcctatttccgccacgccgccctgctcaacatggtgttctgcttgctggccgcagacacttgcttcctgggcgccccattcctctctccagggccccgaagcccgctctgccttgctgccgccttcctctgtcatttcctctacctggccacctttttctggatgctggcgcaggccctggtgttggcccaccagctgctctttgtctttcaccagctggcaaagcaccgagttctccccctcatggtgctcctgggctacctgtgcccactggggttggcaggtgtcaccctggggctctacctacctcaagggcaatacctgagggagggggaatgctggttggatgggaagggaggggcgttatacaccttcgtggggccagtgctggccatcataggcgtgaatgggctggtactagccatggccatgctgaagttgctgagaccttcgctgtcagagggacccccagcagagaagcgccaagctctgctgggggtgatcaaagccctgctcattcttacacccatctttggcctcacctgggggctgggcctggccactctgttagaggaagtctccacggtccctcattacatcttcaccattctcaacaccctccagggcgtcttcatcctattgtttggttgcctcatggacaggaagatacaagaagctttgcgcaaacgcttctgccgcgcccaagcccccagctccaccatctccctggccacaaatgaaggctgcatcttggaacacagcaaaggaggaagcgacactgccaggaagacagatgcttcagagtgaaccacacacggacccatgttcctgcaagggagttgaggctgtgtgcttgaacccaccagatgagccctggcccaatgctctgaactcttcccgcctcccggagctcagcccttgagaaaggcaggcttatatttcccttagtgacactcatttatcttacag

SEQ ID NO: 78 - protein, 997 aa, Mus musculus
MSSLALSQLLLAVTLPLLELEPTFVPTAQSELSPYGGKSGQQLNQYSGEGESVLVSSYVHLEFSSTAWPQELSKNFTLPTALAVLPPKTLTGLGLTTECRANHSGTSLCTCHPGYQWNATLCSLYPHCWGRRSERDSCMCRSFHGPVTGYCQLLPPVPANLILDSQLQMHGNTLNLILLKKEEATNLRWFLRHSKNHTPISLWPGTNVLQTSSEGQSGLRVARMSRHWAGEYESIFEAQGFRWRLRQLVKVPLQEEEVVRLPDALSISCTASTGFQLSCCIPLTTDYTATWSPGEDSQASLQKMSDSQCFVLAVPHCPATNTTYTCTLQSQNLPPLVAPVSITIIQDGDTTCPEDFSVVSWNVTKAGFVAQAPCPVNKKGVVKRLCGTDGIWRPVQNTCTEAKILTLCLKAKLLLEGQGKPYEEVPWILSELQEQVGVASTPSDLWEMLHTVTLLAKVVAETSTELTGSALKDLLTTTDKILDANISALWTLAQAQEPSMGSDFLKAVETLVHSLRPQQHPFSFSSANVLLQSQLLRHSSPPGYQMSFSTWPLLQARIPWHSLAPLVHSGTNVSITSLVLQKLDYRLPSNYTQGLWNTPYTTPGLILVVSITADGQAFTQAEVIMDYEDMNGTLHCVFWDHRVFQGQGGWSDEGCEVHAANASITQCICQHLTAFSILMSQHTVPENPTLDLLSQVGTGASVLALLVCLAIYGLVWRVVVRNKVAFFRHTTLFNMVICLLVADTCFLGSPFLPSGYHSLICLVTAFLCHFFYLATFFWMLAQALVLAHQLLFVFHQLSKHVVLSLMVMLGYLCPLGFAGVTLGLYLPQRKYLWEGKCFLNGGGVMLYSFSEPVLAIVGVNGLVLVIAVLKLLRPSLSEGPTVEKRQALVGVLKALLILTPIFGLTWGLGVATLFDGSIVSHYAFSILNSLQGKTVRNREGRKSNPPVVEGVFILVFGCLTDKKVLEALRKRLRGSRSSNSAISMDHYPQSLFLPYNM

SEQ ID NO: 79 - protein, 435 aa, Homo sapiens
MTACTLLPLPPLCPFTCDAWWAIPWSLKCRVLGVPPSSWSLSFPIHTHNCPMPLNPRSCTCPVSVSCLQTFRHKLVEPVCAFWNYRGAWATTGCSVAALYLDSTACFCNHSTSFAILLQIYEVQRGPEEESLLRTLSFVGCGVSFCALTTTFLLFLVAGVPKSERTTVHKNLTFSLASAEGFLMTSEWAKANEVACVAVTVAMHFLFLVAFSWMLVEGLLLWRKVVAVSMHPGPGMRLYHATGWGVPVGIVAVTLAMLPHDYVAPGHCWLNVHTNAIWAFVGPVLFVLTANTCILARVVMITVSSARRRARMLSPQPCLQQQIWTQIWATVKPVLVLLPVLGLTWLAGILVHLSPAWAYAAVGLNSIQGLYIFLVYAACNEEVRSALQRMAEKKVAEVLRALGVWVGAGGPQSQVPAPISSPLSPVPALPAGGPA

SEQ ID NO: 80 - DNA, 1463 bp, Homo sapiens
aaggagaggagaggcgcagttgcttaactgctccccggtgatggctgcttagcttgttcccagtttttccaccttccacaccatgctggaatgacagcctgcactctcctccctctgcctcccctctgccccttcacctgtgacgcatggtgggcaatcccctggtccctaaaatgcagagtccttggcgtccctccatcctcctggtctctctcctttcccatccacactcacaactgccccatgcccctcaatccacgctcatgcacctgccctgtctctgtctcctgcctccagaccttccgtcataagctggtggagcctgtctgtgctttctggaactacaggggtgcctgggccaccacaggctgctccgtggctgccctgtacctggactccaccgcctgcttctgcaaccacagcaccagctttgccatcctgctgcaaatctatgaagtacagagaggccctgaggaggagtcgctgctgaggactctgtcatttgtgggctgtggcgtgtccttctgcgccctcaccaccaccttcttgctcttcctggtggccggggtccccaagtcagagcgaaccacagtccacaagaacctcaccttctccctggcctctgccgagggcttcctcatgaccagcgagtgggccaaggccaatgaggtggcatgtgtggctgtcacagtcgcaatgcacttcctctttctggtggcattctcctggatgctggtggaggggctgctgctgtggaggaaggtggtagctgtgagcatgcacccgggcccaggcatgcggctctaccacgccacaggctggggcgtgcctgtgggcatcgtggcggtcaccctggccatgctcccccatgactacgtggcccccggacattgctggctcaatgtgcacacaaatgccatctgggccttcgtggggcctgtgctcttcgtgctgactgccaacacctgcatcctggcccgtgtggtaatgatcaccgtgtccagtgcccgccgccgtgcccgcatgttgagcccacagccctgcctgcagcagcagatctggacccagatatgggccacggtgaagcccgtgctggtcctgctgcccgtcctaggcctgacctggctggcaggcatcctggtgcacctgagccccgcctgggcctacgctgccgtgggcctcaactccatccaggggctgtacatcttcctggtttatgctgcctgcaatgaggaggtgcggagcgccctgcagaggatggctgagaagaaggtggccgaggtgctcagggcactgggggtgtgggtgggggcgggaggcccccagagccaggtcccagcccccatatcctctcctttaagtcccgtgccagccctgccagctgggggaccagcctgaggcccccaggcccctgggaggcagcccgagggagccccatagccttggctccaccccggagacac

SEQ ID NO: 81 - protein, 528 aa, Homo sapiens
MDHCGALFLCLCLLTLQNATTETWEELLSYMENMQVSRGRSSVFSSRQLHQLEQMLLNTSFPGYNLTLQTPTIQSLAFKLSCDFSGLSLTSATLKRVPQAGGQHARGQHAMQFPAELTRDACKTRPRELRLICIYFSNTHFFKDENNSSLLNNYVLGAQLSHGHVNNLRDPVNISFWHNQSLEGYTLTCVFWKEGARKQPWGGWSPEGCRTEQPSHSQVLCRCNHLTYFAVLMQLSPALVPAELLAPLTYISLVGCSISIVASLITVLLHFHFRKQSDSLTRIHMNLHASVLLLNIAFLLSPAFAMSPVPGSACTALAAALHYALLSCLTWMAIEGFNLYLLLGRVYNIYIRRYVFKLGVLGWGAPALLVLLSLSVKSSVYGPCTIPVFDSWENGTGFQNMSICWVRSPVVHSVLVMGYGGLTSLFNLVVLAWALWTLRRLRERADAPSVRACHDTVTVLGLTVLLGTTWALAFFSFGVFLLPQLFLFTILNSLYGFFLFLWFCSQRCRSEAEAKAQIEAFSSSQTTQ

SEQ ID NO: 82 - DNA, 1587 bp, Homo sapiens
atggatcactgtggtgcccttttcctgtgcctgtgccttctgactttgcagaatgcaacaacagagacatgggaagaactcctgagctacatggagaatatgcaggtgtccaggggccggagctcagttttttcctctcgtcaactccaccagctggagcagatgctactgaacaccagcttcccaggctacaacctgaccttgcagacacccaccatccagtctctggccttcaagctgagctgtgacttctctggcctctcgctgaccagtgccactctgaagcgggtgccccaggcaggaggtcagcatgcccggggtcagcacgccatgcagttccccgccgagctgacccgggacgcctgcaagacccgccccagggagctgcggctcatctgtatctacttctccaacacccactttttcaaggatgaaaacaactcatctctgctgaataactacgtcctgggggcccagctgagtcatgggcacgtgaacaacctcagggatcctgtgaacatcagcttctggcacaaccaaagcctggaaggctacaccctgacctgtgtcttctggaaggagggagccaggaaacagccctgggggggctggagccctgagggctgtcgtacagagcagccctcccactctcaggtgctctgccgctgcaaccacctcacctactttgctgttctcatgcaactctccccagccctggtccctgcagagttgctggcacctcttacgtacatctccctcgtgggctgcagcatctccatcgtggcctcgctgatcacagtcctgctgcacttccatttcaggaagcagagtgactccttaacacgcatccacatgaacctgcatgcctccgtgctgctcctgaacatcgccttcctgctgagccccgcattcgcaatgtctcctgtgcccgggtcagcatgcacggctctggccgctgccctgcactacgcgctgctcagctgcctcacctggatggccatcgagggcttcaacctctacctcctcctcgggcgtgtctacaacatctacatccgcagatatgtgttcaagcttggtgtgctaggctggggggccccagccctcctggtgctgctttccctctctgtcaagagctcggtatacggaccctgcacaatccccgtcttcgacagctgggagaatggcacaggcttccagaacatgtccatatgctgggtgcggagccccgtggtgcacagtgtcctggtcatgggctacggcggcctcacgtccctcttcaacctggtggtgctggcctgggcgctgtggaccctgcgcaggctgcgggagcgggcggatgcaccaagtgtcagggcctgccatgacactgtcactgtgctgggcctcaccgtgctgctgggaaccacctgggccttggccttcttttcttttggcgtcttcctgctgccccagctgttcctcttcaccatcttaaactcgctctacggtttcttccttttcctgtggttctgctcccagcggtgccgctcagaagcagaggccaaggcacagatagaggccttcagctcctcccaaacaacacagtag

SEQ ID NO: 83 - protein, 524 aa, Mus musculus
MDPHGALFFYLCLLAAQVVLVETLSDLLVLMKRLEQPVGRGLSSRARHIHSLEQKLLNASFGGHNLTLQTNSIQSLVFKLSCDFPGLSLSSTTLTNVSQVRAPHAMQFPAELTKGACVTSRPAELRLICIYFFTAHLFQDDRNSSLLNNYVLGAQLDHRPVNNLQKPVNISFWHNRSLEGYTVSCVFWKEGASKSSWGAWSPEGCYTEQPSATQVLCHCNHLTYFAVLMQLSGDPVPAELQVPLEYISFVGCSISIVASLLTILLYAQSRKQSDSTTRIHMNLNGSVLLLNVTFLLSSQMTLPTMPRPVCKVLAAVLHYALLSSLTWMAIEGFNLYLFLGRVYNAYIRRYLLKLCMLGWGFPALLVLLLLMIKSSVYGPCVTSLSKSQENGTGFQNVSMCWIRSPMVHSILVMGYGGFTSLFNLVVLAWALWILCRLRAREKALSPWAYRDTAMVLGLTVLLGTTWTLAFFSFGVFLLPQLFLFTIFNSLYGFFLFLWFCSQKRYSDAEAKAEMEAVSSSQMTH

SEQ ID NO: 84 - protein, 814 aa, Homo sapiens
MEPEINCSELCDSFPGQELDRRPLHDLCKTTITSSHHSSKTISSLSPVLLGIVWTFLSCGLLLILFFLAFTIHCRKNRIVKMSSPNLNIVTLLGSCLTYSSAYLFGIQDVLVGSSMETLIQTRLSMLCIGTSLVFGPILGKSWRLYKVFTQRVPDKRVIIKDLQLLGLVAALLMADVILLMTWVLTDPIQCLQILSVSMTVTGKDVSCTSTSTHFCASRYSDVWIALIWGCKGLLLLYGAYLAGLTGHVSSPPVNQSLTIMVGVNLLVLAAGLLFVVTRYLHSWPNLVFGLTSGGIFVCTTTINCFIFIPQLKQWKAFEEENQTIRRMAKYFSTPNKSFHTQYGEEENCHPRGEKSSMERLLTEKNAVIESLQEQVNNAKEKIVRLMSAECTYDLPEGAAPPASSPNKDVQAVASVHTLAAAQGPSGHLSDFQNDPGMAARDSQCTSGPSSYAQSLEGPGKDSSFSPGKEEKISDSKDFSDHLDSGCSQKPWTEQSLGPERGDQVPMNPSQSLLPERGGSDPQRQRHLENSEEPPERRSRVSSVIREKLQEVLQDLGLGPEASLSTAPSCHQQTWKNSAAFSPQKMPLSKELGFSPYMVRRRRAAQRARSHFPGSAPSSVGHRANRTVPGAHSRLHVQNGDSPSLAPQTTDSRVRRPSSRKPSLPSDPQDRPGTLEGSKQSQTEPEGARGSKAAFLRQPSGSGRAPSPAAPCLSKASPDLPEQWQLWPPVPSGCASLSSQHSYFDTESSSSDEFFCRCHRPYCEICFQSSSDSSDSGTSDTDPEPTGGLASWEKLWARSKPIVNFKDDLKPTLV

SEQ ID NO: 85 - DNA, 2445 bp, Homo sapiens
atggagcctgaaataaactgctctgaattgtgtgacagttttcctggccaggagctggatcggagaccccttcatgatctctgcaagacaacaattacatcttcccaccacagcagtaagaccatctcttcattatctcctgtcctcttgggtattgtttggacttttctcagctgtggacttctgctgatacttttctttcttgcctttacaattcactgcaggaagaacaggattgtgaagatgtccagtcccaatctgaacattgtgaccttactgggcagttgtctcacttacagtagcgcttacctctttgggattcaggatgttttagtggggagctcaatggaaactctcattcagacaagactgtccatgctgtgcattgggacctcccttgtgtttggccccattctgggaaagagctggcgactctacaaggtgtttacccaaagggtcccggacaagagagtgattatcaaagacctgcagttgctggggttggtggcagccctgttgatggctgatgtgatcctgctcatgacgtgggtgctgactgatcccatccagtgcctccagattctcagtgtcagtatgacggtgacagggaaagacgtgtcctgcacttcgaccagcacccacttctgtgcttcccggtattccgatgtttggattgctctcatttggggatgcaagggtctgctcctgctgtatggtgcctacctggctggcctgactggccatgtcagctcccctcctgtgaatcagtccttaaccatcatggtgggggtcaacctccttgtactggctgctgggctgctttttgtagtcaccagatacttgcattcctggcccaacctggtctttggactcacatctggagggatctttgtttgtacaactacaatcaactgcttcatcttcattccccagctgaagcaatggaaggcatttgaagaggaaaaccaaacaatcagacgcatggccaaatatttcagcactcccaacaaaagcttccatacccagtatggtgaggaggagaactgccacccgaggggagagaaaagctccatggagaggctcctcacagaaaaaaatgctgtgattgaaagcctgcaggaacaagtaaacaacgccaaagagaagattgtgaggctgatgtcagctgagtgcacctatgacctcccagagggggctgccccacctgcctcttccccgaacaaggacgtccaggcggtagcctcggtccacaccctggcagctgctcaggggccttcgggtcacctctctgactttcagaatgatcctggcatggctgcccgggattcccagtgcacttcagggccctcctcatatgcacaaagccttgaggggcctgggaaggactccagcttctccccagggaaggaggagaagatatctgactcaaaagacttttctgatcatttagactcaggttgtagccagaagccatggactgagcaaagcctgggtccagaaagaggagaccaagtccccatgaaccccagccagagtctcctaccagaaagaggcggctcagatccccagagacagaggcatctggagaactcagaggagcccccagagcggcggtcacgggttagttcagtaatcagggagaaacttcaggaggtcttacaagatctgggcctgggccctgaggcttccctctccaccgccccctcttgtcatcagcaaacctggaagaacagtgctgccttcagcccccaaaagatgcccctctccaaggagctcggctttagcccttacatggtgaggagaaggcgggcagctcagcgggcccgctcacactttcctggctctgcaccctcatctgtggggcatcgggcaaacaggactgttcctggggcacacagcaggctacatgtgcagaatggggacagccccagcctggccccacaaactactgattccagagtacgaagaccttcttccaggaagccttcactaccttcagatcctcaagacagaccaggtaccctggagggcagcaaacaaagccagacagagcccgagggggctagagggagcaaagcagcctttcttcgccagccttctggttctggccgggccccaagtcctgctgccccatgcctctccaaagcctcacctgacttgcctgaacagtggcagctgtggcccccagtgccctcaggctgtgcctccctgtcttctcaacacagctattttgatactgagtccagcagctcagatgagttcttctgccgctgccaccggccctactgtgaaatctgcttccagagctcttctgactctagtgacagtggcacatcagacactgaccctgagcctactggggggctggcttcctgggaaaagctgtgggcccgctccaagcctattgtgaacttcaaagatgacttgaaacccacgctggtgtga

SEQ ID NO: 86 - protein, 798 aa, Mus musculus
MEPEINCSEFCDSFPGQELDRRPLHDLCKTTITESQHSSTAASPLSPALLGIMWTFLSCGLLLVLFFLAFTIRCRKNRIVKMSSPNLNVVTLLGSCLTYISAYLFGIQDALEGSSVEALIQTRLSLLCIGTSLVFGPILGKSWRLYKVFTQRVPDKRVIIKDLQLLGLVAALVVADVILLVTWVLTDPIQCLQMLGVSMKVTGRDVSCSLTNTHFCASRYSDVWIALVLGCKGLLLLYGAYLAGLTNHVSSPPVNQSLTIMVGVNLLLLTAGLLFVVTRYLHSWPNLVFGLTSGGIFVCTTTVNCCVFIPQLKQWKAFEGENQTMRHMAKYFSTPSKSFHGQFDEDPSCHLRDEKSCMERLLTEKNAVIESLQEQVSNAKEKLVKLMSAECTYDSPEWAVPDAASARGLALPGPSECPAVSENESGAAARDSLHVPAACQHVQGPGASRRDTSPSPAQQDNMPLKQYCDHLDTGCNQKPKAEQSEGPERGDQEPMAPSQRLMADGVACEPHKPRQSPEGLPKKLPGVSSVVREKLQEVLQELDLGSEAPLSPLPCPQQLWKSTTSRSPQKLSPSKLGFSPYVVRRRRAAQRARSHIPGSVGLNVGHQANSTVSSSQSGLIVQNRDSPRLDHNNARSKVPRSSSVKPSPLSEPRRKQGTLEGSKQCETEPQEAGGACNVAFPCQSSASVQAQSPAAPCLPSSPALPRQRQPRPRLSPGCPSLSSGCYNLDSESSSSDEFFCRCHRPYCEICFQSSLDSNDSDTSDSDLEQASGLASWGKLWARSKPVVNFKDDLKPTLV

SEQ ID NO: 87 - protein, 361 aa, Homo sapiens [sequence omitted]

SEQ ID NO: 88 - DNA, 2081 bp, Homo sapiens
atggactcattacaagttgttttaggatctacctccagacccatggagtttctttagtaaagcctgaacgacacaggccaaaataatctccaaaggccagctctgacccttttaaatcaattttagctaaatccgttcacaaaaggcttcgcacatccagtgtccctgaaaaataaaggaggttgggcaggccctgcgggggctcgaggaattcgctaagtgagttttctggcttctggatacactttcaaagggccagagggcacgaggcttccgccttggccgccacctccccggccagctgcggtgttcgcggccagtgttgccgggcacttcctggttcccgcgcgccccgggtgcagctccctgcacccagtgctggcgctcctcagaagggagggggccagaggcgagatgtcgcaaccgcctccctccctctttccccgccttggcactcagtcgcctcccagatgagcactctctcagaccgctgcgggccgccaggcgccgggaatgtcccctgaatgcgcgcgggcagcgggcgacgcgcccttgcgcagcctggagcaagccaaccgcacccgctttcccttcttctccgacgtcaagggcgaccaccggctggtgctggccgcggtggagacaaccgtgctggtgctcatctttgcagtgtcgctgctgggcaacgtgtgcgccctggtgctggtggcgcgccgacgacgccgcggcgcgactgcctgcctggtactcaacctcttctgcgcggacctgctcttcatcagcgctatccctctggtgctggccgtgcgctggactgaggcctggctgctgggccccgttgcctgccacctgctcttctacgtgatgaccctgagcggcagcgtcaccatcctcacgctggccgcggtcagcctggagcgcatggtgtgcatcgtgcacctgcagcgcggcgtgcggggtcctgggcggcgggcgcgggcagtgctgctggcgctcatctggggctattcggcggtcgccgctctgcctctctgcgtcttcttccgagtcgtcccgcaacggctccccggcgccgaccaggaaatttcgatttgcacactgatttggcccaccattcctggagagatctcgtgggatgtctcttttgttactttgaacttcttggtgccaggactggtcattgtgatcagttactccaaaattttacagatcacaaaggcatcaaggaagaggctcacggtaagcctggcctactcggagagccaccagatccgcgtgtcccagcaggacttccggctcttccgcaccctcttcctcctcatggtctccttcttcatcatgtggagccccatcatcatcaccatcctcctcatcctgatccagaacttcaagcaagacctggtcatctggccgtccctcttcttctgggtggtggccttcacatttgctaattcagccctaaaccccatcctctacaacatgacactgtgcaggaatgagtggaagaaaattttttgctgcttctggttcccagaaaagggagccattttaacagacacatctgtcaaaagaaatgacttgtcgattatttctggctaatttttctttatagccgagtttctcacacctggcgagctgtggcatgcttttaaacagagttcatttccagtaccctccatcagtgcaccctgctttaagaaaatgaacctatgcaaatagacatccacagcgtcggtaaattaaggggtgatcaccaagtttcataatattttccctttataaaaggatttgttggccaggtgcagtggttcatgcctgtaatcccagcagtttgggaggctgaggtgggtggatcacctgaggtcaggagttcgagaccaacctgaccaacatggtgagacccccgtctctactaaaaataaaaaaaaaaattagctgggagtggtggtgggcacctgtaatcctagctacttgggaggctgaaccaggagaatctcttgaacctgggaggcagaggttgcagtgagccgagatcgtgccattgcactccaaccagggcaacaagagtgaaactccatctt

SEQ ID NO: 89 - protein, 361 aa, Mus musculus [sequence omitted]

SEQ ID NO: 90 - protein, 347 aa, Homo sapiens
MGDELAPCPVGTTAWPALIQLISKTPCMPQAASNTSLGLGDLRVPSSMLYWLFLPSSLLAAATLAVSPLLLVTILRNQRLRQEPHYLLPANILLSDLAYILLHMLISSSSLGGWELGRMACGILTDAVFAACTSTILSFTAIVLHTYLAVIHPLRYLSFMSHGAAWKAVALIWLVACCFPTFLIWLSKWQDAQLEEQGASYILPPSMGTQPGCGLLVIVTYTSILCVLFLCTALIANCFWRIYAEAKTSGIWGQGYSRARGTLLIHSVLITLYVSTGVVFSLDMVLTRYHHIDSGTHTWLLAANSEVLMMLPRAMLPYLYLLRYRQLLGMVRGHLPSRRHQAIFTIS

SEQ ID NO: 91 - DNA, 1306 bp, Homo sapiens
atgcagctgcacagttgcagagatgtgaatgcaggaagccaggtgtgagtctgaattcacattggtttttttatctttattaagcagtcattcctaaggcctgcccgagcctggcatctctacagaggagtggtgccatcaggacccctgtggggcagatcaacactcaaggcaggtgcagaatcaacaacctgtgacaaagccagccatccctgccaggaagcatgggggatgagctggcaccttgccctgtgggcactacagcttggccggccctgatccagctcatcagcaagacaccctgcatgccccaagcagccagcaacacttccttgggcctgggggacctcagggtgcccagctccatgctgtactggcttttccttccctcaagcctgctggctgcagccacactggctgtcagccccctgctgctggtgaccatcctgcggaaccaacggctgcgacaggagccccactacctgctcccggctaacatcctgctctcagacctggcctacattctcctccacatgctcatctcctccagcagcctgggtggctgggagctgggccgcatggcctgtggcattctcactgatgctgtcttcgccgcctgcaccagcaccatcctgtccttcaccgccattgtgctgcacacctacctggcagtcatccatccactgcgctacctctccttcatgtcccatggggctgcctggaaggcagtggccctcatctggctggtggcctgctgcttccccacattccttatttggctcagcaagtggcaggatgcccagctggaggagcaaggagcttcatacatcctaccaccaagcatgggcacccagccgggatgtggcctcctggtcattgttacctacacctccattctgtgcgttctgttcctctgcacagctctcattgccaactgtttctggaggatctatgcagaggccaagacttcaggcatctgggggcagggctattcccgggccaggggcaccctgctgatccactcagtgctgatcacattgtacgtgagcacaggggtggtgttctccctggacatggtgctgaccaggtaccaccacattgactctgggactcacacatggctcctggcagctaacagtgaggtactcatgatgcttccccgtgccatgctcccatacctgtacctgctccgctaccggcagctgttgggcatggtccggggccacctcccatccaggaggcaccaggccatctttaccatttcctagagttcttgagtccacagtctggcaagctgaggttaaaa

SEQ ID NO: 92 - protein, 419 aa, Homo sapiens
MLAAAFADSNSSSMNVSFAHLHFAGGYLPSDSQDWRTIIPALLVAVCLVGFVGNLCVIGILLHNAWKGKPSMIHSLILNLSLADLSLLLFSAPIRATAYSKSVWDLGWFVCKSSDWFIHTCMAAKSLTIVVVAKVCFMYASDPAKQVSIHNYTIWSVLVAIWTVASLLPLPEWFFSTIRHHEGVEMCLVDVPAVAEEFMSMFGKLYPLLAFGLPLFFASFYFWRAYDQCKKRGTKTQNLRNQIRSKQVTVMLLSIAIISALLWLPEWVAWLWVWHLKAAGPAPPQGFIALSQVLMFSISSANPLIFLVMSEEFREGLKGVWKWMITKKPPTVSESQETPAGNSEGLPDKVPSPESPASIPEKEKPSSPSSGKGKTEKAEIPILPDVEQFWHERDTVPSVQDNDPIPWEHEDQETGEGVK

SEQ ID NO: 93 - DNA, 1260 bp, Homo sapiens
atgctggcagctgcctttgcagactctaactccagcagcatgaatgtgtcctttgctcacctccactttgccggagggtacctgccctctgattcccaggactggagaaccatcatcccggctctcttggtggctgtctgcctggtgggcttcgtgggaaacctgtgtgtgattggcatcctccttcacaatgcttggaaaggaaagccatccatgatccactccctgattctgaatctcagcctggctgatctctccctcctgctgttttctgcacctatccgagctacggcgtactccaaaagtgtttgggatctaggctggtttgtctgcaagtcctctgactggtttatccacacatgcatggcagccaagagcctgacaatcgttgtggtggccaaagtatgcttcatgtatgcaagtgacccagccaagcaagtgagtatccacaactacaccatctggtcagtgctggtggccatctggactgtggctagcctgttacccctgccggaatggttctttagcaccatcaggcatcatgaaggtgtggaaatgtgcctcgtggatgtaccagctgtggctgaagagtttatgtcgatgtttggtaagctctacccactcctggcatttggccttccattattttttgccagcttttatttctggagagcttatgaccaatgtaaaaaacgaggaactaagactcaaaatcttagaaaccagatacgctcaaagcaagtcacagtgatgctgctgagcattgccatcatctctgctctcttgtggctccccgaatgggtagcttggctgtgggtatggcatctgaaggctgcaggcccggccccaccacaaggtttcatagccctgtctcaagtcttgatgttttccatctcttcagcaaatcctctcatttttcttgtgatgtcggaagagttcagggaaggcttgaaaggtgtatggaaatggatgataaccaaaaaacctccaactgtctcagagtctcaggaaacaccagctggcaactcagagggtcttcctgacaaggttccatctccagaatccccagcatccataccagaaaaagagaaacccagctctccctcctctggcaaagggaaaactgagaaggcagagattcccatccttcctgacgtagagcagttttggcatgagagggacacagtcccttctgtacaggacaatgaccctatcccctgggaacatgaagatcaagagacaggggaaggtgttaaatag

SEQ ID NO: 94 - protein, 422 aa, Mus musculus
MGKAMLRAGFADTNSSNMNESFARLHFAGGYLPSDSKDWRTIIPSLLMAVCLVGLVGNLCVIGILLHGVWKRKPSTIHSLILNLSLADFSLLLFSAPVRAAAYSKGVWDLGWFICKSSDWFTHVCMAAKSLTFVVVAKACFAYASDPAKQESIHSRTIWSVLAGIWVVASLLPLPEWLFSTTRRHAGVEMCLVDVPAVAEEFMSMFGKLYPLLVFCLPLLLAGVYFWRAYDQCKTRCTKTRNLRDQMRSKQLTVMLLSTAIISALLWLPEWIAWLWVWHVKAGGPMPPQGFIALSQVLMFFTSTANPLIFLVMSEEFKAGLKGLWKWMITRKPAVTSEVQEAPAGNTEALPGKAPSPETQTCILDTDGRGSPDDSKEKSGKVVAPILPDVEQFWHERDAVPSAQDNDPIPWEHEGQETEGCN

SEQ ID NO: 95 - protein, 347 aa, Homo sapiens
MEPNATFTTQLTATPERLLRLISAGVCGLILLVGLSANGLMLLVVGRGPGSPHPLHSLTHSLMMNITPSDLLFLACVVPVLLLSFLQHNWWLGPAICTISQATNTATTFCIFYSMVATALLRHVAVARPDLAFPAGWGTLLLLCGAMWALGLTESLPNWLFQRVAVEEETAGAPKTQACLLLLSPAGTSCYISLLGALAFLPCTLGLGCSFSHVGWLLWTQPQGPMGESIQEHENIGLSLVVLVVFVLMWGPCSMLGYVAAMGYLPATPAAFVASSLCTILAYSNCAVSPILCFYLSRPFQAGLRDLFCRPMMARHPRGVGVAASVVATVQPGRDRASGGLWGLAGV

SEQ ID NO: 96 - DNA, 1047 bp, Homo sapiens
atggagcccaatgctacgttcaccacgcagctcacggccacacctgagcgactgctccgactcatctctgctggggtctgtggcctcatcctgctggtggggctgtcagctaatgggctcatgctgctggtggtgggccggggcccgggctccccccacccgctccactccctgacccacagcctcatgatgaacatcacgccatctgacctgctcttcctggcctgcgtggtgcctgtgctgctgctgagcttcctgcagcacaactggtggctgggccctgccatctgcaccattagccaggccaccaacacagccaccacgttctgcatcttctatagcatggtggccacagctctcctgcgccatgtggctgtggcccggcctgacctggccttcccagccggctggggcaccctcttgctgctctgtggggccatgtgggccctgggccttacagaatccctgcccaactggctgttccagagggtggcagtggaggaggagacagcgggggctcccaagacccaggcctgcctcttgctcctgagccctgctgggacctcctgctacatcagcctgctgggagccctggccttcctgccatgcacgctggggctgggctgctctttcagccacgtgggctggctcctgtggacccagccccaaggtcccatgggagagagcatccaggagcattaagagaacatagggctcagccttgtggtgctggtggtttttgtgctgatgtgggggccctgctccatgctgggttatgtggcagccatgggctacctgcctgccacaccggctgcttttgtggcctccagcctctgcaccatcctggcctactccaattgcgctgtcagccctatcctctgcttctacctctcccgccccttccaggcaggactcagggacctcttctgcaggccgatgatggccaggcatcccagaggtgtgggagtggcagcctcagtggtggcgactgtccagcctggccgtgacagggcctcaggaggcctgtggggcctggcgggggtctaa

SEQ ID NO: 97 - protein, 515 aa, Homo sapiens
MGHNGSWISPNASEPHNASGAEAAGVNRSALGEFGEAQLYRQFTTTVQVVIFIGSLLGNFMVLWSTCRTTVFKSVTNRFIKNLACSGICASLVCVPFDIILSTSPHCCWWIYTMLFCKVVKFLHKVFCSVTILSFPAIALDRYYSVLYPLERKISDAKSRELVMYIWAHAVVASVPVFAVTNVADIYATSTCTEVWSNSLGHLVYVLVYNITTVIVPVVVVFLFLILIRRALSASQKKKVIIAALRTPQNTISIPYASQREAELHATLLSMVMVFILCSVPYATLVVYQTVLNVPDTSVFLLLTAVWLPKVSLLANPVLFLTVNKSVRKCLIGTLVQLHHRYSRRNVVSTGSGMAEASLEPSIRSGSQLLEMFHIGQQQIFKPTEDEEESEAKYIGSADFQAKEIFSTCLEGEQGPQFAPSAPPLSTVDSVSQVAPAAPVEPETFPDKYSLQFGFGPFELPPQWLSETRNSKKRLLPPLGNTPEELIQTKVPKVGRVERKMSRNNKVSIFPKVDS

SEQ ID NO: 98 - protein, 515 aa, Mus musculus
MGHNSSWVSPNTSHPRNTSGAEAGANLSAFGELSEAQLYRQFTTTVQVVIFIGSLLGNFMVLWSTCRTTVFKSVTNRFIKNLACSGICASVVCVPFDIILSSSPHCCWWIYTMLFCKVLKFLHKVFCSVTVLSFPAIALDRYYSVLYPLERKISDAKSRELVMYIWAHAVVASVPVFAVTNVADIYAMSTCTEVWSNSLGHLVYVLIYNVTTVIVPVAVVFLFLILIRRALSASQKKKVIIAALRTPQNTISIPYASQREAELHATLLSMVTVFILCSVPYATLVVYQTVLNVPNTSVFLLLTAIWLPKVSLLANPVLFLTVNKSVRKCLVGTLVQLHHRYSRRNVVSTGSGVAEPSLEPSMRSGSQLLEMFHIGQQQIFKPSEDEEESEAKYLGSADFQAKEVLTSCPEGEQEPPQLAPSVPPPGTVDSEPRVSPVAPMESGIFPDKYSLQFGFGPFELPPQWLSETRNSKKRLLPPLGNTPEELIQTKVPRVNRVERKMSRNNKVSIFPKVDS

SEQ ID NO: 99 - DNA, 1545 bp, Mus musculus
atggggcacaacagcagctgggtgtcaccgaacaccagccacccgcgcaacacgtcgggcgccgaggctggcgccaacctcagcgcgttcggggagctgagcgaggctcagctgtaccgccagttcaccaccaccgtgcaggtcgtcatcttcattggctcgctactgggaaacttcatggtgttatggtcaacttgccgcacaacagtgttcaaatctgtcaccaacaggttcattaaaaacctggcctgctccgggatttgtgccagtgtggtctgtgtgcccttcgacatcatcctgagcagcagccctcactgttgctggtggatctatacgatgctcttctgcaaggtgctcaaattcctacacaaggtgttctgctctgtgactgtcctcagttttcctgctattgccctggacaggtactattcagtcctttatcctctggagagaaaaatatctgatgccaagtctcgggagctagtgatgtacatctgggctcatgcagtggtggccagtgtccctgtgtttgctgtgaccaatgtcgctgacatctatgctatgtccacctgcacggaagtctggagcaactccttgggccacctggtgtatgttctgatctacaatgtcaccacagtcattgtgcccgtggctgtggtatttctctttctcatcctgatccggagggccctgagtgccagccagaagaagaaagtcataattgctgcactgaggaccccacagaacaccatctctatcccctatgcttcccagcgagaggcagagctacatgccaccctgctctccatggtgacagttttcattctctgcagtgtaccctatgccaccctggttgtctaccagactgtgctcaatgtacctaacacctctgtcttcttgcttctcacggccatttggctgcccaaagtctctctgttggccaaccctgtgctcttcttaactgtgaacaaatcggtacgcaagtgcttggtggggaccctggtgcagttgcaccaccggtacagtcgccgcaatgtggttagtacagggagtggggtggctgagcccagccttgagcccagcatgcgctctggtagccagctcttggagatgttccacattgggcagcaacagatctttaagccctcggaggatgaggaagaaagtgaggccaagtatctcggctcagccgatttccaggcaaaggaggtgctcacttcctgcccagagggcgagcaggagccaccacagcttgcaccgtctgtgccacctccaggcacagtggactctgaacctcgggtgtccccagtagctcccatggaatctgggatatttcctgataagtattccctgcagtttggctttgggccttttgagttaccccctcagtggctctctgagacccgaaatagcaagaagaggctgcttcccccactgggcaataccccagaagagctgatccagacaaaggtgcccagagtgaacagggtggaacggaagatgagcagaaacaataaagtgagcatttttccaaaggtagactcc

SEQ ID NO: 100 - protein, 1584 aa, Homo sapiens
MRGQAAAPGPVWILAPLLLLLLLLGRRARAAAGADAGPGPEPCATLVQGKFFGYFSAAAVFPANASRCSWTLRNPDPRRYTLYMKVAKAPVPCSGPGRVRTYQFDSFLESTRTYLGVESFDEVLRLCDPSAPLAFLQASKQFLQMRRQQPPQHDGLRPRAGPPGPTDDFSVEYLVVGNRNPSRAACQMLCRWLDACLAGSRSSHPCGIMQTPCACLGGEAGGPAAGPLAPRGDVCLRDAVAGGPENCLTSLTQDRGGHGATGGWKLWSLWGECTRDCGGGLQTRTRTCLPAPGVEGGGCEGVLEEGRQCNREACGPAGRTSSRSQSLRSTDARRREELGDELQQFGFPAPQTGDPAAEEWSPWSVCSSTCGEGWQTRTRFCVSSSYSTQCSGPLREQRLCNNSAVCPVHGAWDEWSPWSLCSSTCGRGFRDRTRTCRPPQFGGNPCEGPEKQTKFCNIALCPGRAVDGNWNEWSSWSACSASCSQGRQQRTRECNGPSYGGAECQGHWVETRDCFLQQCPVDGKWQAWASWGSCSVTCGAGSQRRERVCSGPFFGGAACQGPQDEYRQCGTQRCPEPHEICDEDNFGAVIWKETPAGEVAAVRCPRNATGLILRRCELDEEGIAYWEPPTYIRCVSIDYRNIQMMTREHLAKAQRGLPGEGVSEVIQTLVEISQDGTSYSGDLLSTIDVLRNMTEIFRRAYYSPTPGDVQNFVQILSNLLAEENRDKWEEAQLAGPNAKELFRLVEDFVDVIGFRMKDLRDAYQVTDNLVLSIHKLPASGATDISFPMKGWRATGDWAKVPEDRVTVSKSVFSTGLTEADEASVFVVGTVLYRNLGSFLALQRNTTVLNSKVISVTVKPPPRSLRTPLEIEFAHMYNGTTNQTCILWDETDVPSSSAPPQLGPWSWRGCRTVPLDALRTRCLCDRLSTFAILAQLSADANMEKATLPSVTLIVGCGVSSLTLLMLVIIYVSVWRYIRSERSVILINFCLSIISSNALILIGQTQTRNKVMCTLVAAFLHFFFLSSFCWVLTEAWQSYMAVTGHLRNRLIRKRFLCLGWGLPALVVAISVGFTKAKGYSTMNYCWLSLEGGLLYAFVGPAAAVVLVNMVIGILVFNKLVSKDGITDKKLKERAGASLWSSCVVLPLLALTWMSAVLAVTDRRSALFQILFAVFDSLEGFVIVMVHCILRREVQDAVKCRVVDRQEEGNGDSGGSFQNGHAQLMTDFEKDVDLACRSVLNKDIAACRTATITGTLKRPSLPEEEKLKLAHAKGPPTNFNSLPANVSKLHLHGSPRYPGGPLPDFPNHSLTLKRDKAPKSSFVGDGDIFKKLDSELSRAQEKALDTSYVILPTATATLRPKPKEEPKYSIHIDQMPQTRLIHLSTAPEASLPARSPPSRQPPSGGPPEAPPAQPPPPPPPPPPPPQQPLPPPPNLEPAPPSLGDPGEPAAHPGPSTGPSTKNENVATLSVSSLERRKSRYAELDFEKIMHTRKRHQDMFQDLNRKLQHAAEKDKEVLGPDSKPEKQQTPNKRPWESLRKAHGTPTWVKKELEPLQPSPLELRSVEWERSGATIPLVGQDIIDLQTEV

SEQ ID NO: 101 - protein, 1564 aa, Mus musculus
MRGQAAAPGPIWILAPLLLLLLLLGRWARAASGADIGPGTEQCTTLVQGKFFGYFSAAAVFPANASRCSWTLRNPDPRRYTLYMKVAKAPAPCSGPGRVRTYQFDSFLESTRTYLGVESFDEVLRLCDSSAPLAFLQASKQFLQMQRQQPPQDGDLGPQGEFPSSSDDFSVEYLVVGNRNPSHAACQMLCRWLDACLAGSRSSHPCGIMQTPCACLGGDVGDPASSPLVPRGDVCLRDGVAGGPENCLTSLTQDRGGHGSAGGWKLWSLWGECTRDCGGGLQTRTRTCLPTLGVEGGGCEGVLEEGRLCNRKACGPTGRSSSRSQSLRSTDARRREEFGDELQQFGFPSPQTGDPAAEEWSPWSVCSSTCGEGWQTRTRFCVSSSYSTQCSGPLREQRLCNNSAVCPVHGAWDEWSPWSLCSSTCGRGFRDRTRTCRPPQFGGNPCEGPEKQTKFCNIALCPASCFLPPPGRAVDGNWNEWSSWSTCSASCSQGRQQRTRECNGPSYGGAECQGHWVETRDCFLQQCPVDGKWQAWASWGSCSVTCGGGSQRRERVCSGPFFGGAACQGPQDEYRQCGAQRCPEPHEICDEDNFGAVVWKETPAGEVAAVCPRNATGLILRRCELDEEGIAFWEPPTYIRCVSIDYRNIQMMTREHLAKAQRGLPGEGVSEVIQTLLEISQDGTSYSGDLLSTIDVLRNMTEIFRRAYYSPTPGDVQNFVQIISNLLAEENRDKWEEAQLMGPNAKELFRLVEDFVDVIGFRMKDLRDAYQVTDNLVLSIHKLPASGATDISFPMKGWRATGDWAKVPEDRVTVSKSVFSTGLAEADDSSVFVVGTVLYRNLGSFLALQRNTTVLNSKVISVTVKPPPRSLLTPLEIEFAHMYNGTTNQTCILWDETDGPSSSAPPQLGPWSWRGCRTVPLDALRTRCLCDRLSTFAILAQLSADATMDKVTVPSVTLIVGCGVSSLTLLMLVIIYVSVWRYIRSERSVILINFCLSIISSNALILIGQTQTRNKVVCTLVAAFLHFFFLSSFCWVLTEAWQSYMAVTGRLRSRLVRKRFLCLGWGLPALVVAISVGFTKAKGYSTMNYCWLSLEGGLLYAFVGPAAAVVLVNMVIGILVFNKLVSKDGITDKKLKERAGASLWSSCVVLPLLALTWMSAVLAVTDRRSALFQILFAVFDSLEGFVIVMVHCILRREVQDAVKCRVVDRQEEGNGDSGGSFQNGHAQLMTDFEKDVDLACRSVLNKDIAACRTATITGTFKRPSLPEEEKMKLAKGPPPTFNSLPANVSKLHLHGSPRYPGGPLPDFPNHSLTLKKDKAPKSSFIGDGDIFKKLDSELSRAQEKALDTSYVILPTATATLRPKPKEEPKYSINIDQMPQTRLIHLSMAPDASFPTRSPPAREPPGGAPPEVPPPAPPSLGDTGEPAAHPGPSSGAGAKNENVATLSVSSLERRKSRYAELDFEKIMHTRKRHQDMFQDLNRKLQHAAEKEKEVPGADSKPEKQQTPNKRAWESLRKPHGTPAWVKKELEPLPPSPLELRSVEWEKAGATIPLVGQDIIDLQTEV

SEQ ID NO: 102 - DNA, 4629 bp, Mus musculus
atgaggggccaggctgctgccccgggccccatctggatccttgctccactcctgctgttactattgctattggggcgctgggcgcgcgctgcctctggggcagacatagggcctgggacagagcagtgcaccacgttggtgcagggaaagttcttcggctacttctcggcggctgctgtatttccggccaacgcctcacgctgctcttggacccttcgcaacccggaccctcgtcgttacacgctctacatgaaggtggccaaggcacctgcaccctgcagcggccccggccgagttcgtacctaccagttcgactctttcttggagtctacacgcacctacctgggtgtggagagctttgacgaagttctgcggctctgcgattcctctgcacccctcgcctttctacaggccagcaaacagtttctacagatgcaacgccaacagccaccccaagacggtgacctcggaccccagggcgagttccccagctctagtgacgacttctccgtggagtacctggtggtgggcaatcgcaaccccagccatgctgcctgtcagatgctgtgtcgctggctggatgcctgtctagccggcagccgcagctcacacccctgtggcatcatgcagactccctgcgcctgcctgggtggagatgttggagaccctgcttccagccccttggtcccccgtggggacgtctgcttgagggacggcgtagctggtggccctgagaactgcctcaccagcctgacccaggaccggggtgggcacggctcagcaggtggctggaaactgtggtccttgtggggcgaatgtacgcgggactgcgggggaggcctgcaaactcgaacccgcacttgcttacccacccttggtgtggagggcggaggctgcgagggcgttctggaagaaggtcgcctgtgcaatcgcaaggcctgcggtactgggcgcagcagctcacggagccagtccctgaggtccacggatgcccggcgacgtgaggagtttggggatgagctgcagcagtttgggttcccatctccccagacaggtgacccagcagctgaggagtggtccccatggagtgtatgctccagtacctgcggtgagggctggcagacccgcacccgcttctgcgtgtcatcctcgtacagtactcagtgcagtggacctctgagggagcagcggctctgcaacaactcagccgtgtgtccagtgcatggagcctgggatgagtggtcaccctggagcctctgctccagcacctgtggccgtggcttccgtgaccgcactcgcacctgcaggccccctcagtttggaggcaacccctgtgagggtcctgagaagcaaaccaagttctgcaacattgctctgtgcccagcttcatgtttccttcctcccccgggccgggcagtggatggaaactggaacgaatggtccagctggagcacctgctctgccagttgctcccaaggccgccagcagcggacccgagagtgcaatggtccttcctatggaggcgctgagtgccagggccactgggtggagactcgagactgcttcctgcagcaatgcccagtggatggcaaatggcaggcctgggcctcatggggcagctgcagcgtcacatgtggaggtggaagccagcgacgggagcgtgtctgctctgggcctttctttgggggagcagcctgccaggggccccaggacgagtaccgacagtgtggcgctcaacgatgtcctgagccccatgagatttgtgatgaggacaactttggggccgtggtctggaaggagaccccagctggagaggtggctgcagtcggcctcatcctgcgccgctgtgagctggacgaggagggcatcgccttctgggagccgcccacctacatccgctgcgtctccatcgactaccggaacatccagatgatgacccgagaacacctggcaaaggctcagcgggggctgccaggggagggggtctcagaggtcatccagacactgctggagatctcacaggatggcaccagctacagcggcgacctgctctccaccattgatgtcctgaggaacatgacagagattttccgcagggcttactacagccccacgccaggggatgtgcagaactttgtccagatcatcagcaacctgctggcagaagagaaccgggacaagtgggaggaggcgcagctgatgggccccaatgccaaggagctctttcggctggtggaggactttgtggatgtcatcggcttccgcatgaaggatttgagggatgcctaccaggtgacagacaatctggtgctcagcatccacaagcttccggccagtggggccaccgacatcagcttccctatgaagggctggcgtgccaccggagactgggccaaggtgccagaggacagggtcaccgtgtccaagagtgtgttttccacagggctggcagaagctgacgattcatctgtgttcgtggttggtactgtgctctaccgaaacttgggcagcttcctggccctgcagaggaacacaactgtcctcaactctaaggtcatctccgtgactgtgaagcccccgcctcgatcgctgctcacacccttggagatcgagtttgcccacatgtacaacggcactaccaaccagacctgtatcctgtgggatgagacagatgggccctcctcatccgcccccccgcagctcgggccctggtcgtggcgcggctgccgcacggtgcccctcgatgccctccggacgcgctgcctgtgtgaccggctctccaccttcgccatcttagcccagctcagcgccgacgcgaccatggataaggtgaccgtgccctctgtgacgctcatcgtgggctgtggcgtgtcttccctcaccctgctcatgctggtcatcatctacgtgtctgtgtggaggtacattcgctcagagcggtccgttatcctcatcaatttctgcctgtccatcatctcctctaatgctctcatccttatcgggcagacccagacccgcaacaaggttgtgtgcacgctggtggctgccttcttgcacttcttcttcctgtcctcattttgctgggtgctcaccgaggcctggcaatcctacatggccgtcaccggccgcctccggagccggctcgtccgcaaacgctttctctgcctgggctgggggctccctgcactggtggtggccatttctgtgggattcaccaaggccaagggctacagcaccatgaactgctggctctccctggaggggggacttctgtatgccttcgtgggaccggcagctgcagttgtgctggtgaacatggtgatcgggatcctggtgttcaacaagctcgtgtccaaggacggcatcacggacaagaagctgaaggagcgggcaggggcctccctgtggagctcctgcgtggtgctgccgctgctggcgctgacctggatgtctgctgtgcttgctgtcaccgaccgccgctccgccctcttccagatcctcttcgctgtctttgactcactggagggcttcgtcatcgtgatggtgcactgcattctgcgcagagaggtccaggatgctgtgaagtgccgtgtggtagaccgacaagaggagggcaacggggactcagggggctccttccagaacggccatgcccagctcatggtgctgaacaaagacattgcagcctgccgcacagcaactatcacaggtaccttcaagcgaccatcactgcctgaagaggagaagatgaagctggccaagggcccaccccccaccttcaacagcctgccagctaatgtgtccaagctgcacctgcacggttcaccccgctatcctggtgggccactgcctgacttccctaatcactcactcaccctcaaaaaggacaaggcccccaagtcctcttttattggcgatggggacatctttaagaaactggactccgagctgagccgagcccaggagaaggctctggacacgagctacgtgatcctgcccacggccacggccacactccggcccaaacccaaggaggaacccaaatacagcatcaacattgaccagatgccccaaacccgcctcatccaccttagcatggcacctgatgccagcttccctacccgaagcccacctgcccgtgagcccccaggtggtgcaccccctgaggtgccccctcctgcacctcccagcctgggggacacgggggagcctgcggcccacccgggacccagttcaggtgctggggccaagaatgagaacgtggccaccttgtcagtgagctctctggagcggcggaaatcacggtatgcagaactggactttgagaagatcatgcacacacggaagcgacaccaagacatgttccaggacctgaaccggaagctgcagcatgcggctgagaaggagaaggaggtgccaggcgcagacagcaagccagagaagcagcagactcccaacaagagggcctgggagagcctccgcaagccccacgggacgcctgcctgggtaaaaaaggagctggagccactgcccccgtctccactggagctgcggagcgtagagtgggagaaggcgggtgccaccatcccactggttggccaggacatcattgacctccagaccgaggtc

SEQ ID NO: 103 - protein, 1572 aa, Homo sapiens
MTPACPLLLSVILSLRLATAFDPAPSACSALASGVLYGAFSLQDLFPTIASGCSWTLENPDPTKYSLYLRFNRQEQVCAHFAPRLLPLDHYLVNFTCLRPSPEEAVAQAESEVGRPEEEEAEAAAGLELCSGSGPFTFLHFDKNFVQLCLSAEPSEAPRLLAPAALAFRFVEVLLINNNNSSQFTCGVLCRWSEECGRAAGRACGFAQPGCSCPGEAGAGSTTTTSPGPPAAHTLSNALVPGGPAPPAEADLHSGSSNDLFTTEMRYGEEPEEEPKVKTQWPRSADEPGLYMAQTGDPAAEEWSPWSVCSLTCGQGLQVRTRSCVSSPYGTLCSGPLRETRPCNNSATCPVHGVWEEWGSWSLCSRSCGRGSRSRMRTCVPPQHGGKACEGPELQTKLCSMAACPVEGQWLEWGPWGPCSTSCANGTQQRSRKCSVAGPAWATCTGALTDTRECSNLECPATDSKWGPWNAWSLCSKTCDTGWQRRFRMCQATGTQGYPCEGTGEEVKPCSEKRCPAFHEMCRDEYVMLMTWKKAAAGEIIYNKCPPNASGSASRRCLLSAQGVAYWGLPSFARCISHEYRYLYLSLREHLAKGQRMLAGEGMSQVVRSLQELLARRTYYSGDLLFSVDILRNVTDTFKRATYVPSADDVQRFFQVVSFMVDAENKEKWDDAQQVSPGSVHLLRVVEDFIHLVGDALKAFQSSLIVTDNLVISIQREPVSAVSSDITFPMRGRRGMKDWVRHSEDRLFLPKEVLSLSSPGKPATSGAAGSPGRGRGPGTVPPGPGHSHQRLLPADPDESSYFVIGAVLYRTLGLILPPPRPPLAVTSRVMTVTVRPPTQPPAEPLITVELSYIINGTTDPHCASWDYSRADASSGDWDTENCQTLETQAAHTRCQCQHLSTFAVLAQPPKDLTLELAGSPSVPLVIGCAVSCMALLTLLAIYAAFWRFIKSERSIILLNFCLSILASNILILVGQSRVLSKGVCTMTAAFLHFFFLSSFCWVLTEAWQSYLAVIGRMRTRLVRKRFLCLGWGLPALVVAVSVGFTRTKGYGTSSYCWLSLEGGLLYAFVGPAAVIVLVNMLIGIIVFNKLMARDGISDKSKKQRAGSERCPWASLLLPCSACGAVPSPLLSSASARNAMASLWSSCVVLPLLALTWMSAVLAMTDRRSVLFQALFAVFNSAQGFVITAVHCFLRREVQDVVKCQMGVCRADESEDSPDSCKNGQLQILSDFEKDVDLACQTVLFKEVNTCNPSTITGTLSRLSLDEDEEPKSCLVGPEGSLSFSPLPGNILVPMAASPGLGEPPPPQEANPVYMCGEGGLRQLDLTWLRPTEPGSEGDYMVLPRRTLSLQPGGGGGGGEDAPRARPEGTPRRAAKTVAHTEGYPSFLSVDHSGLGLGPAYGSLQNPYGMTFQPPPPTPSARQVPEPGERSRTMPRTVPGSTMKMGSLERKKLRYSDLDFEVMHTRKRHSELYHELNQKFHTFDRYRSQSTAKREKRWSVSSGGAAERSVCTDKPSPGERPSLSQHRRHQSWSTFKSMTLGSLPPKPRERLTLHRAAAWEPTEPPDGDFQTEV

SEQ ID NO: 104 - protein, 1591 aa, Mus musculus
MTPACPLLLSVILSLRLATAFDPAPSACSALASGVLYGAFSLQDLFPTIASGCSWTLENPDPTKYSLYLRFNRQEQVCTHFAPRLLPLDHYLVNFTCLRPGPEEATARAESEVGRPEEEEEEAAAAASGLELCGGSGPFTFLHFDKNFVQLCLSAEPSEAPRLLAPAALAFRFVEVLLINNNNSSQFTCGVLCRWSEECGRAAGRACGFAQPGCSCPGEAGANPATTTSPGPPVAHTLSNALVPGGPAPPAEADLHSGSSNDLFTTEMRYGEEPEEEPKVKTQWPRSADEPGLYMAQTGDPAAEEWSPWSVCSLTCGQGLQVRTRSCVSSPYGTLCSGPLRETRPCNNSATCPVHGVWEEWGSWSLCSRSCGRGSRSRMRTCVPPQHGGKACEGPELQTKLCSMAACPVEGQWLEWGPWGPCSSSCANGTQQRSRKCSVAGPAWATCAGALTDTRECSNLDCPATDGKWGPWNAWSLCSKTCDTGWQRRFRMCQASGTQGYPCEGTGEEVKPCSEKRCPAFHEMCRDEYVMLMTWKRAAAGEIIYNKCPPNASGSASRRCLLSAQGVAYWGLPSFARCISHEYRYLYLSLREHLAKGQRMLAGEGMSQVVRSLQELLARRTYYSGDLLFSVDILRNVTDTFKRATYVPSADDVQRFFQVVSFMVDSENKDKWDDAQQVSPGSVHLLRVVEDFIHLVGDALKAFQSSLIVTDNLVISIQREPISAVSSDITFPMRGRRGMKDWVRHSEDRLFLPKEVLSLSSPGKPATPGAATAGSPGRGRGPGTVPPGPGHAHQRLLPADPEESSSYFVIGAVLYRTLGLILPPPRPPLAVTSRVMTVTVRPPTQPPAEPLITVELSYIINGTTDPHCASWDYSRADTNSGDWNTESCQTLETQAAHTRCQCQHLSTFAVLAQPPKDLTLELAGAPSVPLVIGCAVSCMALLTLLAIYAAFWRFIKSERSIILLNFCLSILASNILILVGQSRVLSKAGAGSWGATPSYYLSLQGVCTMTAAFLHFFFLSSFCWVLTEAWQSYLAVIGRMRTRLVRKRFLCLGWGLPALVVAVSVGFTRTKGYGTSSYCWLSLEGGLLYAFVGPAAVIVLVNMLIGIIVFNKLMARDGVSDKSKKQRAGSERCPWASLLLPCSACGAVPSPLLSSASARNAMASLWSSCVVLPLLALTWMSAVLAMTDRRSVLFQALFAVFNSAQGFVITAVHCFLRREVQDVVKCQMGVCRADESEDSPDSCKNGQLQILSDFEKDVDLACQTVLFKEVNTCNPSTITGTLSRLSLDEDEEPKSCLVGPEGGLSFSPLPGNILVPMAASPGLGEPPPPQETNPVYMCGEGGLRQLDLTWIRQSEPGSEGDYMVLPRRTLSLQPGGGGTAGEEAPRARPEGTPRRAAKTVAHTEGYPSFLSVEHSGLGLGPAYGSLQNPYGMTFQPPPPTPSARQVPEPGERSRTMPRTVPGSTMKLGSLERKKLRYSDLDFEVMHTRKRHSELYHELNQKFHTFDRYRSQSSAKWMRGCNRLALLLSQEKPSPPGGRPGLSQHRRHQSWSTFKSMTLGSLPPKPRERLALHRTAAWEPTEPPDGDFQTEV

SEQ ID NO: 105 - DNA, 4695 bp, Mus musculus
atgaccccagcctgtcccctcttactgtctgtgattctgtccctgcgcctggccacggccttcgaccctgcccccagtgcctgctctgccctggcctcgggcgtgctctacggggccttctcgctgcaggacctctttcccaccatcgcctcgggctgctcctggaccctggagaacccagaccccaccaagtactccctctacctgcgcttcaaccggcaggagcaggtttgcacacactttgccccgcgcctgctgcccctggaccactacctggtcaactttacctgcctgcggcctggtccagaggaagccacagcccgggctgagtcggaggtgggacggccagaggaggaggaggaggaggcggcggcagcagcatcagggttggagttgtgtggtggctcaggcccctttacctttctgcacttcgacaagaactttgtgcagctgtgcctgtcggctgagccctctgaggcccctcgtctgctagcgcctgctgccctggccttccgttttgtggaggtcttgctgatcaacaacaacaactccagccagttcacctgtggtgtgctctgccgctggagtgaggagtgtggccgggctgcaggcagggcttgtggctttgcacagccagggtgtagttgtcctggggaggcaggggccaaccccgccaccaccacatctccggggcctccggttgcccacaccctgtccaatgccctggtgcccgggggcccagcccctcctgctgaggccgacttgcactcggggagcagcaatgacctgttcaccaccgagatgagatatggtgaggagccggaagaggaaccgaaggtgaaaacccagtggccaaggtctgcagatgagcctgggctatacatggcgcagacaggcgacccagcagctgaggagtggtccccgtggagcgtgtgttccctgacgtgtgggcagggtctgcaggtgcggacccgctcctgcgtgtcctccccctatgggaccctgtgcagcgggccccttcgggagacccggccttgcaacaattcagccacctgcccagtgcacggcgtgtgggaggagtgggggtcctggagcctgtgctcccgcagctgcgggcgggggtctcggagccggatgcggacctgcgtgcccccccagcacggcggcaaggcctgcgagggtcccgagctgcagactaaactctgcagtatggccgcctgcccggtggaaggccagtggctagaatggggtccctggggcccatgctcatcatcttgtgccaatgggacccagcagcgcagccggaaatgcagtgtggcgggtccagcctgggccacgtgcgcaggtgccctcacggatacccgtgagtgcagcaatctcgattgcccggccactgacggcaagtgggggccgtggaacgcgtggagcctgtgctccaagacgtgtgacacgggctggcaacgccgcttccgcatgtgccaggcttctggcacacagggctacccttgcgagggcacaggagaggaggtgaaaccctgcagtgagaagaggtgtccagccttccatgagatgtgcagggatgagtacgtgatgttgatgacatggaagagggcggcagctggcgagatcatttacaacaagtgtccccctaatgcctcgggttctgctagccgccgctgtctcctcagtgcccagggcgtagcatactggggactgcccagctttgctcgttgcatatcccatgaataccgctacctgtacctgtcacttcgggaacacctggctaagggccagcgcatgctggcaggtgagggcatgtcacaggtggtgcggagcctgcaggagctactggcacggcgcacttactacagcggggacctgctcttctctgtggacatcctaaggaacgtcactgacaccttcaagagggccacctatgtcccttccgccgatgacgtgcagcgtttcttccaggtggtgagcttcatggtggattcagaaaacaaggacaaatgggatgatgctcagcaggtgtcaccgggctctgtgcacctgctgcgtgttgtggaagatttcattcacctcgtgggcgacgctctcaaggccttccagagctctctcattgtcacggacaatctggtgatcagcattcagagagagcctatctccgccgtgtccagtgacatcacgtttcccatgcggggccgcaggggcatgaaggactgggtgcgacactcagaggatcgtctctttctacccaaggaggtgctcagcctgtcctccccaggaaagccagccacacctggggcagccacagcaggcagcccgggcagggggaggggcccaggaacggtgccccctggcccaggccacgcccaccagcgccttctcccagctgaccccgaagagtcctcctcctactttgtgatcggtgctgtgctctaccgcacccttggcctcatcctgccgccccccaggcctccacttgctgtcacctcccgggtgatgacagtgactgtgcgtccccccacccagcctccagctgagcccctcattacagtggaactctcgtacatcatcaatggcaccaccgatccccactgtgccagctgggactactccagagcggataccaactcgggggactggaacactgagagctgccagaccttggagacccaggcggctcacacccgctgccagtgccagcacctgtccacctttgccgtcctggcccagccacccaaggacctgaccctggagctggcaggtgctccctctgtccccctggtgatcggctgtgcagtgtcctgcatggctctgctcaccctgctggccatctatgcagccttctggaggtttataaaatcagaacgctccatcatcttgctgaacttctgcctgtccatcctggcttccaacattctgatcctggtgggccagtcccgggtgctgagcaaggcaggtgcaggctcctggggggccactccctcctattacctctccctgcagggcgtatgcaccatgacggctgccttcctacacttcttctttctgtcctccttttgctgggtgcttacagaggcctggcaatcctatctggctgtcatcgggcggatgcgcacccgcctggttcgcaagcgcttcctctgcctgggctggggtctacctgccctggtggtggctgtgtctgttggctttactcgcaccaaaggatatggtacatccagctgctggctgtccctagagggcggcctgctctatgccttcgtgggtccagcagcagtcattgtcctggtgaacatgctcatcgggattatcgtcttcaacaagctcatggctcgcgatggcgtctcagacaaatctaagaagcagagggctgggtcggagcggtgcccctgggccagcctgctccttccctgctcagcgtgtggagcggtccccagccccctgctcagctcagcctcggccaggaatgccatggcttcactctggagttcctgcgtggtactgcctctcctggcgcttacctggatgtctgccgtcctggccatgacagatcgccgctccgtcctcttccaggcactctttgccgttttcaactctgcacaaggctttgtcatcaccgctgtgcactgcttcctgcgccgagaggtccaggatgtggtaaagtgtcagatgggtgtgtgtcgggctgatgagagtgaagactccccagactcgtgcaagaacgggcagctgcagatcctggttctgttcaaggaggtcaacacctgcaacccgtccaccattaccggcactctgtcccgcctgtctctggatgaggatgaggagcccaagtcctgtctcgtgggtcctgagggtggcctcagcttctcaccactgcctgggaacatcctggtacccatggcagcctcaccaggtctaggggagccaccaccaccccaggagaccaaccctgtgtacatgtgtggggagggtggcctgcggcagttggaccttacatggatacggcagagtgaaccaggctctgagggggactacatggttctgccccggcggactttgagcctgcagcctggtggtgggggtacagcgggtgaggaggccccaagggcccggcctgaggggaccccccggcgggctgccaaaacggtagcccacactgaaggctaccccagcttcctgtctgtggagcactcgggtctagggctgggccctgcctatgggtctctccagaacccgtatggaatgaccttccaaccaccaccaccaacacccagcgcccgccaagtaccagagccaggagaacgtagccggaccatgccccgtacagtgcctggttccaccatgaagctgggctcccttgaggtgatgcacactcggaaacggcactcggaactctaccacgaactcaaccagaagttccacactttcgaccgctaccgtagccagtcctcagccaagtggatgagagggtgcaacaggctcgccctgctcctttcacaggagaaacccagcccccccgggggacgccctggcttgtcccagcacaggaggcatcaaagctggagcaccttcaaatctatgacactgggctcactgccccccaagccccgagaacggctggccctgcaccggacagcagcctgggagcccacagaaccgccagacggcgacttccagacagaggtg

SEQ ID NO: 106 - protein, 1522 aa, Homo sapiens
MKAVRNLLIYIFSTYLLVMFGFNAAQDFWCSTLVKGVIYGSYSVSEMFPKNFTNCTWTLENPDPTKYSIYLKFSKKDLSCSNFSLLAYQFDHFSHEKIKDLLRKNHSIMQLCNSKNAFVFLQYDKNFIQIRRVFPTNFPGLQKKGEEDQKSFFEFLVLNKVSPSQFGCHVLCTWLESCLKSENGRTESCGIMYTKCTCPQHLGEWGIDDQSLILLNNVVLPLNEQTEGCLTQELQTTQVCNLTREAKRPPKEEFGMMGDHTIKSQRPRSVHEKRVPQEQADAAKFMAQTGESGVEEWSQWSTCSVTCGQGSQVRTRTCVSPYGTHCSGPLRESRVCNNTALCPVHGVWEEWSPWSLCSFTCGRGQRTRTRSCTPPQYGGRPCEGPETHHKPCNIALCPVDGQWQEWSSWSQCSVTCSNGTQQRSRQCTAAAHGGSECRGPWAESRECYNPECTANGQWNQWGHWSGCSKSCDGGWERRIRTCQGAVITGQQCEGTGEEVRRCSEQRCPAPYEICPEDYLMSMVWKRTPAGDLAFNQCPLNATGTTSRRCSLSLHGVAFWEQPSFARCISNEYRHLQHSIKEHLAKGQRMLAGDGMSQVTKTLLDLTQRKNFYAGDLLMSVEILRNVTDTFKRASYIPASDGVQNFFQIVSNLLDEENKEKWEDAQQIYPGSIELMQVIEDFIHIVGMGMMDFQNSYLMTGNVVASIQKLPAASVLTDINFPMKGRKGMVDWARNSEDRVVIPKSIFTPVSSKELDESSVFVLGAVLYKNLDLILPTLRNYTVINSKIIVVTIRPEPKTTDSFLEIELAHLANGTLNPYCVLWDDSKTNESLGTWSTQGCKTVLTDASHTKCLCDRLSTFAILAQQPREIIMESSGTPSVTLIVGSGLSCLALITLAVVYAALWRYIRSERSIILINFCLSIISSNILILVGQTQTHNKSICTTTTAFLHFFFLASFCWVLTEAWQSYMAVTGKIRTRLIRKRFLCLGWGLPALVVATSVGFTRTKGYGTDHYCWLSLEGGLLYAFVGPAAAVVLVNMVIGILVFNKLVSRDGILDKKLKHRAGQMSEPHSGLTLKCAKCGVVSTTALSATTASNAMASLWSSCVVLPLLALTWMSAVLAMTDKRSILFQILFAVFDSLQGFVIVMVHCILRREVQDAFRCRLRNCQDPINADSSSSFPNGHAQIMTDFEKDVDIACRSVLHKDIGPCRAATITGTLSRISLNDDEEEKGTNPEGLSYSTLPGNVISKVIIQQPTGLHMPMSMNELSNPCLKKENSELRRTVYLCTDDNLRGADMDIVHPQERMMESDYIVMPRSSVNNQPSMKEESKMNIGMETLPHERLLHYKVNPEFNMNPPVMDQFNMNLEQHLAPQEHMQNLPFEPRTAVKNFMASELDDNAGLSRSETGSTISMSSLERRKSRYSDLDFEKVMHTRKRHMELFQELNQKFQTLDRFRDIPNTSSMENPAPNKNPWDTFKNPSEYPHYTTINVLDTEAKDALELRPAEWEKCLNLPLDVQEGDFQTEV

SEQ ID NO: 107 - protein, 1515 aa, Mus musculus
MKAVRNLLIYIFSTYLLVMFGFNAAQDFWCSTLVKGVIYGSYSVSEMFPKNFTNCTWTLENPDPTKYSIYLKFSKKDLSCSNFSLLAYQFDHFSHEKIKDLLRKNHSIMQLCSSKNAFVFLQYDKNFIQIRRVFPTDFPGLQKKVEEDQKSFFEFLVLNKVSPSQFGCHVLCTWLESCLKSENGRTESCGIMYTKCTCPQHLGEWGIDDQSLVLLNNVVLPLNEQTEGCLTQELQTTQVCNLTREAKRPPKEEFGMMGDHTIKSQRPRSVHEKRVPQEQADAAKFMAQTGESGVEEWSQWSACSVTCGQGSQVRTRTCVSPYGTHCSGPLRESRVCNNTALCPVHGVWEEWSPWSLCSFTCGRGQRTRTRSCTPPQYGGRPCEGPETHHKPCNIALCPVDGQWQEWSSWSHCSVTCSNGTQQRSRQCTAAAHGGSECRGPWAESRECYNPECTANGQWNQWGHWSGCSKSCDGGWERRMRTCQGAAVTGQQCEGTGEEVRRCSEQRCPAPYEICPEDYLISMVWKRTPAGDLAFNQCPLNATGTTSRRCSLSLHGVASWEQPSFARCISNEYRHLQHSIKEHLAKGQRMLAGDGMSQVTKTLLDLTQRKNFYAGDLLVSVEILRNVTDTFKRASYIPASDGVQNFFQIVSNLLDEENKEKWEDAQQIYPGSIELMQVIEDFIHIVGMGMMDFQNSYLMTGNVVASIQKLPAASVLTDINFPMKGRKGMVDWARNSEDRVVIPKSIFTPVSSKELDESSVFVLGAVLYKNLDLILPTLRNYTVVNSKVIVVTIRPEPKTTDSFLEIELAHLANVSLHPLCRNESLGTWSTQGCKTVLTDASHTKCLCDRLSTFAILAQQPREIVMESSGTPSVTLIVGSGLSCLALITLAVVYAALWRYIRSERSIILINFCLSIISSNILILVGQTQTHNKSICTTTTAFLHFFFLASFCWVLTEAWQSYMAVTGKIRTRLIRKRFLCLGWGLPALVVATSVGFTRTKGYGTDHYCWLSLEGGLLYAFVGPAAAVVLVNMVIGILVFNKLVSRDGILDKKLKHRAGQMSEPHSGLTLKCAKCGVVSTTALSATTASNAMASLWSSCVVLPLLALTWMSAVLAMTDKRSILFQILFAVFDSLQGFVIVMVHCILRREVQDAFRCRLRNCQDPINADSSSSFPNGHAQIMTDFEKDVDIACRSVLHKDIGPCRAATITGTLSRISLNDDEEEKGTNPEGLSYSTLPGNVISKVIIQQPTGLHMPMSMNELSNPCLKKENTELRRTVYLCTDDNLRGADMDIVHPQERMMESDYIVMPRSSVSTQPSMKEESKMNIGMETLPHERLLHYKVNPEFNMNPPVMDQFNMNLDQHLAPQEHMQNLPFEPRTAVKNFMASELDDNVGLSRSETGSTISMSSLERRKSRYSDLDFEKVMHTRKRHMELFQELNQKFQTLDRFRDIPNTSSMENPAPNKNPWDTFKPPSEYQHYTTINVLDTEAKDTLELRPAEWEKCLNLPLDVQEGDFQTEV

SEQ ID NO: 108 - DNA, 4467 bp, Mus musculus
atgaaggctgttcgtaacctgctgatttatatattttccacctatctcctggttatgtttggatttaatgctgcccaagacttctggtgttccactttggtgaagggagtcatttatggatcctattctgtaagtgaaatgtttcccaaaaactttacaaactgcacctggacactggaaaatccagatccaaccaaatatagcatttacctgaaattttccaaaaaggaccttagctgctctaacttttcccttctggcttatcagtttgatcatttttcccatgaaaaaataaaggatcttttgagaaagaaccattccataatgcaactttgcagttccaagaatgcttttgtttttctacagtacgataaaaatttcattcagatacgccgggtatttccaactgatttcccaggattacagaaaaaagtcgaagaggatcagaaatctttttttgagtttttggtactgaacaaggtgagcccgagccagtttggttgccatgtcttatgcacttggttggaaagctgcttaaaatccgaaaatgggagaaccgagtcttgtggaattatgtacacaaaatgcacgtgcccccagcacttgggagagtggggaatagatgaccagtccctggttctgttaaataacgtcgtgttacccctgaatgagcagacggagggttgcctgactcaggagctgcaaactactcaagtctgcaatctgaccagggaggccaagagaccacccaaagaagaatttggaatgatgggagatcatacaattaaaagtcagcgacctcgatctgtccatgagaaaagggtccctcaggaacaagctgatgctgctaaatttatggcacaaactggtgaatctggtgtggaagagtggtcccagtggagcgcatgctcagttacttgtggtcaagggtcgcaggtgcgaaccagaacttgtgtatcaccttacgggacacactgcagcggcccattaagagaatcaagggtttgcaataacactgccctctgtccagtacatggagtttgggaggaatggtcaccttggagcttatgctccttcacatgtggccgaggccaaagaacacgaaccaggtcatgcacacctcctcagtatggaggaaggccctgtgagggacctgaaactcatcacaagccttgtaatattgccctctgtccagttgacggacagtggcaggaatggagttcatggagccactgctcagtgacatgttctaatgggacacagcagaggagtcggcagtgcacagcagctgctcatggaggctctgagtgccgaggaccatgggctgaaagcagggagtgctacaaccctgaatgtacagccaatggtcagtggaatcagtggggtcactggagtggatgttccaagtcctgtgatggtggctgggagaggagaatgaggacttgtcagggcgcagctgtaacaggacagcagtgtgaaggcacaggtgaagaggtacgaagatgcagtgagcagcggtgcccagcaccttatgaaatatgcccagaggattatcttatatcaatggtgtggaaaaggactcctgcaggcgacctggcattcaatcaatgtccactgaatgccacaggcaccactagcagacgctgctctctcagtcttcatggagtggcctcctgggaacagccgagctttgcaagatgcatatccaatgagtacagacacttgcagcattcaattaaagagcaccttgcgaaggggcagcggatgctggcaggtgatggaatgtcccaggtcaccaagacactattggatttaacccagaggaaaaatttctatgcaggtgaccttctggtgtctgtggaaatcctgagaaatgtgacagacacgtttaaaagggcaagttacatccctgcgtctgatggggtccagaacttctttcaaatagttagcaaccttcttgatgaagaaaacaaggagaaatgggaagacgcacaacagatttacccaggctcaatagagttaatgcaggtgattgaagattttatacacattgttggaatggggatgatggactttcaaaattcatacctaatgactggaaatgtagtggcgagcattcagaagctccctgctgcatctgttctaaccgacatcaacttccccatgaaaggccggaaaggaatggtagactgggcaagaaattcagaagatcgcgttgtgattccaaaaagcattttcactcccgtgtcttcaaaagaattagatgaatcatctgtttttgttcttggagcggtcctatacaaaaacttagacctaattttgcctactttgagaaattacactgtcgtcaattctaaagtcatcgtggtcacaatcaggcctgaacctaaaacaactgactcatttttggagatagagctagctcacttggcaaatgtaagtctccaccccctttgcaggaacgagtctttgggaacgtggtccacccagggatgtaaaactgtgcttaccgatgcatcccatacgaaatgcttatgtgatcggctctctaccttcgccattttggctcagcaacctagagaaatagtcatggaatcctctggtaccccctcagttaccctcatagtaggcagtggcctctcctgcctggccttgataactctagcagttgtgtacgcagcactatggaggtatattcgctctgagaggtccatcattctaattaacttctgcctgtctatcatctcatccaatatcctcatactggttggacagactcagacacacaataagagcatctgcacgaccaccaccgcgttcctgcattttttcttcctggcttcattctgttgggtcttgacagaggcgtggcagtcgtatatggctgtgacaggaaaaatcaggacccggcttataagaaaacgctttttgtgccttggatgggggctgccagctttagtagtggccacatctgtaggcttcactaggacgaaaggatacggcacggatcactgctggctgtctctagaaggaggactgctctatgccttcgttggacctgcagcggctgttgtcctggtcaacatggtgattggcattttggtatttaataaacttgtttccagagatgggatcctagataaaaagctaaaacacagagccgggcagatgagtgagcctcatagcggtctgacgctcaaatgtgccaagtgtggagtagtttctacaacagctttgtcagccaccaccgccagtaacgccatggcctctctttggagctcctgtgtggtgctaccgcttctggctctgacatggatgtctgcagttctggccatgacagataaacgctccatattgtttcagatactttttgccgtgtttgattcattacaaggctttgtgatagtcatggtccactgcattcttcggagagaggttcaagatgcatttagatgccggttgagaaactgccaggatccaatcaatgctgattcttcaagttcttttcctaatggacatgctcaaatcatggtgcttcataaggatatcggcccctgccgcgcagcaaccataacaggaacactctccaggatttctctaaatgatgatgaggaagaaaagggaacaaaccctgaagggctaagctactcaacattgcctggaaatgtcatttccaaagtcatcattcaacagcccacaggcctgcacatgcctatgagtatgaacgagctaagcaatccgtgtctgaaaaaagagaacactgaactgcggagaactgtgtacttatgcacggatgacaatctgagaggggccgatatggacattgtccacccccaagaacgaatgatggaaagtgactatattgtgatgcctagaagttctgtaagcacccagccatcaatgaaagaggagagcaagatgaatattggcatggaaaccttgccgcatgaaaggctattacactacaaagtaaaccctgaattcaatatgaatccccccgtaatggaccagtttaatatgaacttagatcagcatcttgcaccccaggaacatatgcagaatttaccctttgagcctcgcacagctgtgaagaatttcatggcctctgagttggatgataatgtgggactgtcaagaagtgaaactggatcaacgatatcaatgagttctctagagaaggtcatgcacacaaggaagaggcacatggaattgtttcaggaactaaatcagaagtttcagactttggacagatttcgggacataccaaacacaagcagtatggaaaacccagcaccaaacaagaatccatgggacactttcaaaccccccagtgaataccaacattacaccacaatcaatgtcttagacacggaggcaaaggatactctggagctgaggccggccgagtgggagaagtgtctgaatttgcctctggatgtgcaagagggtgattttcaaacagaagtg

SEQ ID NO: 109 - protein, 512 aa, Homo sapiens
MDFESGQVDPLASVILPPNLLENLSPEDSVLVRRAQFTFFNKTGLFQDVGPQRKTLVSYVMACSIGNITIQNLKDPVQIKIKHTRTQEVHHPICAFWDLNKNKSFGGWNTSGCVAHRDSDASETVCLCNHFTHFGVLMDLPRSASQLDARNTKVLTFISYIGCGISAIFSAATLLTYVAFEKLRRDYPSKILMNLSTALLFLNLLFLLDGWITSFNVDGLCIAVAVLLHFFLLATFTWMGLEAIHMYIALVKVFNTYIRRYILKFCIIGWGLPALVVSVVLASRNNNEVYGKESYGKEKGDEFCWIQDPVIFYVTCAGYFGVMFFLNIAMFIVVMVQICGRNGKRSNRTLREEVLRNLRSVVSLTFLLGMTWGFAFFAWGPLNIPFMYLFSIFNSLQGLFIFIFHCAMKENVQKQWRRHLCCGRFRLADNSDWSKTATNIIKKSSDNLGKSLSSSSIGSNSTYLTSKSKSSSTTYFKRNSHTDNVSYEHSFNKSGSLRQCFHGQVLVKTGPC

SEQ ID NO: 110 - protein, 507 aa, Mus musculus
MDFGNGQTDPLASVILPPNLLENLSPEDSVLVRRAQFTFFNKTGLFQDVGSQRKVLVSYVMACSIGNITIQNLKDPVQIKIKHTRTQEVHHPICAFWDMNKNKSFGGWNTSGCVAHSDLDAGETICLCSHFTHFGVLMDLPRSASQIDGRNTKVLTFITYIGCGISAIFSAATLLTYVAFEKLRRDYPSKILMNLSSALLFLNLIFLLDGWVTSFGVAGLCTAVAALLHFFLLATFTWMGLEAIHMYIALVKVFNTYIHRYILKFCIIGWGLPALVVSIILVSRRQNEVYGKESYGKDQDDEFCWIQDPVVFYVSCAGYFGVMFFLNVAMFIVVMVQICGRNGKRSNRTLREEVLRNLRSVVSLTFLLGMTWGFAFFAWGPLNIPFMYLFSIFNSLQGLFIFIFHCAMKENVQKQWRRHLCCGRFRLADNSDWSKTATNIIKKSSDNLGKSLSSSSIGSNSTYLTSKSKSSSTTYFKRNSHSENSFNKSGSLRQHFHGQVPVKTDPC

SEQ ID NO: 111 - DNA, 1521 bp, Mus musculus
atggacttcgggaacggacagacagatccactggcatctgtgattttgcctccaaatttgcttgagaatttaagccccgaagattctgtattggtcaggagagcacagttcactttcttcaacaaaaccggacttttccaggatgttggatctcaaagaaaagtcctcgtgagttatgtgatggcgtgcagcattggaaacattactatccagaatctgaaagatccggttcaaatcaaaatcaaacacaccagaacacaggaagtgcatcatcctatctgtgccttctgggatatgaacaaaaacaaaagtttcggggggtggaacacctcaggatgtgttgcccactctgatttggacgctggtgagaccatttgtctgtgcagccacttcactcactttggagttctgatggatcttccaaggagtgcctcacaaatagatggaagaaacacaaaagtcctcacgttcattacctatattgggtgcggaatatctgccattttctcagctgcaactctcctgacatatgttgcttttgagaagctgcgcagggattatccctccaaaatcctgatgaatctgagctcggccttgctcttcctgaatctcatcttcctcctggatggctgggtcacttcctttggcgtggctggactctgcacggctgtggctgccctgttgcacttcttcctcctggctaccttcacctggatggggctggaagccatccacatgtacattgctcttgtgaaagtgtttaacacttacatccaccgctatattctaaaattctgcatcataggctggggtctgccagccttggtggtgtcaattattctagtgagcagaagacaaaatgaagtatatggaaaagaaagttatgggaaagatcaggatgatgaattctgctggattcaggatcctgtggtgttttatgtgagctgtgccgggtacttcggagtcatgttcttcctgaatgtcgccatgttcattgtggtcatggtgcagatctgtgggaggaatggaaagagaagcaaccggaccctgagagaagaggttttaagaaacctgcgcagtgtggtcagcctgaccttcctgcttggcatgacgtgggggtttgctttctttgcctggggacccttaaatattcctttcatgtacctcttctccatcttcaattcattacaaggtttatttatattcatcttccactgtgcgatgaaggagaatgttcagaaacagtggaggcgtcacctctgctgtggcaggtttcggctagcagacaactcagattggagtaagacagctaccaatatcatcaagaagagctccgataacctggggaaatctttgtcttcaagctccattggctccaattcaacatatctcacatccaaatcaaagtccagctccactacctatttcaaaagaaacagccactcggagaattccttcaacaaaagtggatcactcagacagcacttccacggacaagtccctgtcaaaactgacccatgc

SEQ ID NO: 112 - protein, 446 aa, Homo sapiens
MRTLNTSAMDGTGLVVERDFSVRILTACFLSLLILSTLLGNTLVCAAVIRFRHLRSKVTNFFVISLAVSDLLVAVLVMPWKAVAEIAGFWPFGSFCNIWVAFDIMCSTASILNLCVISVDRYWAISSPFRYERKMTPKAAFILISVAWTLSVLISFIPVQLSWHKAKPTSPSDGNATSLAETIDNCDSSLSRTYAISSSVISFYIPVAIMIVTYTRIYRIAQKQIRRIAALERAAVHAKNCQTTTGNGKPVECSQPESSFKMSFKRETKVLKTLSVIMGVFVCCWLPFFILNCILPFCGSGETQPFCIDSNTFDVFVWFGWANSSLNPIIYAFNADFRKAFSTLLGCYRLCPATNNAIETVSINNNGAAMFSSHHEPRGSISKECNLVYLIPHAVGSSEDLKKEEAAGIARPLEKLSPALSVILDYDTDVSLEKIQPITQNGQHPT

SEQ ID NO: 113 - protein, 446 aa, Mus musculus
MAPNTSTMDETGLPVERDFSFRILTACFLSLLILSTLLGNTLVCAAVIRFRHLRSKVTNFFVISLAVSDLLVAVLVMPWKAVAEIAGFWPFGSFCNIWVAFDIMCSTASILNLCVISVDRYWAISSPFQYERKMTPKAAFILISVAWTLSVLISFIPVQLSWHKAKPTWPLDGNFTSLEDAEDDNCDTRLSRTYAISSSLISFYIPVAIMIVTYTSIYRIAQKQIRRISALERAAVHAKNCQTTTGNGNPVECSQSESSFKMSFKRETKVLKTLSVIMGVFVCCWLPFFISNCMVPFCGSEETQPFCIDSITFDVFVWFGWANSSLNPIIYAFNADFQKAFSTLLGCYRLCPTTNNAIETVSINNNGAVMFSSHHEPRGSISKDCNLVYLIPHAVGSSEDLKREEAGGIPKPLEKLSPALSVILDYDTDVSLEKIQPVTHSGQHST

SEQ ID NO: 114 - DNA, 1338 bp, Mus musculus
atggctcctaacacttctaccatggatgagactggcctgccagtggagagggacttctcctttcgcatcctcacagcctgttttctgtccctgcttatcctgtccactctcttagggaatacccttgtctgtgccgctgtcatcaggtttcgacacctgcggtccaaggtgaccaacttctttgtcatctctttagctgtgtcagatctcttggtggctgtcttggtcatgccctggaaagctgtggctgagattgctggcttttggccctttgggtccttttgtaacatttgggtagcctttgacatcatgtgctccacggcatccatccttaacctctgtgtgatcagcgtggacaggtattgggctatctccagccctttccagtatgagaggaagatgactccgaaggcagccttcatcctgattagcgtagcatggactttgtctgttctcatatccttcattccagtgcagctaagctggcacaaggcaaaacctacatggcccttggatggcaattttacttccctggaagatgccgaggatgacaactgtgacacgaggttgagcaggacatacgccatttcatcctccctcataagcttttacatccccgtagccattatgatcgtcacttacaccagtatctacaggattgcccagaagcaaatccggcgcatctcagctttggagagggcagcagtccatgccaagaactgccagaccaccacaggtaatggaaaccctgtcgaatgctctcaatcagaaagttcctttaagatgtcctttaagagggagactaaagtcctgaagacactgtctgtgatcatgggggtattcgtgtgctgctggctccctttcttcatttcgaactgtatggtgcccttctgtggctctgaggagacccagccattctgcattgattccatcaccttcgatgtatttgtgtggtttggctgggcgaattcctccctgaaccccattatttatgcttttaatgccgattttcagaaggcattctcgaccctcttaggatgctatagactctgccctacaacgaataatgccatagagactgtaagcatcaacaacaacggggctgtgatgttttccagccaccatgagccccgaggctccatctccaaggactgtaatctggtttacctgatccctcatgctgtgggctcctctgaggacctgaagagggaggaggccggtggcatacctaagccactggagaagctgtccccggccttatcggtcatattggactatgacaccgatgtctctctagaaaagatccaacccgttacccacagcggacagcattcaacc

SEQ ID NO: 115 - protein, 477 aa, Homo sapiens
MLPPGSNGTAYPGQFALYQQLAQGNAVGGSAGAPPLGPSQVVTACLLTLLIIWTLLGNVLVCAAIVRSRHLRANMTNVFIVSLAVSDLFVALLVMPWKAVAEVAGYWPFGAFCDVWVAFDIMCSTASILNLCVISVDRYWAISRPFRYKRKMTQRMALVMVGLAWTLSILISFIPVQLNWHRDQAASWGGLDLPNNLANWTPWEEDFWEPDVNAENCDSSLNRTYAISSSLISFYIPVAIMIVTYTRIYRIAQVQIRRISSLERAAEHAQSCRSSAACAPDTSLRASIKKETKVLKTLSVIMGVFVCCWLPFFILNCMVPFCSGHPEGPPAGFPCVSETTFDVFVWFGWANSSLNPVIYAFNADFQKVFAQLLGCSHFCSRTPVETVNISNELISYNQDIVFHKEIAAAYIHMMPNAVTPGNREVDNDEEEGPFDRMFQIYQTSPDGDPVAESVWELDCEGEISLDKITPFTPNGFH

SEQ ID NO: 116 - protein, 475 aa, Mus musculus
MLPPGRNGTAHRARLGLQRQLAQVDAPGGSAAPLGPAQVVTAGLLTLLIVWTLLGNVLVCAAIVRSRHLRAKMTNIFIVSLAVSDLFVALLVMPWKAVAEVAGYWPFGAFCDIWVAFDIMCSTASILNLCIISVDRYWAISRPFRYERKMTQRVALVMVALAWTLSILISFIPVQLNWHRDKAGSQGREGLLSNETPWEEGWELDGRTENCDSSLNRTYAISSSLISFYIPVAIMIVTYTRIYRIAQVQIRRISSLERAAEHAQSCRSRGACEPDPSLRASIKKETKVFKTLSVIMGVFVCCWLPFFILNCMVPFCSSGDAQGPRTGFPCVSETTFDIFVWFGWANSSLNPIIYAFNADFRKVFAQLLGCSHLCFRTPVQTVNISNELISYNQDTVFHREIAAAYVHMIPNAVSSGDREVGEEEEAEEEGPFDHMSQISPTTPDGDLAAESVWELDCEEEVSLGKISPLTPNCFH

SEQ ID NO: 117 - DNA, 1425 bp, Mus musculus
atgctgcctcctgggcgcaatggcaccgcacatcgggcgcggctggggttgcagaggcaactggcgcaggtggacgcccccgggggctcagcagccccactgggacccgcgcaggtggtcaccgctggcctcctgactctcttaatcgtctggaccttgctcggcaacgtcctagtgtgtgctgctatcgtccgcagccgccacctgcgcgccaaaatgaccaacatcttcatcgtatctctggccgtctcagacctcttcgtggcattgctggtcatgccttggaaggccgtggctgaggtggccgggtactggccctttggggcattctgcgacatctgggtggcctttgacatcatgtgctccactgcttccatcctgaatctgtgtatcatcagcgtggaccggtactgggctatttccagacccttccgctacgagcgcaagatgacccagcgtgtagccctggtcatggtggccctggcctggaccttgtccatcctcatctcctttatcccggtccaactcaattggcacagagacaaggcaggctcccagggccgagagggcctgctgtccaatgagacaccctgggaggaaggttgggagctagacgggagaacagagaactgtgactccagcctgaaccgaacctacgccatctcctcgtcgctcatcagcttctatatcccggtagccatcatgatagtgacctacacgcgcatctaccgcattgcacaggttcagatccgccgtatctcctccctagaaagggcagctgagcatgctcagagttgccggagccgtggggcctgcgaacctgaccccagcctgcgagcatccatcaagaaggagaccaaggtcttcaaaaccctgtccgtgatcatgggggtcttcgtgtgctgctggttgcctttcttcatcctgaactgtatggttcccttctgcagcagtggagatgcccagggcccaaggactggcttcccttgtgtcagcgagaccaccttcgacatattcgtctggtttggctgggccaactcctctctcaaccccatcatctatgcctttaatgcagacttccggaaggtgttcgcccagctgctggggtgcagccacctctgcttccggacccccgtgcagacggtaaacatcagtaatgaacttatttcctacaaccaagacacggtcttccacagggagatcgctgctgcctatgtccacatgatcccaaatgcggtgtcctccggagacagggaggtgggagaggaggaggaggcggaggaggaggggcctttcgatcacatgtctcaaatctctccaacgaccccagatggtgacctggctgctgagtctgtctgggagcttgactgtgaggaggaggtttccttaggcaaaatctcaccactcacccccaattgtttccat

SEQ ID NO: 118 - protein, 361 aa, Homo sapiens [sequence omitted]

SEQ ID NO: 119 - protein, 357 aa, Mus musculus
MANNFTTPLATSHGNNCDLYAHHSTARVLMPLHYSLVFIIGLVGNLLALVVIVQNRKKINSTTLYSMNLVISDILFTTALPTRIAYYALGFDWRIGDALCRVTALVFYINTYAGVNFMTCLSIDRFFAVVHPLRYNKIKRIEYAKGVCLSVWILVFAQTLPLLLTPMSKEEGDKTTCMEYPNFEGTASLPWILLGACLLGYVLPITVILLCYSQICCKLFRTAKQNPLTEKSGVNKKALNTIILIIVVFILCFTPYHVAIIQHMIKMLCSPGALECGARHSFQISLHFTVCLMNFNCCMDPFIYFFACKGYKRKVMKMLKRQVSVSISSAVRSAPEENSREMTESQMMIHSKASNGR

SEQ ID NO: 120 - DNA, 1083 bp, Mus musculus
ctggatacagaaatggctaacaatttcactaccccactggcaacgtctcatggcaataactgtgatctctatgcccaccacagcacagccagggtattaatgcctctgcattacagcctggtcttcatcattgggctggtgggaaacctgctggccttggttgtcattgttcaaaacagaaaaaaaatcaactcaaccactctctattcaatgaacttggtcatttctgacatcctgtttaccacagctttacccactcggatagcctactatgcgctgggctttgattggaggataggtgatgccctgtgccgggtaactgctctggtgttctacatcaacacgtacgcaggtgtgaacttcatgacttgcttgagcatagaccgcttcttcgctgtggtgcaccctctgcgctacaacaagattaaaagaatcgaatacgcaaagggtgtctgcctgtccgtctggattctggtctttgctcaaacactgccgctgctcctcacccctatgtctaaggaggagggagacaagaccacttgcatggagtatccaaactttgaagggacagcgtccctgccgtggattctgctcggagcctgtctgctgggctacgtgctgcctatcacagtcattctcctgtgttactctcagatctgctgcaaactcttcaggactgccaagcagaacccactcaccgagaaatctggtgtgaacaaaaaggctctcaacacaattatcctcatcattgtcgtgttcatcctgtgcttcacgccctaccacgtggccatcattcagcacatgataaagatgctctgctcccctggagccctggagtgtggggcgagacattccttccagatctctctgcacttcacggtgtgcctgatgaacttcaactgctgcatggacccgttcatatacttctttgcatgcaaagggtataagagaaaggtcatgaagatgctcaaacgtcaagtgagtgtgtcgatctccagcgcagtgaggtcagcccctgaagagaattcgcgggaaatgacagagtctcagatgatgatccactccaaggcctccaatggaagg

SEQ ID NO: 121 - protein, 797 aa, Homo sapiens
MASCRAWNLRVLVAVVCGLLTGIILGLGIWRIVIRIQRGKSTSSSSTPTEFCRNGGTWENGRCICTEEWKGLRCTIANFCENSTYMGFTFARIPVGRYGPSLQTCGKDTPNAGNPMAVRLCSLSLYGEIELQKVTIGNCNENLETLEKQVEDVTAPLNNISSEVQILTSDANKLTAENITSATRVVGQIFNTSRNASPEAKKVAIVTVSQLLDASEDAFQRVAATANDDALTTLIEQMETYSLSLGNQSVVEPNIAIQSANFSSENAVGPSNVRFSVQKGASSSLVSSSTFIHTNVDGLNPDAQTELQVLLNMTKNYTKTCGFVVYQNDKLFQSKTFTAKSDFSQKIISSKTDENEQDQSASVDMVFSPKYNQKEFQLYSYACVYWNLSAKDWDTYGCQKDKGTDGFLRCRCNHTTNFAVLMTFKKDYQYPKSLDILSNVGCALSVTGLALTVIFQIVTRKVRKTSVTWVLVNLCISMLIFNLLFVFGIENSNKNLQTSDGDINNIDFDNNDIPRTDTINIPNPMCTAIAALLHYFLLVTFTWNALSAAQLYYLLIRTMKPLPRHFILFISLIGWGVPAIVVAITVGVIYSQNGNNPQWELDYRQEKICWLAIPEPNGVIKSPLLWSFIVPVTIILISNVVMFITISIKVLWKNNQNLTSTKKVSSMKKIVSTLSVAVVFGITWILAYLMLVNDDSIRIVFSYIFCLFNTTQGLQIFILYTVRTKVFQSEASKVLMLLSSIGRRKSLPSVTRPRLRVKMYNFLRSLPTLHERFRLLETSPSTEEITLSESDNAKESI

SEQ ID NO: 122 - protein, 785 aa, Mus musculus
MRSCRSCNVRVLVAIVCGLLTGIVLGLGIWRMVIRINRGIFVPVPSIPVQFCRNGGTWQNGRCICTEEWKGLRCTIANFCENSTDGEFTFGSIPVGRYGPSLQTCEPGTLNAGSPKATRLCNVSEFGNIELQNVTKGSCNINLQTLEIQINNQTASAENISREAQVLTADASKLTAQNITSATTVVGQIFGKANNESQAKKTAIATVSQILDASEDVFQKAAEMDNSKSFSNLIKQMENYSYSQGDQTVVEPNIAIQSVTRDDNSGPSVLFSVQKGSSNSLVSGRILINKTANGLNPDGQTELQILLNTGENRKSCGFMVYQNHKLFQSKTFTATSDFSQKIISSKINESEQQRQNKVSVEMVFNPTYDKRELRLHSYACVYWNFLINDWDTQGCQKTGNTTEFLRCNCSHTTNFAVLMSFKKDYKYPKSLDILSNIGCALSIAGLALTILFQILTRKIRKTSVTWVLVSLCSSMLIFNLLFVFGIENSNKNLKTSDSDINVKPENNKIPESDTIETPNPSCTAIAALLHYFLLVTFTWNGLSATQLYFLLIRTMKPLPRHFIIFISLVGWGVPAIIVGVTIGSIYALSGNKRYWELDYRQEEICWLAVPKDNDYARSPLLWSFIIPVTIILITNITIFVIITVKVLWKNNQNLTSTKKVSSLKKVFSTLSIAVVFGVTWILAYAMLISNDDIRIVFSYIFCLFNTTQGLQIFILYTVRTKVFQSEASKILKSLSSSFDRTKPMPSITPLKLRVRMYNMLRSLPSLNERFRLLEPSGMTEETSLS

SEQ ID NO: 123 - DNA, 2355 bp, Mus musculus
atgcgttcctgtcgttcctgcaatgtccgggtactggtggctattgtgtgtgggctactgacaggcattgttctgggactcggcatctggaggatggtcataaggatcaacagagggatatttgttcctgtgccaagtatccctgtacagttctgcaggaatggcggaacctggcaaaatggcagatgcatttgtacagaagagtggaaagggctgcgttgtacaattgctaatttctgtgaaaatagtaccgacggtgaattcacctttggcagtatcccagtgggcagatatggaccctctttgcaaacatgtgaaccgggcaccctcaatgcgggcagtcctaaagcaactcggctgtgcaatgtttctgagtttggaaacatagaactacaaaatgtaaccaaaggaagttgtaatataaatctacagaccctggagatacagataaacaaccaaacagcaagtgctgagaatatttctagagaagcccaggttttaacagcagatgccagtaaactgactgctcagaatatcacttctgctactacagtggttggacagatcttcggtaaagccaacaatgaaagccaggcaaaaaaaactgctatagccacagtgagtcagattttggatgccagtgaagatgtttttcaaaaagctgctgagatggacaacagcaaatcctttagcaatcttatcaagcaaatggagaattactcctattctcaaggtgatcagacagtggtggaacccaatatagcaatccagtccgtcactcgagacgacaattcagggccaagtgttctcttctccgtacagaaaggatctagtaattctctggtttctggtagaatattgattaacaaaactgcaaatggactcaacccagacggacagaccgaacttcagatcttacttaatactggggaaaatagaaaatcatgtggttttatggtgtatcaaaaccacaaacttttccaatcaaaaactttcactgctacatcagattttagtcaaaaaattatctccagcaaaataaatgaaagtgaacaacaacgccaaaataaagtttctgtggaaatggtatttaatcctacgtatgacaaaagagaactccggcttcactcctatgcttgtgtctactggaattttttaataaatgactgggacacacaaggctgccaaaaaaccgggaacaccacagaattcctccgttgcaactgcagccacacgaccaatttcgctgtattgatgagtttcaaaaaggattacaagtatcccaaatctctagacatattatccaacatcggctgtgccttatccattgctggtctggctctcacaatcttattccagattctcaccaggaaaatcagaaaaacctcagtaacctgggtgttggtcagtttgtgttcatcaatgttgatttttaacctcctctttgtgtttggaattgaaaactccaataagaacctaaagacaagtgatagtgacatcaatgttaaacctgaaaataacaaaataccagaaagtgacaccattgaaaccccgaatccctcatgcacagccattgctgccttgctccactactttctgctggtgacattcacctggaatggactcagtgctacacaactctacttccttctgataagaaccatgaagcctctccctcggcatttcattatcttcatctcattagttggatggggagttccagcaataatagtaggtgtgacgattgggagtatttatgccctgagtgggaacaagaggtactgggagttagactatcggcaagaggaaatttgctggctggccgttcccaaggacaatgattatgcaagaagtccacttttgtggtcgttcatcatacctgtaaccattatcctcatcaccaacattactatatttgtcataatcacagtcaaagtgttgtggaagaacaaccagaacctgacaagcacaaaaaaagtttcatccctaaagaaggttttcagcacactatctatcgctgttgtttttggagttacctggatcttggcatatgctatgctaattagtaacgatgacatcaggattgttttcagctacatattctgtcttttcaacaccactcagggattgcaaatattcattctctacactgttcgaacaaaagtatttcagagtgaagcttccaaaatactgaagtcactgtcatcatcctttgatagaacgaagccaatgccttcgataaccccgctgaaactgcgtgtaaggatgtacaatatgctcaggtccctaccatccctaaatgaacgctttaggctgctggagccatctggaatgactgaggaaacatcattgtct

SEQ ID NO: 124 - protein, 366 aa, Homo sapiens
MWNATPSEEPGFNLTLADLDWDASPGNDSLGDELLQLFPAPLLAGVTATCVALFVVGIAGNLLTMLVVSRFRELRTTTNLYLSSMAFSDLLIFLCMPLDLVRLWQYRPWNFGDLLCKLFQFVSESCTYATVLTITALSVERYFAICFPLRAKVVVTKGRVKLVIFVIWAVAFCSAGPIFVLVGVEHENGTDPWDTNECRPTEFAVRSGLLTVMVWVSSIFFFLPVFCLTVLYSLIGRKLWRRRRGDAVVGASLRDQNHKQTVKMLAVVVFAFILCWLPFHVGRYLFSKSFEPGSLEIAQISQYCNLVSFVLFYLSAAINPILYNIMSKKYRVAVFRLLGFEPFSQRKLSTLKDESSRAWTESSINT

SEQ ID NO: 125 - protein, 364 aa, Mus musculus
MWNATPSEEPEPNVTLDLDWDASPGNDSLSDELLPLFPAPLLAGVTATCVALFVVGISGNLLTMLVVSRFRELRTTTNLYLSSMAFSDLLIFLCMPLDLVRLWQYRPWNFGDLLCKLFQFVSESCTYATVLTITALSVERYFAICFPLRAKVVVTKGRVKLVILVIWAVAFCSAGPIFVLVGVEHENGTDPRDTNECRATEFAVRSGLLTVMVWVSSVFFFLPVFCLTVLYSLIGRKLWRRRGDAAVGSSLRDQNHKQTVKMLAVVVFAFILCWLPFHVGRYLFSKSFEPGSLEIAQISQYCNLVSFVLFYLSAAINPILYNIMSKKYRVAVFKLLGFESFSQRKLSTLKDESSRAWTKSSINT

SEQ ID NO: 126 - DNA, 1092 bp, Mus musculus
atgtggaacgcgacgcccagcgaggagccggagcctaacgtcacgctggacctggactgggacgcttctcccggcaacgactcactctctgacgaactgctgccactgttccccgcgccgctgctggcgggcgtcactgccacctgcgtggcgctcttcgtggtgggcatctcgggcaacctgctcaccatgctggtggtgtcccgcttccgcgagctgcgcaccaccaccaacctctacctatccagcatggccttctccgatctgctcatcttcctgtgcatgccgctggacctcgtccgcctctggcagtatcggccctggaacttcggcgacctgctctgcaaactcttccagtttgtcagcgagagctgcacctacgccacggtcctcaccatcaccgcgctgagcgtcgagcgctacttcgccatctgcttcccgctgcgggccaaggtggtggtcaccaagggccgtgtgaagctggtcatccttgtcatttgggccgtggccttctgcagcgcggggcccatcttcgtgctggtgggcgtggagcacgagaacggcacagatccccgggacaccaacgagtgccgcgccaccgagttcgctgtgcgctctgggctgctcaccgtgatggtatgggtgtcgagcgtcttcttcttcctgccggtcttctgcctcactgtgctctacagtctcatcgggaggaagctgtggcggaggcgcggcgacgcggcggtgggctcctcgctcagggaccagaaccacaaacagacagtgaagatgcttgctgtggtggtgtttgctttcatcctctgctggctgcccttccacgtgggaagatatctgttttccaagtctttcgagcctggctctctggagatcgcgcagatcagtcagtactgcaacctggtgtcctttgtcctcttctacctcagcgctgccatcaaccccattctctacaacatcatgtccaagaagtaccgggtggccgtgttcaaacttctaggatttgaatccttctcccagagaaagctttccactctgaaggatgagagttcccgggcctggacaaagtcgagcatcaataca

SEQ ID NO: 127 - protein, 466 aa, Homo sapiens
MTTSPILQLLLRLSLCGLLLQRAETGSKGQTAGELYQRWERYRRECQETLAAAEPPSGLACNGSFDMYVCWDYAAPNATARASCPWYLPWHHHVAAGFVLRQCGSDGQWGLWRDHTQCENPEKNEAFLDQRLILERLQVMYTVGYSLSLATLLLALLILSLFRRLHCTRNYIHINLFTSFMLRAAAILSRDRLLPRPGPYLGDQALALWNQALAACRTAQIVTQYCVGANYTWLLVEGVYLHSLLVLVGGSEEGHFRYYLLLGWGAPALFVIPWVIVRYLYENTQCWERNEVKAIWWIIRTPILMTILINFLIFIRILGILLSKLRTRQMRCRDYRLRLARSTLTLVPLLGVHEVVFAPVTEEQARGALRFAKLGFEIFLSSFQGFLVSVLYCFINKEVQSEIRRGWHHCRLRRSLGEEQRQLPERAFRALPSGSGPGEVPTSRGLSSGTLPGPGNEASRELESYC

SEQ ID NO: 128 - protein, 460 aa, Mus musculus
MPLRLLLLLLWLWGLQWAETDSEGQTTTGELYQRWEHYGQECQKMLETTEPPSGLACNGSFDMYACWNYTAANTTARVSCPWYLPWFRQVSAGFVFRQCGSDGQWGSWRDHTQCENPEKNGAFQDQTLILERLQIMYTVGYSLSLTTLLLALLILSLFRRLHCTRNYIHMNLFTSFMLRAAAILTRDQLLPPLGPYTGDQAPTPWNQALAACRTAQIMTQYCVGANYTWLLVEGVYLHHLLVIVGRSEKGHFRCYLLLGWGAPALFVIPWVIVRYLRENTQCWERNEVKAIWWIIRTPILITILINFLIFIRILGILVSKLRTRQMRCPDYRLRLARSTLTLVPLLGVHEVVFAPVTEEQVEGSLRFAKLAFEIFLSSFQGFLVSVLYCFINKEVQSEIRQGWRHRRLRLSLQEQRPRPHQELAPRAVPLSSACREAAVGNALPSGMLHVPGDEVLESYC

SEQ ID NO: 129 - DNA, 1380 bp, Mus musculus
atgcccctgcggttgctgcttctgctgctgtggttgtggggactccagtgggcggagacagactctgaggggcagaccaccacgggggagctgtaccagcgctgggagcactacggccaggagtgccaaaagatgttggagaccacagaacctccctcaggcctggcctgtaacggttccttcgatatgtatgcctgctggaactacacggccgccaacaccactgctcgggtgtcttgcccctggtatctgccctggttccgtcaggtgtctgcaggctttgtcttccgccagtgtggcagtgatggccagtggggatcttggagagaccacactcagtgtgagaatccagagaagaatggggcttttcaggaccagacgctgatcctggagcgcctgcagatcatgtataccgtgggctactccctgtccctgacgactctgctgctagccctactcatcttaagtttgttcaggcggctgcactgcactcgtaattacattcacatgaacctgttcacgtctttcatgctgcgggcagcagccatcctcacccgagatcagctgctgcctccactgggtccctacactggagaccaggcccctaccccgtggaaccaggccctagctgcctgccgcacggcccagatcatgacccaatattgtgtgggagccaattacacctggctactggtggagggtgtttatctgcaccatctgctggtgatcgtgggacgctcagaaaagggccacttccgctgctacctgcttcttggctggggggcccccgcgcttttcgtcattccctgggtgatcgtcaggtacctgcgcgagaacacacagtgctgggagcgcaacgaagtcaaagccatttggtggatcattcgcactcccatcctaataaccatcttgatcaatttcctcatcttcatccgcatccttggcatccttgtttcaaagctgaggacacggcagatgcgctgccccgactaccgactaaggctggctcgctccacgctgacactggtgcccctgctgggtgtccacgaggtggtgtttgcgcctgtgacggaggaacaggttgaaggctccctgcgcttcgccaaactggcctttgaaatcttcctaagttccttccagggtttcctggtgagcgtgctctactgcttcatcaacaaagaggtgcagtcggagatccgccagggttggcgccaccgccgcctgcgtctcagtcttcaagagcagcgtccacgtccgcaccaggaactcgccccccgggctgtgcctttgagctctgcgtgccgagaagctgccgttggcaacgccttgccctctgggatgctgcatgtgcctggggatgaggtcttggaaagttactgc

SEQ ID NO: 130 - protein, 553 aa, Homo sapiens
MKLGSSRAGPGRGSAGLLPGVHELPMGIPAPWGTSPLSFHRKCSLWAPGRPFLTLVLLVSIKQVTGSLLEETTRKWAQYKQACLRDLLKEPSGIFCNGTFDQYVCWPHSSPGNVSVPCPSYLPWWSEESSGRAYRHCLAQGTWQTIENATDIWQDDSECSENHSFKQNVDRYALLSTLQLMYTVGYSFSLISLFLALTLLLFLRKLHCTRNYIHMNLFASFILRTLAVLVKDVVFYNSYSKRPDNENGWMSYLSEMSTSCRSVQVLLHYFVGANYLWLLVEGLYLHTLLEPTVLPERRLWPRYLLLGWAFPVLFVVPWGFARAHLENTGCWTTNGNKKIWWIIRGPMMLCVTVNFFIFLKILKLLISKLKAHQMCFRDYKYRLAKSTLVLIPLLGVHEILFSFITDDQVEGFAKLIRLFIQLTLSSFHGFLVALQYGFANGEVKAELRKYWVRFLLARHSGCRACVLGKDFRFLGKCPKKLSEGDGAEKLRKLQPSLNSGRLLHLAMRGLGELGAQPQQDHARWPRGSSLSECSEGDVTMANTMEEILEESEI

SEQ ID NO: 131 - protein, 551 aa, Mus musculus
TRPQPSPAVPSRCREASLPRAQPVGIPAAQGPESLHSHGMRRLWGPGTPFLALLLLVSIKQVTTGSLLEETVQKWAQYKETCLKDLLEKPSGVFCNGTFDKYVCWPHSFPGNVSVPCPSYLPWWNKESPGRAYRHCLAQGTWQKQENSTDTWQDESECSENHSFKQNVDHYHHTLLSTLQLMYTVGYSLSLISLFLALTLFLFLRKLHCTRNYIHMNLFASFILRALVVLVKDMVFYNSYSRRPDSESGWMSYLSEISASCRSVQVLLHYFVGTNHLWLLVEGLYLHALLEPTVLPERRLWPKYLVVGWAFPMLFVIPWIFVRASLENTGCWAVNENKKIWWIIRGPILLCVTVNFFIFLKILKLLISKFRAHQMCFRDYKYRLAKSTLLLILLMGVHEFLFTFFTDDQVQGFSRLIRLFIQLTLSSFHGFLVALQYGFASREVKAELRKTWGRFLLARHWGCRACVLGKNFRFLGKCSKKLSEGDGAETLQKLQSSGVSSHLTAGNLRDHGAQPHRGRGAWPRASSLSESSEGDFTLANTMEEILEESEI

SEQ ID NO: 132 - DNA, 1656 bp, Mus musculus
acgaggccccaaccaagcccggcagtgcccagtagatgcagagaggcgtccctgccccgggcgcagccagtgggcatccctgcggcccaggggcctgagtctctccactcccacgggatgcgtcggctctggggccctgggacgcccttcctcgccctgcttctgctggtttccatcaagcaagttactacaggatctctccttgaggagacagttcagaagtgggctcagtataaggagacgtgtctgaaagacttgctcgagaaaccttctggtgtattttgtaatggaacatttgataagtacgtgtgctggcctcattcttttcctggaaatgtctctgtcccctgtccttcatacttaccttggtggaataaagagagcccaggaagggcctacagacactgcttggctcaggggacttggcagaagcaagagaactccacagatacttggcaggatgagtcagaatgctcagagaaccacagcttcaaacaaaacgtggatcactatcaccataccttgttgtccaccttgcagctgatgtacactgtgggctactccctgtctctcatctccctcttcttggctcttacactcttcttgttccttcgaaaactgcactgcacacgcaattacatccacatgaacctgttcgcttcgttcatcctgagagctctggttgtccttgtgaaggacatggtcttctacaactcttactccaggaggcctgacagtgagagtggatggatgtcatatctgtcagagatttctgcctcctgccgctctgtccaggtcctcctgcactactttgtgggcaccaatcacttgtggttgctggttgaaggactttacctccatgctctgctggagccaacagtgcttcctgaaaggcggctgtggcccaagtacctggtggtgggttgggccttccccatgctgtttgttattccctggatttttgtccgagcaagcctggagaatacagggtgctgggcagtaaatgagaataagaaaatctggtggatcatcagaggacccattctgctttgtgtaacagttaatttcttcatcttcctcaagattctcaagcttctcatttctaagttcagagctcatcagatgtgcttcagagactacaaatatagactggcaaaatcaaccctgctcctcattcttttgatgggggttcatgagttcctcttcactttcttcaccgacgaccaagttcaaggattttcaagacttattcgtctcttcatccagttgaccctgagctccttccatggatttctggtggccttgcagtacggctttgccagtagagaggtgaaggcagagctgagaaagacctggggccgcttcttattagctcgccactggggctgcagagcctgtgtcctagggaagaacttccggttcctggggaaatgttccaagaagctgtcggagggagatggtgccgagacactccagaagctgcaatcttcaggtgtcagctcacacctgaccgctgggaacctgcgggatcatggggcacagcctcacaggggccgtggagcttggccccgggcaagcagcctgtctgagagcagcgagggagacttcaccctggccaataccatggaggagattctggaagagagtgagatctaa

SEQ ID NO: 133 - protein, 508 aa, Homo sapiens
MTSTCTNSTRESNSSHTCMPLSKMPISLAHGIIRSTVLVIFLAASFVGNIVLALVLQRKPQLLQVTNRFIFNLLVTDLLQISLVAPWVVATSVPLFWPLNSHFCTALVSLTHLFAFASVNTIVVVSVDRYLSIIHPLSYPSKMTQRRGYLLLYGTWIVAILQSTPPLYGWGQAAFDERNALCSMIWGASPSYTILSVVSFIVIPLIVMIACYSVVFCAARRQHALLYNVKRHSLEVRVKDCVENEDEEGAEKKEEFQDESEFRRQHEGEVKAKEGRMEAKDGSLKAKEGSTGTSESSVEARGSEEVRESSTVASDGSMEGKEGSTKVEENSMKADKGRTEVNQCSIDLGEDDMEFGEDDINFSEDDVEAVNIPESLPPSRRNSNSNPPLPRCYQCKAAKVIFIIIFSYVLSLGPYCFLAVLAVWVDVETQVPQWVITIIIWLFFLQCCIHPYVYGYMHKTIKKEIQDMLKKFFCKEKPPKEDSHPDLPGTEGGTEGKIVPSYDSATFP

SEQ ID NO: 134 - protein, 511 aa, Mus musculus
MPPSCTNSTQENNGSRVCLPLSKMPISVAHGIIRSVVLLVILGVAFLGNVVLGYVLHRKPNLLQVTNRFIFNLLVTDLLQVALVAPWVVSTAIPFFWPLNIHFCTALVSLTHLFAFASVNTIVVVSVDRYLTIIHPLSYPSKMTNRRSYILLYGTWIAAFLQSTPPLYGWGHATFDDRNAFCSMIWGASPAYTVVSVVSFLVIPLGVMIACYSVVFGAARRQQALLYKAKSHRLEVRVEDSVVHENEEGAKKRDEFQDKNEFQGQDGGGQAEAKGSSSMEESPMVAEGSSQKTGKGSLDFSAGIMEGKDSDEVSNGSMEGLEVITEFQASSAKADTGRIDANQCNIDVGEDDVEFGMDEIHFNDDVEAMRIPESSPPSRRNSTSDPPLPPCYECKAARVIFVIISTYVLSLGPYCFLAVLAVWVDIDTRVPQWVITIIIWLFFLQCCIHPYVYGYMHKSIKKEIQEVLKKLICKKSPPVEDSHPDLHETEAGTEGGIEGKAVPSHDSATSP

SEQ ID NO: 135 - DNA, 1536 bp, Mus musculus
atgccacccagctgcactaacagtactcaagagaacaatggcagtcgagtgtgcctccccctctccaagatgcctattagtgtagctcacggcatcatccgctcagttgtgctgctcgtcatccttggtgtagcctttctgggtaacgtagtgctgggttatgtattgcaccgtaagccaaacttgctgcaggtgaccaaccggttcatatttaacctgcttgtcactgacctgctgcaggttgctctcgtggccccctgggtggtgtccactgccattcctttcttctggcctctcaacatccacttctgcactgccctggttagcctcacccacttatttgcctttgctagtgtcaataccattgtggtggtgtcagttgatcgttacctgaccatcatccaccctctttcctacccatccaagatgaccaaccgacgtagttatattctcctctatggcacctggattgcagccttcctgcagagcacacctccactctatggctggggccacgctacttttgatgaccgtaatgccttctgttccatgatctggggagccagccctgcctatacggttgtcagtgtggtatccttcctcgttattccactgggtgttatgattgcctgctattctgtggtgttcggtgcagcccggaggcagcaagctctcctgtataaggccaagagccaccgcttggaggtgagagtcgaggactctgtggtgcatgagaatgaagagggagcaaagaagagggatgagttccaggacaagaatgagttccagggccaagatggaggtggtcaggccgaggctaagggaagcagctccatggaagagagtcccatggtagccgagggcagcagccagaagaccggaaaaggaagcctggatttcagtgcaggtatcatggagggcaaggacagtgacgaggtcagtaatggcagcatggaggggctggaagtcatcactgaatttcaggctagcagcgcaaaggcagacaccggccgcatagatgccaatcagtgcaacattgacgtgggcgaagatgatgtagagtttggcatggatgaaattcatttcaacgacgatgttgaggcgatgcgcattccagagagcagtccacccagtcgtcgaaacagcaccagcgacccacctttgcctccatgctatgagtgcaaagctgctagagtgatcttcgtcatcatttccacttatgtgctatctctggggccctactgctttctagcagtgctggctgtgtgggtggatatcgataccagggtaccccagtgggtgatcaccataataatctggctttttttcctgcagtgttgcatccacccatatgtctatggctatatgcacaagagcatcaagaaggaaatccaggaggtactgaagaagttaatctgtaagaaaagcccccctgtagaagatagccaccctgaccttcatgaaacggaagctggtacagagggaggtattgaaggcaaggctgtcccctcccatgattcagctacttcaccttaa

SEQ ID NO: 136 - protein, 455 aa, Homo sapiens [sequence omitted]

SEQ ID NO: 137 - protein, 408 aa, Mus musculus
MQALNITAEQFSRLLSAHNLTREQFIHRYGLRPLVYTPELPARAKLAFALAGALIFALALFGNSLVIYVVTRSKAMRTVTNIFICSLALSDLLIAFFCIPVTMLQNISDKWLGGAFICKMVPFVQSTAVVTEILTMTCIAVERHQGLIHPFKMKWQYTTRRAFTILGVVWLAAIIVGSPMWHVQRLEIKYDFLYEKEHVCCLEEWASPMHQRIYTTFILVILFLLPLVVMLVLYSKIGYELKKKRAVVMMVTVVALFAACWAPFHVVHMMVEYSNFEKEYDDVTIKMVFAVAQTIGFFNSICNPFVYAFMNENFKKNFLSAVCYCIVRETFSPGQKPGNSGISMMQKRAKLSRSQRPVAEAKGDLFSDANVDVKLCEQPGEKRQLKRQLAFFSSELSENSTFGSGHEL

SEQ ID NO: 138 - DNA, 1173 bp, Mus musculus
atgcaggcgctcaacatcaccgcggagcagttttcccggctgctgagcgcgcacaacctgactcgggaacagttcattcatcgctatgggctgcgaccgctggtctacactccggagctgcccgcgcgcgctaaactggcctttgcgctggctggagcactcatttttgccctggcgctctttggcaactctctggtcatctatgtggtgacccgcagcaaggccatgcgcaccgtcaccaacatcttcatctgctctctggcactcagtgatctgctcattgccttcttctgcatccccgtcacgatgctccagaacatctccgacaagtggctgggtggtgaaatcctcaccatgacttgcatcgctgttgagaggcaccaaggactcatccatccttttaaaatgaagtggcagtacactacccgaagggctttcacaatcttgggtgtggtctggttggcagccatcatcgtaggatcacccatgtggcacgtacaacgcctcgagattaagtatgacttcctctatgagaaagaacatgtctgctgtttggaagagtgggccagccccatgcaccagagaatctacaccaccttcatcctcgtcatcctcttcctcctgccgcttgtggtgatgcttgtcctctacagcaagattggctatgaactgaagaagaagcgggctgtcgttatgatggtgacagtggtggctctcttcgctgcgtgctgggcacctttccatgttgttcacatgatggttgagtacagtaactttgaaaaagagtatgatgatgtcacaatcaagatggtttttgctgttgcacaaacaattggctttttcaactccatctgtaatccctttgtgtatgcatttatgaatgaaaacttcaaaaagaattttttgtctgcggtttgttattgcatagtaagagaaaccttctccccaggacagaagcctggaaattctgggatttcaatgatgcaaaagagagcaaagttatcacgatcacagcgtccagtggcggaagccaaaggagacttattcagcgatgccaacgttgatgtcaaattgtgtgagcagccaggggagaaaaggcaactcaagcgacagcttgccttctttagttctgaactttctgaaaactctactttcggcagtggacatgaactg

SEQ ID NO: 139 - protein, 367 aa, Homo sapiens
MSKRSWWAGSRKPPREMLKLSGSDSSQSMNGLEVAPPGLITNFSLATAEQCGQETPLENMLFASFYLLDFILALVGNTLALWLFIRDHKSGTPANVFLMHLAVADLSCVLVLPTRLVYHFSGNHWPFGEIACRLTGFLFYLNMYASIYFLTCISADRFLAIVHPVKSLKLRRPLYAHLACAFLWVVVAVAMAPLLVSPQTVQTNHTVVCLQLYREKASHHALVSLAVAFTFPFITTVTCYLLIIRSLRQGLRVEKRLKTKAVRMIAIVLAIFLVCFVPYHVNRSVYVLHYRSHGASCATQRILALANRITSCLTSLNGALDPIMYFFVAEKFRHALCNLLCGKRLKGPPPSFEGKTNESSLSAKSEL

SEQ ID NO: 140 - protein, 339 aa, Mus musculus
MNGLEAALPSLTDNSSLAYSEQCGQETPLENMLFACFYLLDFILAFVGNALALWLFIWDHKSGTPANVFLMHLAVADLSCVLVLPTRLVYHFSGNHWPFGEIPCRLTGFLFYLNMYASIYFLTCISADRFLAIVHPVKSLKLRRPLYAHLACAFLWIVVAVAMAPLLVSPQTVQTNHTVVCLQLYREKASHHALASLAVAFTFPFITTVTCYLLIIRSLRQGPRIEKHLKNKAVRMIAMVLAIFLICFVPYHIHRSVYVLHYRGGGTSCAAQRALALGNRITSCLTSLNGALDPVMYFFVAEKFRHALCNLLCSKRLTGPPPSFEGKTNESSLSARSEL

SEQ ID NO: 141 - DNA, 1017 bp, Mus musculus
atgaacggtctggaggcagccctaccgagtctgactgacaactcctccctggcttactctgagcaatgcggacaagagacccccctggagaacatgctcttcgcctgcttctaccttctggacttcatcctcgcttttgtgggcaatgctctggccctgtggcttttcatatgggaccacaagtcaggcactccggccaatgtcttcctcatgcacctggctgtggccgacctgtcctgcgtgttggtcctgcctacccggttggtttatcacttctctgggaatcactggccatttggggagatcccatgccgactcactggcttcctcttctatctgaacatgtatgccagcatctactttctcacctgcatcagcgctgaccggttcctggccattgtgcaccctgtcaagtccctcaagcttcgaagacctctctatgctcacctggcctgcgccttcctgtggatcgtggtggctgtggctatggccccactgctagtcagcccacagacagtgcagaccaaccacacagttgtctgcctgcaactgtaccgggagaaggcctcccatcacgccctggcatccctggctgtggcttttaccttcccattcatcaccacggtcacctgctacctgctgatcattcgcagcctgcgccagggtccccggatagagaagcacctcaagaataaagccgtccgcatgattgctatggttctggccatcttcctgatttgttttgtgccctaccacatccaccgttcagtctatgtgcttcactaccgtggtggtgggacttcgtgcgctgctcagcgtgccctggccctggggaaccggatcacctcctgcctcaccagcctcaacggggccctggatcctgtcatgtacttctttgtggctgagaagttccgccacgccttgtgcaacttgctctgcagcaaacggctcacaggtccacctcccagcttcgaagggaaaaccaacgagagctccctgagtgcccgatccgagctg

SEQ ID NO: 142 - protein, 358 aa, Homo sapiens
MPSVSPAGPSAGAVPNATAVTTVRTNASGLEVPLFHLFARLDEELHGTFPGLCVALMAVHGAIFLAGLVLNGLALYVFCCRTRAKTPSVIYTINLVVTDLLVGLSLPTRFAVYYGARGCLRCAFPHVLGYFLNMHCSILFLTCICVDRYLAIVRPEAPAACRQPACARAVCAFVWLAAGAVTLSVLGVTGSRPCCRVFALTVLEFLLPLLVISVFTGRIMCALSRPGLLHQGRQRRVRAMQLLLTVLIIFLVCFTPFHARQVAVALWPDMPHHTSLVVYHVAVTLSSLNSCMDPIVYCFVTSGFQATVRGLFGQHGEREPSSGDVVSMHRSSKGSGRHHILSAGPHALTQALANGPEA

SEQ ID NO: 143 - protein, 358 aa, Mus musculus
MPSALSMRPWDAALPNTTAAAWTNGSVPEMPLFHHFARLDEELQATFPSLWQALMVVHGTIFLAGLVLNGLALYVFCCRTRAKTPSVTYTINLVVTDLLVGLSLPTRFAVFYGARGCLRCAFPHVLGYFLNMHCSILFLTCICVDRYLAIVQPEGSRRWRQPACAKAVCIFVWLAAGVVTLSVLGVKSGGRSCCRVFALTVLEFLLPLLVISVFTGRIMCALSRPGLLRQGRQRRVRAMQLLLTVLVIFLVCFTPFHARQVAVALWPNVPKHTSLVAYHVAVTLSSLNSCMDPIVYCFITSGFQATVRGLFYQRGEEFKPSSMDVVSMHKSTKASAPIHILSIGSHTLTQPLTNGPEP

SEQ ID NO: 144 - DNA, 1071 bp, Mus musculus
atgccctctgcgttgtctatgaggccctgggatgctgcactccccaacaccactgcagcagcatggaccaatggaagtgtgccggagatgcccctgttccatcactttgcccggctggatgaggaactgcaagccaccttccccagcctgtggcaagcactaatggtcgtgcacggcaccatcttccttgccgggctggtgctcaacggactggcactgtatgtcttctgctgtcgcacgcgggccaagaccccttcagtcacctataccatcaacctggtggtgactgacctgctagtgggcctgtccctgcccacacgctttgctgtcttctacggtgcccgaggctgtctgcgctgtgccttccctcatgtcctgggctacttcctcaacatgcactgttccatcctcttcctcacctgcatctgcgtggaccgctacctggccattgtgcaacccgagggttcccgccgctggcgccagccggcctgcgccaaggccgtgtgcatctttgtgtggctggcagcaggagtcgtgaccctgtctgtgctgggtgtgaagtcgggtggacgatcatgctgccgtgtctttgctctgaccgttctggagttcctgctgcctctgctggtcatcagcgtgttcacaggccggatcatgtgtgcgctgtcgaggccgggtctgctacgccagggccgtcagcggcgcgtgagggccatgcagctgctgctcacggtgctggtcatcttcctggtctgtttcacacccttccatgcccgccaggtggctgtggcactgtggcctaacgtacctaagcataccagccttgtggcttaccacgtggctgtcaccctcagcagcctcaacagctgcatggaccccattgtctactgtttcatcaccagtggcttccaggccactgtccgaggcctcttctaccagcgtggagaagaattcaagcccagcagtatggatgtggtcagcatgcacaagagcaccaaggcctcagctcccattcacatcctcagcatcggttcccacacccttacccagcctttgaccaacgggcctgag

SEQ ID NO: 145 - protein, 349 aa, Homo sapiens
MNSTLDGNQSSHPFCLLAFGYLETVNFCLLEVLIIVFLTVLIISGNIIVIFVFHCAPLLNHHTTSYFIQTMAYADLFVGVSCVVPSLSLLHHPLPVEESLTCQIFGFVVSVLKSVSMASLACISIDRYIAITKPLTYNTLVTPWRLRLCIFLIWLYSTLVFLPSFFHWGKPGYHGDVFQWCAESWHTDSYFTLFIVMMLYAPAALIVCFTYFNIFRICQQHTKDISERQARFSSQSGETGEVQACPDKRYAMVLFRITSVFYILWLPYIIYFLLESSTGHSNRFASFLTTWLAISNSFCNCVIYSLSNSVFQRGLKRLSGAMCTSCASQTTANDPYTVRSKGPLNGCHI

SEQ ID NO: 146 - protein, 349 aa, Mus musculus
MNSTWDGNQSSHPFCLLALGYLETVRFCLLEVLIIVFLTVLIISGNIIVIFVFHCAPLLNHHSTSYFIQTMAYADLLVGVSCLVPSLSLLYYPLPIEEAMTCQVFGFVVSVLKSISMASLACISIDRYIAITKPLTYNTLVTPWRLRLCIFLIWLYSTLVFLPSFFHWGKPGYHGDVFQWCAESWHTNSYFTLFIVMMLYAPAALIVCFTYFNIFRICQQHTKEISERQARFSSQNGETGEPQTCPDKRYAMVLFRITSVFYVLWLPYIIYFLLESSTGCSSRLASFLTTWLAISNSFCNCIIYSLSNSVFQRGLKGLSGSLCTSCASHTTAKDPYTVRCKGPPNGSHI

SEQ ID NO: 147 - DNA, 1047 bp, Mus musculus
atgaactccacctgggatggtaatcagagcagccatcctttctgtcttctggcactgggctacttggaaactgtcaggttctgtcttttggaagtgctgattattgtctttctaactgtattgattatttctggcaacatcattgtgatttttgtgtttcactgtgcacctctgttgaaccatcattctacaagttattttattcagacaatggcatatgctgacctcttggttggggtaagctgcctggtcccttccttatcactcctctactaccctcttccgattgaggaggccatgacttgccaagtatttggttttgtagtgtcagttctgaagagtatctctatggcttctctggcctgtatcagcattgatagatatattgccatcactaagcctttaacctataataccctggttactccctggagactacgcctctgtatttttctgatttggctgtattccaccctggtcttcctgccttccttcttccactggggtaaacccggatatcatggagatgtatttcagtggtgtgcagagtcctggcacaccaactcctacttcacattgttcatcgtgatgatgctgtacgccccagctgccctcattgtctgcttcacgtatttcaacatcttccgcatctgccagcagcacacaaaagaaatcagcgaaaggcaagcccgattcagcagccagaatggggagactggggaaccccagacctgtccagataagcgctatgccatggtcctattcagaatcaccagtgtgttttatgtcctctggttgccatacatcatctacttcttgctggagagttctactggctgcagcagccgccttgcatccttcctgactacctggcttgctattagtaacagtttctgcaactgtatcatttacagtctctccaacagtgttttccagcgaggactaaagggcctttcagggtctctgtgtacttcttgtgcaagtcacaccacagccaaggacccttacacagttaggtgcaaaggaccccctaatggatctcatatc

SEQ ID NO: 148 - protein, 370 aa, Homo sapiens
MGDRRFIDFQFQDSNSSLRPRLGNATANNTCIVDDSFKYNLNGAVYSVVFILGLITNSVSLFVFCFRMKMRSETAIFITNLAVSDLLFVCTLPFKIFYNFNRHWPFGDTLCKISGTAFLTNIYGSMLFLTCISVDRFLAIVYPFRSRTIRTRRNSAIVCAGVWILVLSGGISASLFSTTNVNNATTTCFEGFSKRVWKTYLSKITIFIEVVGFIIPLILNVSCSSVVLRTLRKPATLSQIGTNKKKVLKMITVHMAVFVVCFVPYNSVLFLYALVRSQAITNCFLERFAKIMYPITLCLATLNCCFDPFIYYFTLESFQKSFYINAHIRMESLFKTETPLTTKPSLPAIQEEVSDQTTNNGGELMLESTF

SEQ ID NO: 149 - protein, 370 aa, Mus musculus
MGDRRFIDFQFQDLNSSLRPRLGNATANNTCIVDDSFKYNLNGAVYSVVFILGLITNSASLFVFCFRMKMRSETAIFITNLALSDLLFVCTLPFKIFYNFNRHWPFGDTLCKISGTAFLTNIYGSMLFLTCISVDRFLAIVYPFRSRTIRTRRNSAIVCAGVWILVLSGGISASLFSTTNVNNATTTCFEGFSKRVWKTYLSKITIFIEVVGFIIPLILNVSCSSVVLRTLRKPATLSQIGTNKKKVLKMITVHMAVFVVCFVPYNSVLFLYALVRSQAITNCLLERFAKIMYPITLCLATLNCCFDPFIYYFTLESFQKSFYINTHIRMESLFKTETPLTPKPSLPAIQEEVSDQTTNNGGELMLESTF

SEQ ID NO: 150 - DNA, 1113 bp, Mus musculus
atgggtgacagaagatttattgacttccaattccaagatttaaattcaagtctcagacccaggttgggaaatgcaactgccaataatacttgcattgttgatgattccttcaagtataatttgaatggtgctgtctatagtgttgtattcatcctgggtctaataaccaacagtgcctccctgtttgtcttctgcttccgcatgaaaatgagaagtgagacggctattttcatcaccaacctggccctctctgatttgctttttgtttgtaccctacctttcaaaatattttacaactttaatcgccactggccttttggtgacaccctctgtaagatctcagggactgcgttcctcaccaacatctatgggagcatgctcttcctcacctgcatcagtgtggatcgtttcctagccattgtctatcccttccgatcgcgtaccatcaggaccaggaggaattccgccattgtgtgcgctggagtctggatcctagtcctcagtggtggtatttcagcttctttgttctccaccactaatgtcaacaatgcgaccaccacttgctttgaaggcttctccaaacgtgtctggaagacatacctgtccaagatcactatattcattgaagttgttggattcatcattcctctgatattgaatgtttcttgttcttctgtggtgcttagaaccctccgcaagcctgcaacattgtctcagattgggaccaataaaaaaaaagtgttgaagatgatcacagtgcatatggcagtgtttgtggtatgctttgtaccatacaactccgttctctttttatatgccttggtacgctcccaagccattactaattgcttattggaaaggtttgcaaagatcatgtacccaattaccttgtgccttgcaactctgaattgttgctttgatccttttatctattacttcactcttgaatcctttcagaagtccttttatatcaatacacatataaggatggagtcgctgtttaagactgagacacctctgacccccaaaccttcccttccagctatccaagaggaagttagtgatcaaacaacaaataatggtggtgaattaatgctggaatccaccttctag

SEQ ID NO: 151 - protein, 360 aa, Homo sapiens
MAPTEPWSPSPGSAPWDYSGLDGLEELELCPAGDLPYGYVYIPALYLAAFAVGLLGNAFVVWLLAGRRGPRRLVDTFVLHLAAADLGFVLTLPLWAAAAARRPWPFGDGLCKLSTFALAGTRSAGALLLAGMSVDRYLAVVKLLEARPLRTPRCAVASCCGVWAVALLAGLPSLVYRGLQPLPGGQDSQCGEEPSHAFQGLSLLLLLLTFVLPLVVTLFCYCRISRRLRRPPHVGRARRNSLRIIFAIESTFVGSWLPFSALRAVFHLARLGALPLPCPLLLALRWGLTIATCLAFVNSCANPLIYLLLDRSFRARALDGACGRTGRLARRISSASSLSRDDSSVFRCRAQAANTASASW

SEQ ID NO: 152 - protein, 298 aa, Mus musculus
  misc_feature (141)..(141): Xaa can be any naturally occurring amino acid
MQSTEPWSPSWGTLSWDYSGSGSLDQVELCPAWNLPYGHAIIPALYLAAFAVGLPGNAFVVWLLSRQRGPRRLVDTFVLHLAAADLGFVLTLPLWAAAEARGGLWPFGDGLCKVSSFALAVTRCAGALLLAGMSVDRYLAXVGLLLLLLTFALPLAVTLICYWRVSRRLPRVGRARSNSLRIIFTVESVFVGCWLPFGVLRSLFHLARLQALPLPCSLLLALRWGLTVTTCLAFVNSSANPVIYLLLDRSFRARARFGLCARAGRQVRRISSASSLSRDDSSVFRGRSPKVNSASATW

SEQ ID NO: 153 - DNA, 1011 bp, Mus musculus
  misc_feature (440)..(539): n is a, c, g, or t
atgcagtccaccgaaccctggagtcctagctggggcacgttgtcctgggactattcgggctcgggctccctggaccaagtggagttgtgccctgcttggaacctgccttacggccacgccatcatcccagcgctctacctggcggccttcgccgtgggcctgccgggcaacgccttcgtggtgtggctactgagccggcagcgcgggccgcggcggctggtggacaccttcgtgctgcacttggcggccgccgacctgggcttcgtgctcacgctgccgctgtgggccgcggcagaggcgcgcggcggcctctggcccttcggcgacggcctgtgcaaagtcagcagcttcgcgctggcggtcacgcgctgcgcgggcgcgctgctgctggcgggcatgagcgtggaccgctacctggcggtgggccggccgctgagcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtcgggctgctgctgctgctactgaccttcgcgctgccgctggctgtcaccctgatctgctactggcgcgtgtcgcgccgcctgccgcgcgtcggtagggcccggagcaactccctgcgcatcatcttcaccgtggagagcgtcttcgtgggctgctggctgcccttcggcgtcctgcgctccctcttccacctggcgcggctccaggcgctgccgctgccctgctccctgctgctggctctgcgctggggtctgactgtcaccacctgcctggctttcgtcaatagcagtgcgaacccggtcatctacctcctgttggaccgctcattccgcgcccgggcccggttcgggctgtgcgcgcgcgccgggcgccaggtgcgcaggatcagctcggcctcctcgctctccagggacgacagttcggtgttccggggccggtccccgaaggtgaactctgcctcggccacttgg

SEQ ID NO: 154 - protein, 337 aa, Homo sapiens
MNSWNAGLAGLLVGTIGVSLLSNALVLLCLLHSADIRRQAPALFTLNLTCGNLLCTVVNMPLTLAGVVAQRQPAGDRLCRLAAFLDTFLAANSMLSMAALSIDRWVAVVFPLSYRAKMRLRDAALMVAYTWLHALTFPAAALALSWLGFHQLYASCTLCSRRPDERLRFAVFTGAFHALSFLLSFVVLCCTYLKVLKVARFHCKRIDVITMQTLVLLVDLHPSVRERCLEEQKRRRQRATKKISTFIGTFLVCFAPYVITRLVELFSTVPIGSHWGVLSKCLAYSKAASDPFVYSLLRHQYRKSCKEILNRLLHRRSIHSSGLTGDSHSQNILPVSE

SEQ ID NO: 155 - protein, 337 aa, Mus musculus
MNSWDAGLAGLLVGTIGVSLLSNGLVLLCLLHSADIRRQAPALFTLNLTCGNLLCTVVNMPLTLAGVVAQRQPAGDRLCRLAAFLDTFLAANSMLSMAALSIDRWVAVVFPLSYRAKMRLRDAAFMVAYTWLHALTFPATALALSWLGFHQLYASCTLCSRRPDERLRFAVFTSAFHALSFLLSFIVLCFTYLKVLKVARFHCKRIDVITMQTLVLLVDIHPSVRERCLEEQKRRRQRATKKISTFIGTFLVCFAPYVITRLVELFSTAPIGSHWGVLSKCLAYSKAASDPFVYSLLRHQYRRSCKELLNRIFNRRSLHSVGLTGDSHSQNILPVSE

SEQ ID NO: 156 - DNA, 1011 bp, Mus musculus
atgaactcgtgggacgcgggcctggcggggctgctggtgggcactatcggcgtgtcgctgctgtccaacgggctggtgctgctctgcctcctgcacagcgctgacatccgccgccaggcgccggcgctcttcactctcaacctcacgtgtggcaacctgctgtgtaccgtggtcaacatgccactaacactggccggcgtcgtggcacaacggcagccggccggggaccgcctgtgccgcctggccgccttcctcgacacctttctggccgccaactccatgctcagcatggccgcgctcagcatcgaccgctgggtggctgtggtctttccgctgagctaccgtgccaagatgcgcctccgagatgccgccttcatggtggcctacacgtggctgcacgcgctcaccttcccggccaccgcgctcgccctgtcctggctcggcttccaccagctatatgcctcgtgcacactgtgcagccggcggccggacgagcgcctgcgctttgctgtcttcaccagcgccttccatgcgctcagcttcctgctctccttcatcgtgctctgcttcacgtacctcaaggtgctcaaggtggcccgcttccactgcaagcgcatcgacgtgatcaccatgcagacgcttgtgctgttggtggacatacaccccagtgtgagggaacggtgtctggaggaacagaagcggaggcgacagcgtgccaccaagaagatcagcaccttcatagggaccttccttgtgtgctttgcaccctatgtgattaccaggctggtggaactcttctccacagcacccattggctctcactggggagtgctgtccaagtgcttggcctacagcaaggccgcttctgaccccttcgtgtattccttgctgcgacaccaataccgcaggagctgcaaggagctcctgaacaggatcttcaacagacgctcccttcactctgtgggcctcacaggtgactctcacagccagaacattctgccagtgtcggaa

SEQ ID NO: 157 - protein, 481 aa, Homo sapiens
MRWLWPLAVSLAVILAVGLSRVSGGAPLHLGRHRAETQEQQSRSKRGTEDEEAKGVQQYVPEEWAEYPRPIHPAGLQPTKPLVATSPNPDKDGGTPDSGQELRGNLTGAPGQRLQIQNPLYPVTESSYSAYAIMLLALVVFAVGIVGNLSVMCIVWHSYYLKSAWNSILASLALWDFLVLFFCLPIVIFNEITKQRLLGDVSCRAVPFMEVSSLGVTTFSLCALGIDRFHVATSTLPKVRPIERCQSILAKLAVIWVGSMTLAVPELLLWQLAQEPAPTMGTLDSCIMKPSASLPESLYSLVMTYQNARMWWYFGCYFCLPILFTVTCQLVTWRVRGPPGRKSECRASKHEQCESQLNSTVVGLTVVYAFCTLPENVCNIVVAYLSTELTRQTLDLLGLINQFSTFFKGAITPVLLLCICRPLGQAFLDCCCCCCCEECGGASEASAANGSDNKLKTEVSSSIYFHKPRESPPLLPLGTPC

SEQ ID NO: 158 - protein, 482 aa, Mus musculus
MMRWLWPLAVSLVVVLTVGLSGVSGAATSSLGGHRAKVQEQQSRPRRGTKDEGPKEVQHYVPEEWAEYPKPIHPAGLQPTKTLEATSPNPDKDGATPGNGQELRVNLTGTPSQRLQIQNPLYPVTESSYSAYAIMLLALVVFAVGIVGNLSVMCIVWHSYYLKSAWNSILASLALWDFLVLFFCLPIVIFNEITKQRLLGDVSCRAVPFMEVSSLGVTTFSLCALGIDRFHVATSTLPKVRPIERCQSILAKLAVIWVGSMMLAVPELLLWQLAQEPAPTAGTVDSCIMKPSADLPESVYSLVMTYQNARMWWYFGCYFCLPILFTVTCQLVTWRVRGPPGRKPECRAGRHEQCESQLNSTVVGLTVVYAFCTLPENVCNIVVAYLSTELTRQTLDLLGLINQFSTFFKGAITPVLLLCICRPLGQAFLDCCCCCCCEECGGASDSSATVSADSKLKAEVSSSIYFHKPRESPPLLPLGTPC

SEQ ID NO: 159 - DNA, 1443 bp, Mus musculus
atgcggtggctgtggcccctggctgtgtctcttgttgtagtgttgactgtggggctgagtggggtctctggggctgccacctcatctttaggtgggcatagagccaaggtccaggagcagcagagtcgaccccgaagaggcaccaaggacgaggggcccaaggaggtacagcactatgtacccgaggagtgggctgaatatcccaagcccatccatcctgctggcctgcagcccaccaagactttggaggccactagccccaacccagacaaggatggggccaccccaggtaatggacaagagctgagggtcaacctgaccgggacgccaagtcagaggctgcagattcagaaccccctgtatccggtgaccgagagctcctacagcgcctacgccatcatgctcctggctctggtggtgtttgctgtgggtatcgttggcaatctgtctgtcatgtgcattgtgtggcacagctactacttgaagagtgcctggaactctatccttgccagcctggctctctgggatttcctggtcctcttcttctgcctcccaattgtcatcttcaatgagattaccaagcaaaggctactcggggatgtttcttgccgggcagtgcccttcatggaggtctcctccctgggagtcacaaccttcagtctctgtgccctgggcatagaccgattccatgtggccaccagcaccctgccaaaggtgaggcccattgagcgatgtcaatcaattctggctaaactagctgtcatctgggtgggctccatgatgctggccgtgcccgaactcctgctatggcagctggcccaggagccggctcccaccgcaggaactgtggactcgtgtatcatgaaaccttcagctgacctgcccgaatctgtctattcgctggtgatgacctaccagaatgcccgcatgtggtggtattttggttgctacttctgtctgcccatcctcttcaccgtcacctgtcagctggtgacgtggcgggtgcggggcccaccaggcaggaagcctgagtgtagagcgggcaggcatgagcagtgtgagagccagctcaacagcaccgtggtcggcctgactgtggtctatgccttctgtacactccctgagaacgtctgcaatatcgtggtggcttacctctctaccgagctcacgcggcagaccctggacctcctgggcctcatcaaccagttctccaccttctttaagggcgccatcacccctgtgctcctcctgtgcatctgcaggccactgggccaggcctttctggattgctgctgctgctgctgctgcgaggagtgcggcggggcctcagactcctcagccacagtcagcgcggacagcaagctgaaggcggaagtgtcctcttctatctacttccacaagcccagggagtcgcccccactcctgcccctgggcaccccttgc

SEQ ID NO: 160 - protein, 453 aa, Homo sapiens
MASPSLPGSDCSQIIDHSHVPEFEVATWIKITLILVYLIIFVMGLLGNSATIRVTQVLQKKGYLQKEVTDHMVSLACSDILVFLIGMPMEFYSIIWNPLTTSSYTLSCKLHTFLFEACSYATLLHVLTLSFERYIAICHPFRYKAVSGPCQVKLLIGFVWVTSALVALPLLFAMGTEYPLVNVPSHRGLTCNRSSTRHHEQPETSNMSICTNLSSRWTVFQSSIFGAFVVYLVVLLSVAFMCWNMMQVLMKSQKGSLAGGTRPPQLRKSESEESRTARRQTIIFLRLIVVTLAVCWMPNQIRRIMAAAKPKHDWTRSYFRAYMILLPFSETFFYLSSVINPLLYTVSSQQFRRVFVQVLCCRLSLQHANHEKRLRVHAHSTTDSARFVQRPLLFASRRQSSARRTEKIFLSTFQSEAEPQSKSQSLSLESLEPNSGAKPANSAAENGFQEHEV

SEQ ID NO: 161 - protein, 456 aa, Mus musculus
MASSSGSNHICSRVIDHSHVPEFEVATWIKITLILVYLIIFVVGILGNSVTIRVTQVLQKKGYLQKEVTDHMVSLACSDILVFLIGMPMEFYSIIWNPLTTPSYALSCKLHTFLFETCSYATLLHVLTLSFERYIAICHPFKYKAVSGPRQVKLLIGFVWVTSALVALPLLFAMGIEYPLVNVPTHKGLNCNLSRTRHHDEPGNSNMSICTNLSNRWEVFQSSIFGAFAVYLVVLASVAFMCWNMMKVLMKSKQGTLAGTGPQLQLRKSESEESRTARRQTIIFLRLIVVTLAVCWMPNQIRRIMAAAKPKHDWTRTYFRAYMILLPFSDTFFYLSSVVNPLLYNVSSQQFRKVFWQVLCCRLTLQHANQEKRQRARFISTKDSTSSARSPLIFLASRRSNSSSRRTNKVFLSTFQTEAKPGEAKPQPLSPESPQTGSETKPAGSTPENSLQEQEV

SEQ ID NO: 162 - DNA, 1365 bp, Mus musculus
atggcttcatccagtggctccaaccacatctgctcccgtgtcatcgatcacagccatgttcctgaatttgaggtggccacttggatcaaaatcaccctcatcttggtgtacctgatcatctttgtggtaggcatcttgggcaacagcgtcaccatcagggttacgcaggtattgcagaagaagggctatttgcagaaggaggtgacagatcacatggtcagtttggcttgttcagatatcttggtctttttgattggcatgcccatggagttctacagcatcatttggaaccccctgaccacacccagctatgctctgtcctgtaagctccacacgttcctctttgagacgtgcagctacgccacactgctgcacgtgctgaccctcagctttgagcgctacattgccatttgtcatcccttcaagtataaagcagtgtctggacctcgccaggtgaaactgctgattggctttgtatgggtcacctccgccctggtggcactgcctttgctctttgccatgggtatcgagtaccctctggtaaacgtacccactcacaagggactcaactgcaacctctctcgcacccgccaccacgatgaacctggaaactccaatatgtccatctgcacgaacctctccaaccgttgggaggtcttccagtccagcatctttggggcctttgctgtttacctggtggtcctggcgtctgtggctttcatgtgttggaatatgatgaaagtgctaatgaagagcaagcagggcactcttgcagggaccgggccacagctccagctgaggaagtcagagagtgaggagagccggacagcaagaagacagaccatcatattcctgctgattgtggtgacgttggccgtgtgttggatgcccaatcagatccgacggatcatggctgcagcaaaacccaaacatgactggaccagaacgtacttcagggcatacatgatcctcctgcccttctctgataccttcttctacctcagctctgtggtcaaccctctcctctacaacgtgtcctctcagcagttccggaaggtgttctggcaggtgctctgctgccgcctgactctgcagcatgccaaccaagagaaacgccagcgtgcccgcttcatctccaccaaggacagcaccagctcagcccgcagccccctcatcttcctagcctcccggcgcagtaactcttcctccaggagaactaacaaggttttcttaagcacttttcagactgaggccaagcctggagaggctaagccccagcccttgagtcctgagtcaccacagactggctcagagaccaaaccagctgggtccaccccagaaaatagtttacaggagcaggaagta

SEQ ID NO: 163 - protein, 362 aa, Homo sapiens
MGNHTWEGCHVDSRVDHLFPPSLYIFVIGVGLPTNCLALWAAYRQVQQRNELGVYLMNLSIADLLYICTLPLWVDYFLHHDNWIHGPGSCKLFGFIFYTNIYISIAFLCCISVDRYLAVAHPLRFARLRRVKTAVAVSSVVWATELGANSAPLFHDELFRDRYNHTFCFEKFPMEGWVAWMNLYRVFVGFLFPWALMLLSYRGILRAVRGSVSTERQEKAKIKRLALSLIAIVLVCFAPYHVLLLSRSAIYLGRPWDCGFEERVFSAYHSSLAFTSLNCVADPILYCLVNEGARSDVAKALHNLLRFLASDKPQEMANASLTLETPLTSKRNSTAKAMTGSWAATPPSQGDQVQLKMLPPAQ

SEQ ID NO: 164 - protein, 365 aa, Mus musculus
MDNSTGTGEGCHVDSRVDHLFPPSLYIFVIGVGLPTNCLALWAAYRQVRQHNELGVYLMNLSIADLLYICTLPLWVDYFLHHDNWIHGPGSCKLFGFIFYSNIYISIAFLCCISVDRYLAVAHPLRFARLRRVKTAVAVSSVVWATELGANSAPLFHDELFRDRYNHTFCFEKFPMERWVAWMNLYRVFVGFLFPWALMLLCYRGILRAVQSSVSTERQEKVKIKRLALSLIAIVLVCFAPYHALLLSRSAVYLGRPWDCGFEERVFSAYHSSLAFTSLNCVADPILYCLVNEGARSDVAKALHNLLRFLASNKPQEMANASLTLETPLTSKRSTTGKSSGAVWAVPPTAQGDQVPLKVLLPPAQ

SEQ ID NO: 165 - DNA, 1098 bp, Mus musculus
atggacaacagcacgggcacaggggagggctgccatgtggactctcgagtggaccacctcttcccaccatctctctacatcttcgtcatcggggtggggctgcccaccaactgcctggccctgtgggcagcctaccggcaggtgcgccaacacaatgagctgggcgtctacctgatgaacttgagcattgcagacctgctgtacatctgcactttgccgctgtgggtcgactacttcctccaccatgacaactggatccacggccctggctcctgcaagctctttggcttcatcttctacagcaacatctatatcagcatcgccttcctgtgctgcatctccgtggaccgctacctggctgtggctcatcctctgcgctttgcacgcctgcgccgggtcaagacagcagtggctgtgagctctgtggtctgggccacggagctgggcgccaattcagcaccgctcttccatgatgagctgtttcgtgatcgctacaaccacaccttctgctttgagaagttccccatggagcgttgggtggcctggatgaatctgtaccgcgtctttgtgggcttcctcttcccctgggcactcatgttgctgtgctaccgtggcatcctgagggcagtgcagagcagtgtgtccaccgagcgccaggagaaagtcaagatcaaacgtctggccctgagcctcatcgccattgtgctggtgtgctttgcgccttaccatgctctcctgctgtctcgcagcgccgtctacctgggccggccctgggactgtggcttcgaggagcgagtcttttctgcctaccacagctccctggccttcaccagcctcaattgtgtggctgaccccatcctctactgcctggtcaacgagggtgcccgcagtgatgtggccaaggccctgcacaacctcctccgcttcctggccagcaacaagccccaggagatggccaatgcttccctcaccctggagacacccttgacctccaagaggagcaccaccggcaagtcgtccggggctgtctgggcagtgcctccgactgcccagggggaccaggtgccactgaaggtgctgctgcccccggcacagtga

SEQ ID NO: 166 - protein, 951 aa, Homo sapiens
MPGPLGLLCFLALGLLGSAGPSGAAPPLCAAPCSCDGDRRVDCSGKGLTAVPEGLSAFTQALDISMNNITQLPEDAFKNFPFLEELQLAGNDLSFIHPKALSGLKELKVLTLQNNQLKTVPSEAIRGLSALQSLRLDANHITSVPEDSFEGLVQLRHLWLDDNSLTEVPVHPLSNLPTLQALTLALNKISSIPDFAFTNLSSLVVLHLHNNKIRGLSQHCFDGLDNLETLDLSYNNLGEFPQAIKARPSLKELGFHSNSISVIPDGAFDGNPLLRTIHLYDNPLSFVGNSASHNLSDLHSLVIRGASMVQQFPNLTGTVHLESLTLTGTKISSIPNNLCQEQKMLRTLDLSYNNIRDLPSFNGCHALEEISLQRNQIYQIKEGTFQGLISLRILDLSRNLIHEIHSRAFATLGPITNLDVSFNELTSFPTEGPNGLNQLKLVGNFKLKEALAAKDFVNLRSLSVPYAYQCCAFWGCDSYANLNTEDNSLQDHSVAQEKGTADAANVTSTLENEEHSQIIIHCTPSTGAFKPCEYLLGSWMIRLTVWFIFLVALFFNLLVILTTFASCTSLPSSKLFIGLISVSNLFMGIYTGILTFLDAVSWGRFAEFGIWWETGSGCKVAGFLAVFSSESAIFLLMLATVERSLSAKDIMKNGKSNHLKQFRVAALSAFLGATVAGCFPLFHRGEYSASPLCLPFPTGETPSLGFTVTLVLLNSLAFLLMAVIYTKLYCNLEKEDLSENSQSSMIKHVAWLIFTNCIFFCPVAFFSFAPLITAISISPEIMKSVTLIFFPLPACLNPVLYVFFNPKFKEDWKLLKRRVTKKSGSVSVSISSQGGCLEQDFYYDCGMYSHLQGNLTVCDCCESFLLTKPVSCKHLIKSHSCPALAVASCQRPEGYWSDCGTQSAHSDYADEEDSFVSDSSDQVQACGRACFYQSRGFPLVRYAYNLPRVKD

SEQ ID NO: 167 - protein, 889 aa, Mus musculus
DISMNNITQLPEDAFKNFPFLEELQLAGNDLSFIHPKALSGLKELKVLTLQNNQLKTVPSEAIRGLSALQSLRLDANHITSVPEDSFEGLVQLRHLWLDDNILTEVPVRPLSNLPTLQALTLALNNISSIPDFAFTNLSSLVVLHLHNNKIKSLSQHCFDGLDNLETLDLNYNNLDEFPQAIKALPSLKELGFHSNSISVIPDGAFAGNPLLRTIHLYDNPLSFVGNSAFHNLSDLHSLVIRGASLVQWFPNLAGTVHLESLTLTGTKISSIPDDLCQNQKMLRTLDLSYNDIRDLPSFNGCRALEEISLQRNQISLIKETTFQGLTSLRILDLSRNLIREIHSGAFAKLGTITNLDVSFNELTSFPTEGLNGLNQLKLVGNFQLKDALAARDFANLRSLSVPYAYQCCAFWGCDSYANLNTEDNSPQDHSVTKEKGATDAANATSTAESEEHSQIIIHCTPSTGAFKPCEYLLGSWMIRLTVWFIFLVALLFNLLVILTVFASCSSLPASKLFIGLISVSNLLMGIYTGILTFLDAVSWGRFAEFGIWWETGSGCKVAGSLAVFSSESAVFLLTLAAVERSVFAKDVMKNGKSSHLRQFQVAALVALLGAAIAGCFPLFHGGQYSASPLCLPFPTGETPSLGFTVTLVLLNSLAFLLMAIIYTKLYCNLEKEDPSENSQSSMIKHVAWLIFTNCIFFCPVAFFSFAPLITAISISPEIMKSVTLIFFPLPACLNPVLYVFFNPKFKDDWKLLKRRVTRKHGSVSVSISSQGGCGEQDFYYDCGMYSHLQGNLTVCDCCESFLLTKPVSCKHLIKSHSCPVLTVASCQRPEAYWSDCGTQSAHSDYADEEDSFVSDSSDQVQACGRACFYQSRGFPLVRYAYNLPRVRD

SEQ ID NO: 168 - DNA, 2667 bp, Mus musculus
gatatcagtatgaacaatatcactcagttaccagaagatgcatttaagaattttccttttctagaggagctacaactggctggtaacgacctttcttttatccacccaaaagccttgtctgggttgaaagaactcaaagtcctaaccctccagaacaatcagttgaaaacagtacccagtgaagccattcgtggactgagtgctttgcagtctctacgcttagatgccaaccatattacctcagtcccggaggacagttttgaagggctcgttcagttgcggcatctgtggctggatgacaacatcttgacggaagtgcctgtgcgtccgctcagcaacctgccaaccctgcaggcgctgaccttggctctcaacaacatctcaagcatccccgacttcgcattcaccaacctttcaagcttggtagtgctgcatcttcataacaataaaattaaaagcctcagtcaacactgttttgatggactagataacctggaaaccctggacttgaattataataacttggatgaatttcctcaggctattaaagcccttcccagccttaaagagctgggatttcacagtaattctatttctgttatcccggatggagcatttgctggtaatccactgctaagaactatccatttgtatgataatcctctgtcttttgtggggaactcagcatttcacaacctgtctgatctgcattccttagtcattcgtggtgcaagcctggtgcagtggttccccaatctggccggaactgtccatctggagagtctaaccttgacagggacaaaaataagcagcatacctgatgatctgtgccaaaaccaaaagatgctgcggactctggacttatcttataacgatataagagaccttccaagttttaatggttgtcgtgcattggaagaaatttcattgcagcgtaatcaaatctccctgataaaggaaactacttttcaaggcctaacatccctaaggattctagatctgagtagaaacctgattcgtgaaattcacagtggagcttttgcgaagcttgggacaattactaacctggatgtgagtttcaatgaattaacctcatttcctacggaaggcctgaatgggctcaatcaacttaaacttgtgggtaacttccagctgaaagatgccttggcagccagagactttgccaatctcaggtctctatcagtaccatatgcttatcagtgttgtgcattttgggggtgtgactcttatgcaaatttaaacacagaagataacagcccccaagaccacagtgtgacaaaagagaaaggtgctacagatgcagcaaatgccaccagcactgctgaaagtgaagaacatagccaaataatcatccattgtacaccttcaacaggtgcttttaagccctgtgaatatttactgggaagctggatgattcgccttacagtgtggttcattttcctggtcgccttgcttttcaacctgcttgtcattttaacagtgtttgcgtcttgttcatcactgcctgcctccaagctcttcataggcttgatttctgtgtctaacttactcatgggcatctatactggcatccttacttttcttgatgctgtgtcctggggccgatttgctgaatttggcatttggtgggaaactggcagcggctgcaaggtagctgggtctctggcagtcttctcctcagagagcgccgtattcctgttaaccctggcagccgtggaaagaagcgtttttgcaaaggatgtaatgaaaaatgggaaaagcagtcacctccgacagttccaggtggctgccctcgtagctttgctgggtgctgcaatagcaggctgcttccccctttttcacggagggcaatattctgcatcacccttgtgcttgccatttcctacaggagagacaccatcattaggattcactgtgaccctagtgctattaaactcactagcatttttattgatggccattatctacactaaactctactgcaacttagagaaagaagacccgtcagaaaactcccagtctagcatgattaagcacgttgcttggctcatcttcacaaactgcatcttcttctgccctgttgcatttttctcattcgcaccattgatcacggcaatctccatcagccccgagataatgaagtctgttacgctgatattcttcccgctgcctgcttgcctgaatccagtcctgtacgttttcttcaacccaaagtttaaagacgactggaagctcctgaagcggcgtgtcaccaggaaacacggatcagtctcagtctccatcagcagccaaggcggttgtggggaacaggatttctactacgactgtggcatgtattcccacttgcagggtaacctgactgtctgtgactgctgtgagtcatttcttctgacaaaaccagtatcgtgcaaacacttaataaaatcgcacagttgtcctgtattgacagtggcctcttgccagaggccagaggcctactggtctgattgtggcacacagtcggcccattctgactatgcagatgaagaggattcctttgtctcggacagctctgaccaggtgcaggcctgtggacgagcctgcttctaccagagtcgcggattccctctggtgcgctatgcttataatctaccgagagtcagagac

SEQ ID NO: 169 - protein, 941 aa, Homo sapiens
MASPRSSGQPGPPPPPPPPPARLLLLLLLPLLLPLAPGAWGWARGAPRPPPSSPPLSIMGLMPLTKEVAKGSIGRGVLPAVELAIEQIRNESLLRPYFLDLRLYDTECDNAKGLKAFYDAIKYGPNHLMVFGGVCPSVTSIIAESLQGWNLVQLSFAATTPVLADKKKYPYFFRTVPSDNAVNPAILKLLKHYQWKRVGTLTQDVQRFSEVRNDLTGVLYGEDIEISDTESFSNDPCTSVKKLKGNDVRIILGQFDQNMAAKVFCCAYEENMYGSKYQWIIPGWYEPSWWEQVHTEANSSRCLRKNLLAAMEGYIGVDFEPLSSKQIKTISGKTPQQYEREYNNKRSGVGPSKFHGYAYDGIWVIAKTLQRAMETLHASSRHQRIQDFNYTDHTLGRIILNAMNETNFFGVTGQVVFRNGERMGTIKFTQFQDSREVKVGEYNAVADTLEIINDTIRFQGSEPPKDKTIILEQLRKISLPLYSILSALTILGMIMASAFLFFNIKNRNQKLIKMSSPYMNNLIILGGMLSYASIFLFGLDGSFVSEKTFETLCTVRTWILTVGYTTAFGAMFAKTWRVHAIFKNVKMKKKIIKDQKLLVIVGGMLLIDLCILICWQAVDPLRRTVEKYSMEPDPAGRDISIRPLLEHCENTHMTIWLGIVYAYKGLLMLFGCFLAWETRNVSIPALNDSKYIGMSVYNVGIMCIIGAAVSFLTRDQPNVQFCIVALVIIFCSTITLCLVFVPKLITLRTNPDAATQNRRFQFTQNQKKEDSKTSTSVTSVNQASTSRLEGLQSENHRLRMKITELDKDLEEVTMQLQDTPEKTTYIKQNHYQELNDILNLGNFTESTDGGKAILKNHLDQNPQLQWNTTEPSRTCKDPIEDINSPEHIQRRLSLQLPILHHAYLPSIGGVDASCVSPCVSPTASPRHRHVPPSFRVMVSGL

SEQ ID NO: 170 - protein, 935 aa, Mus musculus
RAPGQPRSSPPPPPPARLLLPLLLSLLLSLAPGAWGWARGAPRPPPSSPPLSIMGLMPLTKEVAKGSIGRGVLPAVELAIEQIRNESLLRPYFLDLRLYDTECDNAKGLKAFYDAIKYGPNHLMVFGGVCPSVTSIIAESLQGWNLVQLSFAATTPVLADKKKYPYFFRTVPSDNAVNPAILKLLKHFRWRRVGTLTQDVQRFSEVRNDLTGVLYGEDIEISDTESFSNDPCTSVKKLKGNDVRIILGQFDQNMAAKVFCCAFEESMFGSKYQWIIPGWYEPAWWEQVHVEANSSRCLRRSLLAAMEGYIGVDFEPLSSKQIKTISGKTPQQYEREYNSKRSGVGPSKFHGYAYDGIWVIAKTLQRAMETLHASSRHQRIQDFNYTDHTLGRIILNAMNETNFFGVTGQVVFRNGERMGTIKFTQFQDSREVKVGEYNAVADTLEIINDTIRFQGSEPPKDKTIILEQLRKISLPLYSILSALTILGMIMASAFLFFNIKNRNQKLIKMSSPYMNNLIILGGMLSYASIFLFGLDGSFVSEKTFETLCTVRTWILTVGYTTAFGAMFAKTWRVHAIFKNVKMKKKIIKDQKLLVIVGGMLLIDLCILICWQAVDPLRRTVERYSMEPDPAGRDISIRPLLEHCENTHMTIWLGIVYAYKGLLMLFGCFLAWETRNVSIPALNDSKYIGMSVYNVGIMCIIGAAVSFLTRDQPNVQFCIVALVIIFCSTITLCLVFVPKLITLRTNPDAATQNRRFQFTQNQKKEDSKTSTSVTSVNQASTSRLEGLQSENHRLRMKITELDKDLEEVTMQLQDTPEKTTYIKQNHYQELNDILSLGNFTESTDGGKAILKNHLDQNPQLQWNTTEPSRTCKDPIEDINPCSIQRRLSLQLPILHHAYLPSIGGVDASCVSPCVSPTASPRHRHVPPSFRVMVSGL

SEQ ID NO: 171 - DNA, 2805 bp, Mus musculus
cgagctccgggtcagccccggtcgtcgccgccaccgccgccgcccgcgcgcctgctgctgcccctgctgctgtcgttgctgctgtcgttggctcccggggcctggggctgggcgcggggcgccccccggccgccgcccagcagcccgccgctctccatcatgggcctcatgccgctcaccaaggaggtggccaagggcagcatcgggcgcggcgtgctccccgccgtggagctagccatcgagcagatccgcaacgagtcactcctgcgcccctacttcctggacctgcgactctacgacaccgagtgtgacaatgcaaagggactgaaagccttctatgatgcaataaagtatgggccgaaccatttgatggtgtttggaggcgtctgtccgtctgtcacctctatcatcgcggaatccctccaaggctggaacctggtgcagctttccttcgccgccaccacgcctgttcttgcggataagaagaagtacccatatttcttccggacggtgccctcagacaacgcggtgaacccggcaatcctgaagctgctgaagcacttccgctggcggcgcgtgggcacactcacgcaggacgtgcagcgcttctccgaggtgaggaacgacctgactggggttctgtacggggaagacattgagatctcagacacggagagcttctccaatgatccctgcaccagcgtcaaaaagctcaaggggaacgacgtgcggatcatccttggccagtttgaccagaacatggcagcgaaagtcttctgttgtgcctttgaggagagcatgtttggcagcaagtaccagtggatcatcccgggctggtacgagcctgcgtggtgggaacaggtgcacgtggaggccaactcctcacgctgcctgcgcaggagcctcctggctgccatggaaggctacatcggagtggacttcgagcccctgagctccaaacaaatcaagaccatctcagggaagactccacagcaatacgaaagagaatacaacagcaagcgttcgggtgtagggcccagcaagttccatgggtatgcctacgatggcatctgggtcatcgccaagaccctgcagagggccatggagacactgcatgccagtagcaggcaccagcggatccaggacttcaactacacagaccacaccctgggcagaatcatcctcaacgccatgaacgaaaccaacttcttcggagtcacgggtcaagttgtgttccggaacggggaaagaatgggaaccattaaatttactcaatttcaagacagcagagaggtgaaggtcggcgagtacaacgctgtggctgacacactggagatcatcaacgacaccataaggttccaggggtcggagccacccaaggacaagaccatcattctagagcagcttcggaagatctcgcttccactgtatagcatcctgtcagctctcactatcctcggcatgatcatggccagcgccttcctcttcttcaacatcaagaaccggaaccaaaagctgatcaagatgtcaagcccctatatgaacaacctcatcatcctgggtgggatgctgtcctatgcatccatcttcctctttggtctcgatggatccttcgtctcagaaaagacctttgaaacactctgcacggtccggacctggattctcaccgtgggctacacaaccgcctttggagccatgtttgcaaagacctggagggtccatgccatcttcaaaaatgtgaaaatgaagaagaagatcatcaaagaccagaagctgctcgtgattgtggggggcatgctgctgatcgatctgtgcatcctgatctgctggcaggctgtggaccccctgcggaggacagtggagcggtacagcatggagccggacccagcaggacgggacatctccatccgcccactgctggaacactgcgaaaacacccacatgaccatctggctcggcattgtctacgcctacaaggggctcctcatgttgttcggttgtttcttagcatgggaaacccgcaacgtgagcatccctgccctcaacgacagcaagtacattgggatgagtgtgtacaatgtggggatcatgtgcatcatcggggccgccgtctccttcctgacacgtgaccagcccaacgtgcagttctgcatcgtggccctggtcatcatcttctgtagcaccatcactctctgcctggtgtttgtgccaaagctcatcactctgaggacaaaccctgacgcagccactcagaacaggcgattccagttcacacagaaccagaagaaagaagattcgaagacctccacctcagtcaccagcgtgaaccaggcgagcacgtcacgcctggagggactgcagtcagaaaaccaccgcctacgaatgaagatcacagagctggacaaagacttggaagaagtcaccatgcagctacaagacacaccagagaagaccacatacatcaaacagaatcactaccaagagctcaacgacatcctcagcttgggcaacttcacagagagcacagatggaggaaaggccattctaaaaaatcacctcgatcaaaaccctcagctccagtggaacacgaccgagccctcaagaacatgcaaagaccccatagaggacatcaacccctgcagcatccagcgccggctgtccctccagctccccatcctccaccacgcctacctcccgtccattggaggcgtggacgccagctgcgtcagcccctgtgtcagccctacagccagccctcgccacagacacgtaccaccctccttccgagtcatggtctcgggcctg

SEQ ID NO: 172 - protein, 306 aa, Homo sapiens
MYSFMAGSIFITIFGNLAMIISISYFKQLHTPTNFLILSMAITDFLLGFTIMPYSMIRSVENCWYFGLTFCKIYYSFDLMLSITSIFHLCSVAIDRFYAICYPLLYSTKITIPVIKRLLLLCWSVPGAFAFGAVFSEAYADGIEGYDILVACSSSCPVMFNKLWGTTLFMAGFFTPGSMMVGIYGKIFAVSRKHAHAINNLRENQNNQVKKDKKAAKTLGIVIGVFLLCWFPCFFTILLDPFLNFSTPVVLFDALTWFGYFNSTCNPLIYGFFYPWFRRALKYILLGKIFSSCFHNTILCMQKESE

SEQ ID NO: 173 - protein, 306 aa, Mus musculus
MYSLMACAIFITIFGNLAMIISISYFKQLHTPTNLLILSMAVTDFLLGFTIMPYSMVRSVENCWYFGLTFCKIHYSFDLMLSITSIFHLCSVAVDRFYAICHPLHYCTKMTIPVVRRLLLVCWSVPGAFAFGVVFSEAYADGIEGYDILVACSSSCPVMFNKLWGTTLFVAGFFTPSSMMVGIYGKIFAVSKKHARVIDNLPENQNNQMRKDKKAAKTLGIVMGVFLLCWFPCFFTILLDPFLNFSTPAVLFDALTWFGYFNSTCNPLIYGFFYPWFRRALKYILLGKIFSSHFHNTNLFTQKETE

SEQ ID NO: 174 - DNA, 921 bp, Mus musculus
atgtactcgttgatggcctgcgccatattcatcacgatctttggcaacctggccatgatcatttccatttcctacttcaaacagcttcacacaccgaccaacctcctcattctctccatggccgtcaccgacttccttctcggattcaccatcatgccatatagtatggtcaggtcagtggaaaactgctggtatttcggacttacgttttgcaagatccattatagcttcgacctgatgcttagcataacgtccattttccacctttgctcggtggccgtcgatagattttatgccatctgtcaccctttgcattattgcaccaaaatgactatcccggtcgttaggcggctgctgctcgtctgctggtcagtccccggggcgtttgcctttggggtggtcttctccgaggcttacgctgatggaattgaaggctatgacattttggttgcatgttccagttcctgcccagtcatgttcaacaagctatgggggaccaccttgtttgtggcaggctttttcactcctagctcgatgatggtggggatttacggcaaaattttcgctgtatccaaaaaacacgctcgcgtaattgacaacttgccagaaaatcaaaacaatcaaatgaggaaggacaaaaaagcagccaaaactttagggatagtgatgggtgttttcttattgtgttggtttccatgtttcttcaccatcctgttagatccgtttctgaatttctctacgcctgcagttctgtttgatgccttaacatggttcggttattttaattccacatgtaatcccttaatttatggtttcttctacccttggtttcgcagagcactcaagtacattttactgggtaaaattttcagctcgcatttccataatactaatttgtttactcaaaaagaaacagaatag

SEQ ID NO: 175 - protein, 368 aa, Homo sapiens
MANSTGLNASEVAGSLGLILAAVVEVGALLGNGALLVVVLRTPGLRDALYLAHLCVVDLLAAASIMPLGLLAAPPPGLGRVRLGPAPCRAARFLSAALLPACTLGVAALGLARYRLIVHPLRPGSRPPPVLVLTAVWAAAGLLGALSLLGPPPAPPPAPARCSVLAGGLGPFRPLWALLAFALPALLLLGAYGGIFVVARRAALRPPRPARGSRLRSDSLDSRLSILPPLRPRLPGGKAALAPALAVGQFAACWLPYGCACLAPAARAAEAEAAVTWVAYSAFAAHPFLYGLLQRPVRLALGRLSRRALPGPVRACTPQAWHPRALLQCLQRPPEGPAVGPSEAPEQTPELAGGRSPAYQGPPESSLS

SEQ ID NO: 176 - protein, 285 aa, Mus musculus
MANGSGLSVTELAGSVGFILAVLVEVGAVLGNGTLLVVVLRTPDLQDAFYLAHLCVVDLLAAASIMPLGLLAAPPGLGTVPLDPSSCRAARFLSAALLPACTLGVAALGLARYRLIVHPLRPGSVLAGGLGPFRPLWAMLAFALPALLLLAAYDSRLSFLPPLRPRLLGGKAALAPALAVGQFAACWLPYGCACLAPAARAAAAEATVTWVAYSAFAAHPFLYGLLQRPVRLALGRLTRRALPRAPKACTSQAWHLQTLLRRLQELRKDPVLGPSEAPEQARELA

SEQ ID NO: 177 - DNA, 855 bp, Mus musculus
atggccaacggctcggggctcagcgtcaccgaactcgcgggctcggtggggtttatcctggcggttctcgtagaggtgggggccgtgctgggcaacggcactctgctcgtggtggtgctgcgcacgccggaccttcaagatgccttctacttagcgcacttgtgcgtcgtggacctgctggcggctgcctccatcatgcctctgggcctgctggccgcgccgcccgggctgggcactgtgcccctggacccctcgtcgtgccgagcggcgcgcttcctctcggcggctctgctccccgcatgcacgctcggcgtggccgctctcggcctggcgcgctaccgcctcatagtgcatccgctgcggccaggctccgtcctggccggggggctcgggcccttccgcccgctttgggcgatgctagccttcgcgctgcccgccctcctgctgttggccgcctacgacagtcgcctctccttcttgccgcccctccggccacgtctgctggggggcaaggcggccctggccccagccctggccgtgggccagtttgcagcctgctggctgccttatggctgcgcgtgcttggcgcccgcggcgcgcgccgcagcggccgaggctactgtcacctgggtagcctactccgccttcgcggctcacccctttctctatggcctgctgcagcgcccggtgcgcctggcgctgggccgccttacccgccgagcgctgcctcgggccccgaaagcctgcacatcgcaagcctggcacctgcagacactccttcggcgcctccaggaactccgcaaggaccctgtcctaggcccttctgaggcaccagaacaggcccgagaattggca

SEQ ID NO: 178 - protein, 1014 aa, Homo sapiens
MVFSVRQCGHVGRTEEVLLTFKIFLVIICLHVVLVTSLEEDTDNSSLSPPPAKLSVVSFAPSSNEVETTSLNDVTLSLLPSNETEKTKITIVKTFNASGVKPQRNICNLSSICNDSAFFRGEIMFQYDKESTVPQNQHITNGTLTGVLSLSELKRSELNKTLQTLSETYFIMCATAEAQSTLNCTFTIKLNNTMNACAAIAALERVKIRPMEHCCCSVRIPCPSSPEELGKLQCDLQDPIVCLADHPRGPPFSSSQSIPVVPRATVLSQVPKATSFAEPPDYSPVTHNVPSPIGEIQPLSPQPSAPIASSPAIDMPPQSETISSPMPQTHVSGTPPPVKASFSSPTVSAPANVNTTSAPPVQTDIVNTSSISDLENQVLQMEKALSLGSLEPNLAGEMINQVSRLLHSPPDMLAPLAQRLLKVVDDIGLQLNFSNTTISLTSPSLALAVIRVNASSFNTTTFVAQDPANLQVSLETQAPENSIGTITLPSSLMNNLPAHDMELASRVQFNFFETPALFQDPSLENLSLISYVISSSVANLTVRNLTRNVTVTLKHINPSQDELTVRCVFWDLGRNGGRGGWSDNGCSVKDRRLNETICTCSHLTSFGVLLDLSRTSVLPAQMMALTFITYIGCGLSSIFLSVTLVTYIAFEKIRRDYPSKILIQLCAALLLLNLVFLLDSWIALYKMQGLCISVAVFLHYFLLVSFTWMGLEAFHMYLALVKVFNTYIRKYILKFCIVGWGVPAVVVTIILTISPDNYGLGSYGKFPNGSPDDFCWINNNAVFYITVVGYFCVIFLLNVSMFIVVLVQLCRIKKKKQLGAQRKTSIQDLRSIAGLTFLLGITWGFAFFAWGPVNVTFMYLFAIFNTLQGFFIFIFYCVAKENVRKQWRRYLCCGKLRLAENSDWSKTATNGLKKQTVNQGVSSSSNSLQSSSNSTNSTTLLVNNDCSVHASGNGNASTERNGVSFSVQNGDVCLHDFTGKQHMFNEKEDSCNGKGRMALRRTSKRGSLHFIEQM

SEQ ID NO: 179 - protein, 1009 aa, Mus musculus
MLFSGGQYSPVGRPEEVLLIYKIFLVIICFHVILVTSLKENGNSSLLSPSAESSLVSLIPYSNGTPDAASEVLSTLNKTEKSKITIVKTFNASGVKSQRNICNLSSLCNDSVFFRGEIVFQHDEDHNVTQNQDTANGTFAGVLSLSELKRSELNKTLQTLSETYFIVCATAEAQSTVNCTFTVKLNETMNVCAMMVTFQTVQIRPMEQCCCSPRTPCPSSPEELEKLQCELQDPIVCLADQPHGPPLSSSSKPVVPQATIISHVASDFSLAEPLDHALMTPSTPSLTQESNLPSPQPTIPLASSPATDLPVQSVVVSSLPQTDLSHTLSPVQSSIPSPTTPAPSVPTELVTISTPPGETVVNTSTVSDLEAQVSQMEKALSLGSLEPNLAGEMVNRVSKLLHSPPALLAPLAQRLLKVVDAIGLQLNFSSTTISLTSPSLALAVIRVNASNFNTTTFAAQDPTNLQVSLETPPPENSIGAITLPSSLMNNLPANDVELASRIQFNFFETPALFQDPSLENLTLISYVISSSVTNMTIKNLTRNVTVALKHINPSPDDLTVKCVFWDLGRNGGKGGWSSDGCSVKDKRMNETICTCSHLTSFGILLDLSRTSLPPSQMMALTFITYIGCGLSSIFLSVTLVTYIAFEKIRRDYPSKILIQLCAALLLLNLIFLLDSWIALYNTRGFCIAVAVFLHYFLLVSFTWMGLEAFHMYLALVKVFNTYIRKYILKFCIVGWGIPAVVVSIVLTISPDNYGIGSYGKFPNGTPDDFCWINSNVVFYITVVGYFCVIFLLNVSMFIVVLVQLCRIKKKKQLGAQRKTSIQDLRSIAGLTFLLGITWGFAFFAWGPVNVTFMYLFAIFNTLQGFFIFIFYCAAKENVRKQWRRYLCCGKLRLAENSDWSKTATNGLKKQTVNQGVSSSSNSLQSSCNSTNSTTLLVNSDCSVHASGNGNASTERNGVSFSVQNGDVCLHDLTGKQHMFSDKEDSCNGKSRIALRRTSKRGSLHFIEQM

SEQ ID NO: 180 - DNA, 4684 bp, Mus musculus
gccaaccggtcaccgggacccgcagatgcacacggagtttcctccctatttcctctgaacttcctgtcaggatgcttttctctggtgggcagtacagccctgttggcagacctgaagaggttttactgatatacaagatattccttgtcatcatttgttttcatgtcattctcgttacatccctgaaagaaaacggtaattccagtttgttatcaccatctgctgaatcatctcttgtcagtctcatcccctactccaatggtacaccagatgctgcttcagaagttttgtcgactttaaacaaaacagaaaaatctaaaatcactatagtaaaaaccttcaatgcatcaggagtcaaatcccagagaaatatctgcaatttgtcatctctttgcaatgactcagtattttttagaggtgagatagtgtttcaacatgatgaagaccacaatgttacccagaatcaagatacagctaatggcaccttcgctggagtcctgtctctaagtgaactgaagcgatcagagctcaacaaaactctacagaccttaagtgagacttactttatagtgtgtgctacagcagaggcccaaagcacggtaaactgtacattcacagtaaaactcaatgagaccatgaatgtgtgtgccatgatggttactttccaaactgtacagattcggccaatggaacagtgctgctgttccccgaggactccctgcccttcctcaccagaagagttagaaaaactacagtgtgaactgcaggatcccattgtctgtcttgctgatcaaccgcatggcccaccgttatcgtcttccagcaagcctgttgtacctcaggccaccattatttcccatgttgctagtgacttctctttggctgaaccccttgatcatgcccttatgaccccaagcacaccctctctgacacaagaaagtaaccttccatctcctcagcctacgatccccctggcttccagtcctgccactgacttgccagttcaatctgtagtggtctcttctttgcctcaaactgatctttcccacaccctgtcaccggtgcagtcctccattccctctcctaccacaccagccccatctgtccctacagaactggtcaccatcagcacacctcctggtgagacagttgtcaacactagcactgtttctgatctggaagcccaagtatcccagatggagaaagctttgtctttgggtagcttagagcctaatcttgcaggcgaaatggtaaaccgagtcagcaaactccttcactctccacctgccttgctagcccctctagctcaaaggttgctaaaagtggtagatgccattggcttacagctgaatttttcatctacaactatcagtctaacttcaccttctttggctcttgctgtgatcagagtgaatgccagtaatttcaataccacgacttttgcagcccaagacccaacaaatctccaggtttctctggaaaccccacctcctgagaatagtattggtgccattactctgccctcatcactgatgaataatttgccagctaatgatgtagaattggcttcaaggattcagttcaatttctttgaaacacccgccctgtttcaggatccttccctggagaacctcactctgataagctatgtcatatcatcaagtgtcacaaacatgaccatcaagaacttgacaagaaacgtgacagtcgcactgaaacacatcaacccaagtccggatgacttaactgtgaaatgtgtattctgggacttgggcagaaatggtggcaaaggaggttggtcatctgatggctgttccgtcaaagacaagagaatgaatgaaaccatctgtacctgtagccatcttacaagttttggcatcctattggacctatctcgaacatccttaccaccaagtcaaatgatggctctgacatttatcacgtatattggctgtgggctttcatcaatttttctgtcagttactcttgtaacctacatcgcctttgaaaagatccggagggattacccctccaaaatcctcatccagctgtgtgctgccctgcttctgctcaacctgatcttcctcctagactcctggattgcgctgtataatacccgaggtttctgcattgccgtggctgtatttcttcactattttctcttggtctcattcacatggatgggattagaagcattccacatgtacctagcactggtcaaggtgtttaatacttacatccgaaagtacatccttaaattctgcattgttggctggggcataccagctgtggttgtgtccatcgtcctgactatatccccagataactatgggattggatcctatggaaaattccccaatggcacaccagatgacttttgctggatcaacagcaatgtggtgttctatatcacggttgtgggatatttctgtgtgatatttctactgaacgtcagcatgttcatcgtggtcttggttcagctctgtcgaattaaaaagaagaagcagctgggagcccagcgcaaaactagtattcaagacctcaggagtatcgctggcctcacatttttactgggaattacttggggctttgccttctttgcctggggaccagttaatgtcaccttcatgtatctctttgccatctttaacaccttacaagggtttttcatattcattttttactgtgcagcaaaagagaatgtcagaaaacagtggaggcggtatctttgttgtggaaaattacggctggctgaaaattctgactggagtaaaactgctactaatggtttaaagaagcagactgtaaaccaaggagtatccagctcttcaaattccttacagtcaagctgtaactccactaactccaccacactcctagtgaatagtgattgctcagtgcacgcaagcgggaatggcaatgcatctaccgagaggaatggggtttctttcagtgttcagaatggagacgtgtgccttcatgatctcactggcaaacagcatatgtttagtgacaaagaggactcctgcaatggtaaaagccggatagcgctcagaaggacttcgaagcggggaagcttacactttatcgagcaaatgtgattctcttcttctaaaatcaaagcatgatgtggatggtgtgaagtgtccagttttcctttaacacaatgtgagatgtatgaaaagcgctggttttctattcagcaacctcgaaaggaacataagctaaatgagggcaaccagttactatcagaagaaaccacgactggttatggtttctagacgtttgcagtttggtttcttatctctcattttcaaaggcattggtgttaaaaccacagaataagatccaggaaagaaaaatgaaagtttgtttccactcacattttaaagaggctgttatccttgataacatcctaagaaagaaggaaaaaaagaaggaaagaaagaaagaaagagagagagagagagagaaagaaaaaagaaagaaagatgtttacttcagtctgttggtaagtttagttgtgcatgcctttgttgtatataagctaaattctagtgacccacatgtcaaaaaatcttctctttacctttttttatatttattttctactgtgtaaatttattcttttgtagaatcatggttgtgtcgccttctctaatgtgataacttaccagtgacttctaaacctcctttagaagatcatataggatgtgaaattcagaaacttcactgaaatcaagaaataatgataaaggcaatctgaacaattataaatagacaattagctcagaaagtgcctttgagcaatcaagaaaaggtgcccccactgggcagatatagccttgtgagcttatggtttggaaaacagtcgggccacattttagccctgatgatcctcctgggtaccttatgcagggtcctcatgaagggtccttatgcagggaatgacttgtatgactatatgtgacatgaaatagtgataccaatggccagacttcatccctaatgaccagattatagaatctctacaccatggttgttagaggctaaaactgtaatctaaaccatgttaggaaaatcgtgatggtagaaaagatacacactgccacttctcaaatacccagagcctttcaaaagaggggatcagagtaggattacttttccagagtgtatatatggcaaacaaagtaggtctttaaaagacgctgcatgatatgttattgttgcaactgctacattctggtccagtcatacttgtatgtatttttaaaaacatgtcaaatcttgaagagtgtatagtgacaagggggagcagctactgggaagagtgaattatcctgtgatattgttgtttgtatgtaataacatatatccaaccttgattgttcctagttctagagggcctatcctatttctcacctttaccagcttgagtggtgcctcaagcagtgtgattattaggaacatttcaaaatcctttagttaggtctttcactaaggctcccttgcatatatttcaaataaatgttgtatctgagactagccacagtagtaacatctgtttctgtgtgtgctcattgtctttgcaaaattcttctccaaattatttaattattttgtatttatatgttatgattgacaaaactgttaaaaaccaataaaaatcaatttgcagttaaaa

SEQ ID NO: 181 - protein, 365 aa, Homo sapiens
MGNITADNSSMSCTIDHTIHQTLAPVVYVTVLVVGFPANCLSLYFGYLQIKARNELGVYLCNLTVADLFYICSLPFWLQYVLQHDNWSHGDLSCQVCGILLYENIYISVGFLCCISVDRYLAVAHPFRFHQFRTLKAAVGVSVVIWAKELLTSIYFLMHEEVIEDENQHRVCFEHYPIQAWQRAINYYRFLVGFLFPICLLLASYQGILRAVRRSHGTQKSRKDQIQRLVLSTVVIFLACFLPYHVLLLVRSVWEASCDFAKGVFNAYHFSLLLTSFNCVADPVLYCFVSETTHRDLARLRGACLAFLTCSRTGRAREAYPLGAPEASGKSGAQGEEPELLTKLHPAFQTPNSPGSGGFPTGRLA

SEQ ID NO: 182 - protein, 365 aa, Mus musculus
MGNITTENSSLSCPIDHTIHQTLAPVVYVTVLVVGFPANCLSLYFGYLQIKARNELGVYLCNLTIADLFYICSLPFWLQYVLQHDDWSHGDLSCQVCGILLYENIYISVGFLCCISIDRYLAVAHPFRFHQFRTLKAAVGVSVLIWAKELLTSIYFLNHKEVIEDEDQHRVCFEHYPIQAWQRSINYYRFLVGFLFPICLLLASYQGILRAVRRSHGTQKSRKDQIQRLVLSTVVIFLACFLPYHVLLLVRSLWERNCEFAKSIFNVYHFSLLLTSFNCVADPVLYCFVSETTHRDLARLRGACLAVLTCSRTSRAREAYPLGAPEASGKSGAQGEEPELLTKLHSAFQTPSSLGVGGPSTVGLA

SEQ ID NO: 183 - DNA, 1095 bp, Mus musculus
atggggaacatcactacagaaaactcctcactatcttgccccatcgaccacaccatccaccagacactagccccagtggtctatgtgaccgtgctggtggtgggcttcccagccaactgcctgtccctctacttcgggtacttgcagatcaaggcccggaatgagctgggagtgtacctgtgtaacctgaccattgcagacctgttctatatctgttcacttcccttctggctgcagtacgtgcttcagcacgacgactggtcccatggtgacctatcctgccaggtgtgtggcatcctcctctatgagaacatttacatcagcgtgggcttcctctgctgcatctccatcgaccgctacctggctgtggcccaccccttccgcttccaccagttccgcaccctgaaggcagccgtgggtgtcagtgtgctcatctgggccaaggagctgctgaccagcatctacttcctcaatcacaaggaggtcattgaggacgaggaccagcaccgagtctgctttgagcattaccctatccaggcctggcagcgtagcatcaactactaccgcttcctggtgggctttctcttccccatctgcctgctgctggcctcctaccagggcatcctgcgggctgtgcgccgcagccacggcacacagaagagccgcaaggaccagattcagcggctggtgctcagcaccgtggtcatcttcctggcttgctttctaccctaccacgtgctgctgctggtacgcagcctctgggagagaaactgtgagtttgccaagagcatcttcaacgtctatcacttctccctcctcctcaccagcttcaactgtgtagctgacccggtgctgtactgctttgtcagtgagaccactcacagggacctagcccgcctccgaggagcctgcctagctgtccttacctgctctaggacaagcagggccagggaggcctaccctctgggtgcccctgaggcctctgggaaaagtggggcccagggcgaggaacctgaattgttaaccaagctccactcagccttccagacccctagctcactgggagtgggagggccctccacagtggggttggcc

SEQ ID NO: 184 - protein, 336 aa, Homo sapiens
MNNNTTCIQPSMISSMALPIIYILLCIVGVFGNTLSQWIFLTKIGKKTSTHIYLSHLVTANLLVCSAMPFMSIYFLKGFQWEYQSAQCRVVNFLGTLSMHASMFVSLLILSWIAISRYATLMQKDSSQETTSCYEKIFYGHLLKKFRQPNFARKLCIYIWGVVLGIIIPVTVYYSVIEATEGEESLCYNRQMELGAMISQIAGLIGTTFIGFSFLVVLTSYYSFVSHLRKIRTCTSIMEKDLTYSSVKRHLLVIQILLIVCFLPYSIFKPIFYVLHQRDNCQQLNYLIETKNILTCLASARSSTDPIIFLLLDKTFKKTLYNLFTKSNSAHMQSYG

SEQ ID NO: 185 - protein, 328 aa, Mus musculus
MTNNSTCIQPSVISTTALPVTYIFLFIIGLFGNSLAQWVFLTKIGKKTSTHIYLANLVTANLLVCTAMPFMGIYFLRGFYWKYQSVQCRLVNFLGTLSMHVSMFVSLLILSWIAISRYATLMKKESKQEATSCYERMFYGHVLKRFRQPNFARTMCIYIWGVVLVIIIPVTLYYSVVEATEEGQSQCYNRQMELGARPSQIAGLIGTTFIGFSFLVVVTSYYSLVSHLRRVRTCTSITEKDLTYRSVKRHLLIIQVLLVVCFLPYSIFKPIFYVLHQREGDCQQLNYLIEAKNILTCLASARSSTDPIIFLLLDKTFKKTLYGLLTKS

SEQ ID NO: 186 - DNA, 984 bp, Mus musculus
atgactaataactcgacatgcattcaaccatccgtgatttctaccacagctttaccggtcacttacatctttttgtttattattggtctctttggaaactcacttgctcagtgggtatttttaacaaaaataggtaagaaaacatcaacacatatctacttggcaaatcttgtgactgcaaacttacttgtgtgcactgctatgcctttcatgggtatatatttcttgagaggtttttattggaaatatcaatctgtacaatgcagactggtcaattttttgggaactctttctatgcatgtaagtatgtttgtcagcctcttaattttaagctggattgccataagccgctatgctaccttaatgaaaaaggagtccaagcaagaggccacctcatgctacgagagaatgttttatggtcacgtactgaaaagatttcgccagcccaactttgccagaacaatgtgtatttacatatggggagttgtgcttgtcataattattccagttaccctatactactcagtagtcgaggctacagaagaaggacagagccagtgctacaatcggcagatggaactgggagccagaccttctcagattgcgggtctcattggaaccacatttattggattctcctttttagtagtagtgacatcatactattctcttgtcagccatctgcgaagagtaaggacctgtacctccattaccgagaaagatttgacctacagatctgtgaaaagacaccttttgatcatccaggtcctcctagtagtttgctttcttccatatagtatttttaaacccattttttatgttctgcaccagagagaaggagactgtcagcagctgaattatttaatagaagcaaaaaacatcctcacttgtcttgcatcagccagaagtagtacagaccccattatatttcttttattagataaaacattcaagaagacactatatggtctccttacaaaatct

SEQ ID NO: 187 - protein, 372 aa, Homo sapiens [sequence omitted]

SEQ ID NO: 188 - protein, 373 aa, Mus musculus
MMFANSSANTTSTNSSVLQCPDYRDTHRLHMVVYSLVLATGLPLNALALWVFLRVLRVHSVVSVYMCNLAASDLLFTLSLPLRLSYYAQHHWPFPGFLCQTSGAIFQMNMYGSCLFLMLINVDRYAAIVHPLRLRHLRRPRVARRLCLGVWALILLFAVPAARVHSPSHCTYKNITVRLCFESFSDELWKGRLLPLLLLAEILGFLLPLAAVVYSSGRVFWTLARPDATQSQRRRKTVRLLLANLIIFLLCFVPYNSTLAVYGLLRANLVKNSIQDRDQVRGVLMIMVLLAGANCVLDPLVYYFSAEGFRNTLRNLGAPLNTRPLATNGAAGVLTELPSESTQNTGQDATSQVLLQPATLGTPPDNCSQDSAL

SEQ ID NO: 189 - DNA, 1119 bp, Mus musculus
atgatgtttgccaattcttcagccaacacgacttctaccaacagctctgtgctccagtgccctgactatcgagatacacatcgtttgcatatggtggtctacagcctggtattggcgactggtctccctctcaacgctctggctctctgggtcttcctgcgtgtactgcgcgtacactcagtggtgagcgtgtacatgtgcaacctggcagccagcgacttgctcttcaccctgtcacttcccctgcgcctctcctactatgcacagcaccactggccttttccaggcttcctgtgccagacgtcgggcgccatcttccagatgaacatgtacggcagctgtctctttctgatgctcatcaacgtggaccgctatgcggccatcgtgcacccgctgagactgcgccacctacggcggccccgtgtggcacggcggctctgcctgggcgtgtgggctctcatcctgctgttcgctgtgcccgccgcccgcgtgcacagcccgtcccactgcacgtacaagaacatcactgtgcgcctgtgcttcgagagcttcagcgatgaactgtggaagggcaggctgctgccgctcctgctgctggccgagatactaggctttctgctgcccctggcggctgtcgtctattcgtctggcagagtcttctggacactggcgaggcccgacgccactcagagccaacggcgacggaagaccgtgcgcctcctgctggccaatctcatcatcttcctgctgtgcttcgtgccctataactccacgctggctgtatatgggttgctacgggccaacttggtgaagaacagtattcaggaccgcgatcaggtgcgcggggtgctgatgataatggtgctgctggccggcgccaactgcgtgctggatccactggtttactacttcagtgccgagggtttccgtaacacccttcgcaacctgggcgccccgctgaataccaggcctttggctaccaatggggctgcaggcgtgctcaccgaactaccctcagaaagcacccaaaacactgggcaggatgccacaagtcaggttctactccagcctgccactctgggtacacccccggacaactgctcccaggattcggctctc

SEQ ID NO: 190 - protein, 872 aa, Homo sapiens
MGSLLALLALLPLWGAVAEGPAKKVLTLEGDLVLGGLFPVHQKGGPAEDCGPVNEHRGIQRLEAMLFALDRINRDPHLLPGVRLGAHILDSCSKDTHALEQALDFVRASLSRGADGSRHICPDGSYATHGDAPTAITGVIGGSYSDVSIQVANLLRLFQIPQISYASTSAKLSDKSRYDYFARTVPPDFFQAKAMAEILRFFNWTYVSTEASEGDYGETGIEAFELEARARNICVATSEKVGRAMSRAAFEGVVRALLQKPSARVAVLFTRSEDARELLAASQRLNASFTWVASDGWGALESVVAGSEGAAEGAITIELASYPISDFASYFQSLDPWNNSRNPWFREFWEQRFRCSFRQRDCAAHSLRAVPFEQESKIMFVVNAVYAMAHALHNMHRALCPNTTRLCDAMRPVNGRRLYKDFVLNVKFDAPFRPADTHNEVRFDRFGDGIGRYNIFTYLRAGSGRYRYQKVGYWAEGLTLDTSLIPWASPSAGPLAASRCSEPCLQNEVKSVQPGEVCCWLCIPCQPYEYRLDEFTCADCGLGYWPNASLTGCFELPQEYIRWGDAWAVGPVTIACLGALATLFVLGVFVRHNATPVVKASGRELCYILLGGVFLCYCMTFIFIAKPSTAVCTLRRLGLGTAFSVCYSALLTKTNRIARIFGGAREGAQRPRFISPASQVAICLALISGQLLIVVAWLVVEAPGTGKETAPERREVVTLRCNHRDASMLGSLAYNVLLIALCTLYAFNTRKCPENFNEAKFIGFTMYTTCIIWLALLPIFYVTSSDYRVQTTTMCVSVSLSGSVVLGCLFAPKLHIILFQPQKNVVSHRAPTSRFGSAAARASSSLGQGSGSQFVPTVCNGREVVDSTTSSL

SEQ ID NO: 191 - protein, 872 aa, Mus musculus
MESLLRFLALLLLRGAVAEGPAKKVLTLEGDLVLGGLFPVHQKGGPAEECGPVNEHRGIQRLEAMLFALDRINRDPHLLPGVRLGAHILDSCSKDTHALEQALDFVRASLSRGADGSRHICPDGSYATLSDAPTAITGVIGGSYSDVSIQVANLLRLFQIPQISYASTSAKLSDKSRYDYFARTVPPDFFQAKAMAEILRFFNWTYVSTVASEGDYGETGIEAFELEARARNICVATSEKVGRAMSRAAFEGVVRALLQKPSARVAVLFTRSEDARELLAATQRLNASFTWVASDGWGALESVVAGSERAAEGAITIELASYPISDFASYFQNLDPWNNSRNPWFREFWEERFRCSFRQRDCAAHSLRAVPFEQESKIMFVVNAVYAMAHALHNMHRALCPNTTRLCDAMRPVNGRRLYKDFVLNVKFDAPFRPADTDDEVRFDRFGDGIGRYNIFTYLRAGNGRYRYQKVGYWAEGLTLDTSIIPWASPSAGTLPASRCSEPCLQNEVKSVQPGEVCCWLCIPCQPYEYRLDEFTCADCGLGYWPNASLTGCFELPQEYIRWGDAWAVGPVTIACLGALATLFVLGVFVRHNATPVVKASGRELCYILLGGVFLCYCMTFIFIAKPSTAVCTLRRLGLGTAFSVCYSALLTKTNRIARIFGGAREGAQRPRFISPASQVAICLALISGQLLIVAAWLVVEAPGIGKETAPERREVVTLRCNHRDASMLGSLAYNVLLIALCTLYAFKTRKCPENFNEAKFIGFTMYTTCIIWLAFLPIFYVTSSDYRVQTTTMCVSVSLSGSVVLGCLFAPKLHIILFQPQKNVVSHRAPTSRFGSAAPRASANLGQGSGSQLVPTVCNGREVVDSTTSSL

SEQ ID NO: 192 - DNA, 2616 bp, Mus musculus
atggaatccctgcttaggttcctggcactgctgctgctgcggggtgctgtggccgagggcccggccaagaaggtgctgaccctggagggggacctggtgctgggtgggctgttcccagtgcaccagaagggtggcccagcagaggagtgtggacctgttaatgagcaccgtggcatacagcgcctagaggccatgctttttgcactggaccgcatcaaccgcgacccccatctgctgcctggggtgcgtttgggcgcgcacatcctcgacagctgctccaaggatacacacgccctggagcaggccctggactttgtgcgtgcctcactcagccgtggggctgatggctcacgccacatctgtcctgacggctcctatgctactctcagtgatgctcccacagctatcaccggtgtcattggcggctcctacagtgatgtctccatccaggtggccaatctcctgcggctgttccagatcccacagatcagctatgcctccaccagcgccaagctgagcgacaagtcccgttatgattactttgctcgcaccgtgcccccagacttcttccaagccaaggccatggctgagattctccgctttttcaactggacgtatgtgtctacggtggcatctgagggtgactatggagagacaggcattgaggccttcgagctcgaggctcgggcacgcaacatctgcgtggccacttcggagaaggtgggccgtgccatgagccgcgcagccttcgagggtgtggtgcgagccctgttgcagaagcccagcgcccgtgtggctgtgctcttcacccggtcagaggatgcccgtgagctgcttgcagccacccagcgtctcaacgccagcttcacctgggtagccagcgacggctggggggccctagagagcgtggtggcaggcagtgaaagggctgccgagggcgccatcaccattgagctggcctcctaccccatcagtgactttgcctcctacttccagaacttggatccctggaacaacagcaggaacccttggttccgtgagttctgggaggagaggttccgttgcagcttccggcagcgagactgcgccgcccactctctgcgggccgtaccctttgaacaggagtcaaagatcatgtttgtggtcaatgccgtgtatgccatggcccacgctctgcacaacatgcaccgtgccctctgtcccaacaccacccgcctctgcgatgccatgagacctgtcaatgggcgccgcctctacaaggacttcgtgctcaatgtcaagtttgatgcccccttccgcccagcagataccgacgacgaggtccgctttgaccgctttggagatggtattggccgctacaacatcttcacctatctgcgggcaggcaatgggcgctatcgctaccagaaggtaggctactgggcagaaggtctgactctggatactagcatcatcccatgggcctccccatcagctggcaccctccctgcctctcgctgtagcgagccctgccttcagaatgaggtgaagagcgtgcagcccggcgaggtctgctgctggctctgcatcccctgtcagccctatgagtacaggctggatgagttcacctgtgctgactgtggcctgggctactggcctaatgccagtctgactggatgctttgagctgccccaggagtacatccgctggggcgacgcctgggcggtgggacctgtcaccatcgcctgcctaggtgccctggccaccctctttgtgttgggtgtcttcgtgcggcataacgccacacccgtggtcaaggcctcggggcgggagctttgctacattctgctgggaggcgtcttcctctgctactgcatgaccttcatcttcatcgccaagccctccacggccgtctgcaccttaaggcgcctcgggttggggaccgccttctctgtctgctactcagccctcctcaccaagaccaatcgcatcgctcgcatctttggcggggcccgggagggtgcccagcggccgcgcttcatcagtcccgcctcacaggtggccatctgcctggcacttatctcgggccagctgctcattgttgctgcctggctggtggtggaggcacctggcataggcaaggagacagcccctgagcggcgggaagtggtgaccttgcgctgtaaccaccgtgacgcaagcatgcttggctcgctggcctacaacgtgctcctcatcgctctctgcacgctctatgccttcaagacccgcaagtgcccggagaacttcaacgaggccaagttcatcggctttaccatgtacaccacctgtatcatctggctggctttccttcccatcttctacgtcacctccagtgattatcgggtgcagaccactacgatgtgcgtgtccgtcagcctcagtggctctgtggtgctcggctgcctctttgcacccaagctgcacattatcctcttccagccacagaagaacgtggtgagccaccgggcacctaccagccgctttggcagtgctgcccccagggccagcgccaaccttggtcaagggtctggatcccagcttgttcctactgtttgcaatggccgtgaggtggtagactcaacaacatcgtcgctt

SEQ ID NO: 193 - protein, 912 aa, Homo sapiens
MPGKRGLGWWWARLPLCLLLSLYGPWMPSSLGKPKGHPHMNSIRIDGDITLGGLFPVHGRGSEGKPCGELKKEKGIHRLEAMLFALDRINNDPDLLPNITLGARILDTCSRDTHALEQSLTFVQALIEKDGTEVRCGSGGPPIITKPERVVGVIGASGSSVSIMVANILRLFKIPQISYASTAPDLSDNSRYDFFSRVVPSDTYQAQAMVDIVRALKWNYVSTVASEGSYGESGVEAFIQKSREDGGVCIAQSVKIPREPKAGEFDKIIRRLLETSNARAVIIFANEDDIRRVLEAARRANQTGHFFWMGSDSWGSKIAPVLHLEEVAEGAVTILPKRMSVRGFDRYFSSRTLDNNRRNIWFAEFWEDNFHCKLSRHALKKGSHVKKCTNRERIGQDSAYEQEGKVQFVIDAVYAMGHALHAMHRDLCPGRVGLCPRMDPVDGTQLLKYIRNVNFSGIAGNPVTFNENGDAPGRYDIYQYQLRNDSAEYKVIGSWTDHLHLRIERMHWPGSGQQLPRSICSLPCQPGERKKTVKGMPCCWHCEPCTGYQYQVDRYTCKTCPYDMRPTENRTGCRPIPIIKLEWGSPWAVLPLFLAVVGIAATLFVVITFVRYNDTPIVKASGRELSYVLLAGIFLCYATTFLMIAEPDLGTCSLRRIFLGLGMSISYAALLTKTNRIYRIFEQGKRSVSAPRFISPASQLAITFSLISLQLLGICVWFVVDPSHSVVDFQDQRTLDPRFARGVLKCDISDLSLICLLGYSMLLMVTCTVYAIKTRGVPETFNEAKPIGFTMYTTCIVWLAFIPIFFGTSQSADKLYIQTTTLTVSVSLSASVSLGMLYMPKVYIILFHPEQNVPKRKRSLKAVVTAATMSNKFTQKGNFRPNGEAKSELCENLEAPALATKQTYVTYTNHAI

SEQ ID NO: 194 - protein, 909 aa, Mus musculus
MSGKGGWAWWWARLPLCLLLSLYGSWVPSSLKAQGHPHMNSIRIDGDITLGGLFPVHGRGSEGKACGELKKEKGIHRLEAMLFALDRINNDPDLLPNITLGARILDTCSRDTHALEQSLTFVQALIEKDGTEVRCGSGGPPIITKPERVVGVIGASGSSVSIMVANILRLFKIPQISYASTAPDLSDNSRYFFSRVVPSDTYQAQAMVDIVRALKWNYVSTLASEGSYGESGVEAFIQKSRENGGVCIAQSVKIPREPKTGEFDKIIKRLLETSNARAIIIFANEDDIRRVLEAARRANQTGHFFWMGSDSWGSKSAPVLRLEEVAEGAVTILPKRTSVRGFDRYFSSRTLDNNRRNIWFAEFWEDNFHCKLSRHALKKGSHIKKCTNRERIGQDSAYEQEGKVQFVIDAVYAMGHALHAMHRDLCPGRVGLCPRMDPVDGTQLLKYIRNVNFSGIAGNPVTFNENGDAPGRYDIYQYQRRNGSAEYKVIGSWTDHLHLRIERMQWPGSGQLPRSICSLPCQPGERKKTVKGMACCWHCEPCTGYQYQVDRYTCKTCPYDMRPTENRTSCQPIPIVKLEWDSPWAVLPLFLAVVGIAATLFVVVTFVRYNDTPIVKASGRELSYVLLAGIFLCYATTFLMIAEPDLGTCSLRRIFLGLGMSISYAALLTKTNRIYRIFEQGKRSVSAPRFISPASQLAITFVLISLQLLGICVWFVVDPSHSVVDFQDQRTLDPRFARGVLKCDISDLSLICLLGYSMLLMVTCTVYAIKTRGVPETFNEAKPIGFTMYTTCIVWLAFIPIFFGTSQSADKLYIQTTTLTVSVSLSASVSLGMLYMPKVYIILFHPEQNVPKRKRSLKAVVTAATMSNKFTQKGNFRPNGEAKSELCENLEAPALATKQTYVTYTNHAI

SEQ ID NO: 195 - DNA, 2694 bp, Mus musculus
atgtccgggaagggaggctgggcctggtggtgggcccggctgcccctctgcctactcctcagcctttatggctcctgggtgccttcttccctaaaagcccaaggtcacccccacatgaactctatccgtatcgatggagacatcaccctgggaggcctgtttcccgtccacggtcgcggctccgagggcaaggcctgcggcgagttgaagaaggagaaaggtatccaccggctggaggccatgctctttgccctggaccgcatcaacaacgacccggacctactgcccaacatcacgttgggcgcccgcattctggacacctgctcaagggatacccacgccctggagcagtccctgacctttgtgcaggcgctcatcgagaaggacggcacggaggtccgctgcggcagcgggggcccacccatcatcaccaagcctgaacgagtggtgggtgtcatcggagcttcggggagctccgtctcgatcatggtggccaacatcctccgcctcttcaagatcccccagatcagctacgcctccacggctcccgacttgagtgataacagccgctacttcttctcccgggtcgtgccctcggacacataccaggcccaggccatggtggacatcgtccgggccctcaagtggaactatgtgtccacgctggcctcagagggtagctacggcgagagcggcgtggaggcctttatccagaagtcccgagagaacggaggcgtgtgcattgcccagtcggtgaagattccacgggaacccaagaccggggagtttgacaagatcatcaaacgccttctggaaacgtccaatgccagagccatcatcatctttgccaacgaggatgatatcaggagggtgctggaggcagcgcgcagggccaaccagaccggccacttcttttggatgggttctgatagctggggctccaagagcgcccccgtgctgcgccttgaggaagtggctgaaggtgcagtcaccattcttcccaagaggacgtctgtgcgagggtttgaccgatacttctccagccgcacgcttgacaacaacaggcgcaacatctggtttgctgagttctgggaggacaacttccattgcaagttgagccgccacgcgctcaagaagggaagccacatcaagaagtgcacagaccgagagcgcatcgggcaggactcggcctacgaacaggaggggaaggtgcagtttgtgatcgacgccgtgtacgccatgggccatgctctgcacgccatgcatcgtgacctgtgtcccggccgcgtaggactctgccctcgaatggaccctgtggatggcacccagctgcttaagtacatcagaaacgtcaacttctcaggcatcgccgggaacccggtgaccttcaacgagaacggagacgcgccagggcgttatgacatctaccagtaccaacgtcgcaacggctcggctgagtacaaggtcatcggctcatggacagaccacttgcacctcagactgccacgctccatctgcagcctgccctgccagccaggcgagcggaagaagacggtgaagggcatggcttgctgctggcactgcgagccctgcacggggtaccagtaccaggtggaccgctacacctgtaagacctgcccctatgacatgcggcccacggagaaccgcacgagctgccagcccatacccattgtcaagttggagtgggactcaccctgggctgtgctgcccctcttcctggctgtggtgggcattgctgccacgctgttcgtggtggtcacttttgtgcgctacaacgacactccgatcgtcaaggcctcgggccgggagctgagctacgtcctgctggcgggcatctttctctgctatgccaccaccttcctcatgatcgcagagcctgacctggggacctgttcactccgccgcatcttcctggggcttggcatgagcatcagctacgcggccctgctgaccaagaccaaccgcatctaccgcatctttgagcagggcaagcggtcggtcagcgccccacggttcatcagccccgcctcgcagctggccatcaccttcgtcctcatctcgctgcagttgcttggcatctgcgtgtggttcgtggtggacccctcccactcggtggtggacttccaggaccagcggacacttgacccccgcttcgcccggggtgtgctcaagtgtgacatctcggacctgtcgctcatctgcctcctgggctacagcatgctgctgatggtcacgtgtactgtgtatgccatcaagactcgaggcgtgcctgagaccttcaatgaggccaagcccatcggcttcaccatgtacaccacctgcatcgtctggctggccttcatccccatcttttttggcacctcgcagtcggctgacaagctgtacatccagacaaccacactgacggtctctgtgagtctgagcgcttcagtgtccctggggatgctctacatgcccaaagtctacatcatcctcttccacccggagcagaacgtgcccaagcgcaagcgcagcctcaaagccgttgtcaccgccgccaccatgtccaacaagttcacacagaagggcaacttcaggcctaatggggaagccaagtcagagctgtgtgagaacctggaggccccagcactggccaccaaacagacctacgtcacttacaccaaccatgcaatc

SEQ ID NO: 196 - protein, 1180 aa, Homo sapiens
MVLLLILSVLLLKEDVRGSAQSSERRVVAHMPGDIIIGALFSVHHQPTVDKVHERKCGAVREQYGIQRVEAMLHTLERINSDPTLLPNITLGCEIRDSCWHSAVALEQSIEFIRDSLISSEEEEGLVRCVDGSSSSFRSKKPIVGVIGPGSSSVAIQVQNLLQLFNIPQIAYSATSMDLSDKTLFKYFMRVVPSDAQQARAMVDIVKRYNWTYVSAVHTEGNYGESGMEAFKDMSAKEGICIAHSYKIYSNAGEQSFDKLLKKLTSHLPKARVVACFCEGMTVRGLLMAMRRLGLAGEFLLLGSDGWADRYDVTDGYQREAVGGITIKLQSPDVKWFDDYYLKLRPETNHRNPWFQEFWQHRFQCRLEGFPQENSKYNKTCNSSLTLKTHHVQDSKMGFVINAIYSMAYGLHNMQMSLCPGYAGLCDAMKPIDGRKLLESLMKTNFTGVSGDTILFDENGDSPGRYEIMNFKEMGKDYFDYINVGSWDNGELKMDDDEVWSKKSNIIRSVCSEPCEKGQIKVIRKGEVSCCWTCTPCKENEYVFDEYTCKACQLGSWPTDDLTGCDLIPVQYLRWGDPEPIAAVVFACLGLLATLFVTVVFIIYRDTPVVKSSSRELCYIILAGICLGYLCTFCLIAKPKQIYCYLQRIGIGLSPAMSYSALVTKTNRIARILAGSKKKICTKKPRFMSACAQLVIAFILICIQLGIIVALFIMEPPDIMHDYPSIREVYLICNTTNLGVVTPLGYNGLLILSCTFYAFKTRNVPANFNEAKYIAFTMYTTCIIWLAFVPIYFGSNYKIITMCFSVSLSATVALGCMFVPKVYIILAKPERNVRSAFTTSTVVRMHVGDGKSSSAASRSSSLVNLWKRRGSSGETLSSNGKSVTWAQNEKSSRGQHLWQRLSIHINKKENPNQTAVIKPFPKSTESRGLGAGAGAGGSAGGVGATGGAGCAGAGPGGPESPDAGPKALYDVAEAEEHFPAPARPRSPSPISTLSHRAGSASRTDDDVPSLHSEPVARSSSSQGSLMEQISSVVTRFTANISELNSMMLSTAAPSPGVGAPLCSSYLIPKEIQLPTTMTTFAEIQPLPAIEVTGGAQPAAGAQAAGDAARESPAAGPEAAAAKPDLEELVALTPPSPFRDSVDSGSTTPNSPVSESALCIPSSPKYDTLIIRDYTQSSSSL

SEQ ID NO: 197 - protein, 1006 aa, Mus musculus
MVLLLILSVLLLKEDVRGSAQSSERRVVAHMPGDIIIGALFSVHHQPTVDKVHERKCGAVREQYGIQRVEAMLHTLERINSDPTLLPNITLGCEIRDSCWHSAVALEQSIEFIRDSLISSEEEEGLVRCVDGSSSFRSKKPIVGVIGPGSSSVAIQVQNLLQLFNIPQIAYSATSMDLSDKTLFKYFMRVVPSDAQQARAMVDIVKRYNWTYVSAVHTEGNYGESGMEAFKDMSAKEGICIAHSYKIYSNAGEQSFDKLLKKLRSHLPKARVVACFCEGMTVRGLLMAMRRLGLAGEFLLLGSDGWADRYDVTDGYQREAVGGITIKLQSPDVKWFDDYYLKLRPETNLRNPWFQEFWQHRFQCRLEGFAQENSKYNKTCNSSLTLRTHHVQDSKMGFVINAIYSMAYGLHNMQMSLCPGYAGLCDAMKPIDGRKLLDSLMKTNFTGVSGDMILFDENGDSPGRYEIMNFKEMGKDYFDYINVGSWDNGELKMDDDEVWSKKNNIIRSVCSEPCEKGQIKVIRKGEVSCCWTCTPCKENEYVFDEYTCKACQLGSWPTDDLTGCDLIPVQYLRWGDPEPIAAVVFACLGLLATLFVTVIFIIYRDTPVVKSSSRELCYIILAGICLGYLCTFCLIAKPKQIYCYLQRIGIGLSPAMSYSALVTKTNRIARILAGSKKKICTKKPRFMSACAQLVIAFILICIQLGIIVALFIMEPPDIMHDYPSIREVYLICNTTNLGVVTPLGYNGLLILSCTFYAFKTRNVPANFNEAKYIAFTMYTTCIIWLAFVPIYFGSNYKIITMCFSVSLSATVALGCMFVPKVYIILAKPERNVRSAFTTSTVVRMHVGDGKSSSAASRSSSLVNLWKRRGSSGETLRYKDRRLAQHKSEIECFTPKGSMGNGGRATMSSSNGKSVTWAQNEKSTRGQHLWQRLSVHINKKENPNQTAVIKPFPKSTESRGQGAGAGGGSGPGAAGAGSAGCTATGGPEPPDAGPKALYDVAEAEERF

SEQ ID NO: 198 - DNA, 3018 bp, Mus musculus
atggtccttctgttgattctgtcagtcctacttctgaaagaagatgtacgaggaagtgcacagtccagtgagaggagggtggtggctcacatgccaggtgacattattattggagctctcttctcggtccaccaccaaccaactgtggacaaagttcatgagaggaagtgtggggcagtccgtgagcagtatggcattcagagagtggaagccatgctgcataccttggaaaggatcaattcagatcccacactcttgcccaacatcacactaggctgtgagataagagattcctgctggcattctgctgtggccctagagcaaagcattgagtttataagggattccctcatctcttcggaagaggaagaaggcttggtacgctgtgtagatggctcttcttccttccgctccaagaaacccatagtgggagtcattgggcctggctcgagttctgtggccattcaagttcagaacttgctccagcttttcaacatacctcagattgcttactctgcaactagcatggatttgagtgacaagactctattcaagtacttcatgagggttgtaccttcggatgcccagcaagcccgagccatggtagacatagtgaagagatacaactggacttatgtctcagctgtgcacacagaaggtatgtgatatggagaaagtgggatggaggctttcaaagatatgtcagcgaaggaagggatttgcatcgcccactcttacaaaatctacagcaatgctggggaacagagctttgacaagctgttgaaaaagctcagaagtcatttacctaaagcccgggtggtagcctgcttctgtgaaggcatgacagttcgaggtctgctcatggccatgagacgcttgggtctagcaggggaatttctacttctgggcagtgatggctgggctgacaggtatgacgtgacagatgggtatcagcgagaagctgtcggtgggattacaatcaagctccagtctcctgatgtcaagtggtttgatgattattatctgaagctccggccagaaacaaacctcagaaacccttggtttcaagaattttggcagcatcgttttcagtgccggctagaagggtttgcacaggagaacagcaagtacaacaagacttgcaactctctaactctgagaacgcatcatgttcaagattccaaaatgggatttgtgatcaatgcaatctattctatggcttatgggctccacaacatgcagatgtccctgtgtccaggctatgcaggcctctgtgatgcaatgaagccaattgatgggcggaaacttttggactccctgatgaaaaccaactttactggagtttccggagatatgattctatttgatgaaaatggagactctccaggaaggtatgaaataatgaatttcaaggaaatgggaaaagattattttgattacatcaatgttggaagttgggacaatggggaattaaaaatggatgatgatgaagtgtggtccaagaaaaataacatcatcagatctgtgtgcagtgaaccgtgtgagaaaggacagataaaggtgatccggaagggagaagtcagctgttgttggacctgcacaccttgtaaggagaatgagtatgtttttgatgagtacacctgcaaggcgtgccaactggggtcctggcccactgacgacttgacaggttgtgatttgatcccagtccagtatcttcgatggggtgaccctgagcccattgcagctgtggtgtttgcctgcctcggtctgctagccaccctcttcgttactgtaatcttcatcatttatcgggacactccagtggtcaagtcttccagcagggaactctgctacattatccttgctggcatctgcctgggttacttgtgtaccttctgcctcattgcaaagcccaaacagatttactgctaccttcagagaattggcatcggtctctctccagccatgagctactcagcccttgtaacgaagaccaaccgtattgcaaggattctagctggcagcaagaagaagatctgtaccaaaaagcccagattcatgagcgcctgtgctcagttagtgatcgctttcattctcatctgtatacagttgggtattattgtggccctctttatcatggagcctccggatataatgcatgactatccaagcatccgagaagtctacttgatttgtaacaccaccaacctaggggttgtcactcctcttggatacaatggattattgattttgagttgcacattctatgcgttcaagaccagaaatgttccagccaactttaacgaggccaaatatattgctttcaccatgtacacaacctgcatcatatggctggcctttgtgcctatctactttggcagcaactacaaaatcatcaccatgtgtttctcagtcagcctcagtgccacagtggccctgggttgcatgtttgtgccgaaggtgtacatcatcctagccaaaccggagagaaatgtgcgcagcgccttcacaacctctacagtggtgcgcatgcacgtaggagatggcaagtcatcatccgctgccagcagatccagcagcctagtcaacctgtggaagaggaggggctcgtctggggaaaccctaaggtacaaagacaggagactggcccagcacaagtcggaaatagagtgtttcacccccaaagggagtatggggaatggtgggagagcaacaatgagcagctccaatggaaaatccgtgacttgggcccagaatgagaagagcacccgggggcagcacctgtggcagcgactgtctgtccatatcaacaagaaggagaaccccaaccagacagcagtcatcaaacccttccccaagagcacagagagccgcgggcagggtgcaggggcaggtggtggctctggccccggtgcagctggtgctggtagcgcaggatgcacagcgacaggcggcccagagccaccagacgccggccccaaggcgctttatgatgtcgcagaggcagaggagcgcttc

SEQ ID NO: 199 - protein, 877 aa, Homo sapiens
MARPRRAREPLLVALLPLAWLAQAGLARAAGSVRLAGGLTLGGLFPVHARGAAGRACGPLKKEQGVHRLEAMLYALDRVNADPELLPGVRLGARLLDTCSRDTYALEQALSFVQALIRGRGDGDEVGVRCPGGVPPLRPAPPERVVAVVGASASSVSIMVANVLRLFAIPQISYASTAPELSDSTRYDFFSRVVPPDSYQAQAMVDIVRALGWNYVSTLASEGNYGESGVEAFVQISREAGGVCIAQSIKIPREPKPGEFSKVIRRLMETPNARGIIIFANEDDIRRVLEAARQANLTGHFLWVGSDSWGAKTSPILSLEDVAVGAITILPKRASIDGFDQYFMTRSLENNRRNIWFAEFWEENFNCKLTSSGTQSDDSTRKCTGEERIGRDSTYEQEGKVQFVIDAVYAIAHALHSMHQALCPGHTGLCPAMEPTDGRMLLQYIRAVRFNGSAGTPVMFNENGDAPGRYDIFQYQATNGSASSGGYQAVGQWAETLRLDVEALQWSGDPHEVPSSLCSLPCGPGERKKMVKGVPCCWHCEACDGYRFQVDEFTCEACPGDMRPTPNHTGCRPTPVVRLSWSSPWAAPPLLLAVLGIVATTTVVATFVRYNNTPIVRASGRELSYVLLTGIFLIYAITFLMVAEPGAAVCAARRLFLGLGTTLSYSALLTKTNRIYRIFEQGKRSVTPPPFISPTSQLVITFSLTSLQVVGMIAWLGARPPHSVIDYEEQRTVDPEQARGVLKCDMSDLSLIGCLGYSLLLMVTCTVYAIKARGVPETFNEAKPIGFTMYTTCIIWLAFVPIFFGTAQSAEKIYIQTTTLTVSLSLSASVSLGMLYVPKTYVILFHPEQNVQKRKRSLKATSTVAAPPKGEDAEAHK

SEQ ID NO: 200 - protein, 871 aa, Mus musculus
MGRLRVLLLWLAWWLSQAGIAHGAGSVRLAGGLTLGGLFPVHARGAAGRACGTLKKEQGVHRLEAMLYALDRINADPELLPGVRLGARLLDTCSRDTYALEQALSFVQALIRGRGDGEEASVRCPGGVPPLRAAPPERVVAVVGASASSVSIMVANVLRLFAIPQISYASTAPELSDSTRYDFFSRVVPPDSYQAQAMVDIVRALGWNYVSTLASEGNYGESGVEAFVQISREAGGVCIAQSIKIPREPKPGEFHKVIRRLMETPNARGIIIFANEDDIRRVLEATRQANLTGHFLWVGSDSWGSKISPILNLEEEAVGAITILPKRASIDGFDQYFMTRSLENNRRNIWFAEFWEENFNCKLTSSGGQSDDSTRKCTGEERIGQDSTYEQEGKVQFVIDAVYAIAHALHSMHQALCPGHTGLCPAMEPTDGRTLLHYIRAVRFNGSAGTPVMFNENGDAPGRYDIFQYQATNGSASSGGYQAVGQWAEALRLDMEALQWSGDPHEVPPSQCSLPCGPGERKKMVKGVPCCWHCEACDGYRFQVDEFTCEACPGHMRPTPNHTGCRPTPVVRLTWSSPWAALPLLLAVLGIMATTTIIATFMRHNDTPIVRASGRELSYVLLTGIFLIYAITFLMVAEPCAAVCASRRLLLGLGTTLSYSALLTKTNRIYRIFEQGKRSVTPPPFISPTSQLVITFGLTSLQVVGVIAWLGAQPPHSVIDYEEQRTVDPEQARGVLKCDMSDLSLIGCLGYSLLLMVTCTVYAIKARGVPETFNEAKPIGFTMYTTCIIWLAFVPIFFGTAQSAEKMYIQTTTLTVSLSLSASVSLGMLYVPKTYVILFHPEQNVQKRKRSLKKTSTMAAPPKSENSEDAK

SEQ ID NO: 201 - DNA, 2613 bp, Mus musculus
atggggcggctccgagtgctgctgctgtggctagcctggtggctgtcgcaggcgggcatagctcacggtgcgggctcggtgcgcctggcaggcggcctgacgctgggcggcctcttcccggtgcacgcccggggcgccgcagggcgtgcgtgcgggacgctgaagaaggagcagggagtgcaccggctggaggcgatgctctacgcgctggaccgcatcaacgccgacccggagctcctgcccggtgtgcgactaggcgcgcggctgctcgacacctgctcgcgggacacctacgctctggagcaggcgctgagcttcgtgcaggcgctcatccgaggccgcggagacggcgaagaggccagcgtgcgctgccctgggggcgtccccccgctgcgcgccgcgcctcctgaacgcgtcgtggcggtggtgggcgcctcagctagctccgtgtccatcatggtcgccaatgtcttgcgcctgtttgcgataccccagatcagctatgcctccacagccccagagctcagtgactccacacgctatgacttcttctcccgagtggtgcctcctgactcctaccaggcgcaggccatggtggacattgtgcgggcactgggatggaattacgtgtctacactggcctctgagggcaactatggtgaaagcggggttgaggcctttgtgcagatctcccgtgaggctggaggtgtctgtattgcccaatcaataaagattcccagggaaccaaagccaggagaattccacaaagtgatccggaggctcatggagacacccaacgcccggggcatcatcatctttgccaatgaagatgacatcaggagggtcttggaggcaacacgccaggcaaacctgactggccacttcctgtgggttggctcagacagctggggatccaagatctctcccatcttgaacctagaggaagaggctgtgggggccatcaccatcttgcccaaaagggcttcaatcgacggatttgaccaatactttatgactcgttccctggagaacaaccgcagaaacatctggtttgctgagttctgggaagagaattttaactgcaaactaaccagctcaggtggccagtcagatgattccacccggaaatgcacaggcgaggaacgcatcggccaggactccacctatgaacaggaggggaaggtgcagttcgtgatagatgctgtgtatgccatcgctcatgctctgcacagcatgcaccaagcactctgcccaggccacacaggtctgtgcccagccatggagcctactgatggccggaccctgctgcactacatccgagcagtccgcttcaatggtagcgcaggaaccccagtgatgttcaatgagaatggggatgcccccgggcgctatgacatcttccagtaccaagcaaccaatggaagtgccagcagtggcgggtaccaggctgtgggccaatgggcagaggcccttagactggatatggaagctctacagtggtcaggcgacccccatgaggtgcccccttctcaatgcagcctcccctgtgggcctggtgaacggaaaaagatggtgaagggtgtgccctgctgttggcactgtgaggcctgcgacgggtaccgcttccaggtggacgagttcacgtgtgaggcctgtccagggcacatgagaccgacacccaaccacactggctgccgtcccactcccgtggtgcgcctgacctggtcctctccgtgggccgctctgccccttctcctggctgtcctgggcatcatggccaccacaactatcattgctaccttcatgcgacacaacgacactcccatagtccgcgcctctggccgtgagcttagctatgtgctgctcaccggcatcttcctgatctacgccatcaccttcctcatggtagccgagccttgtgcagccgtctgtgcttcccgaagactcttgctcggcttgggtaccacgctcagctactctgccctgctcaccaagaccaaccgcatctaccgcattttcgagcaagggaagcgctctgtcacgccgccacccttcatcagccccacctcgcagctagtcatcaccttcggccttacctccctgcaggtagtgggagtgatagcgtggttgggggcccaacctccacacagcgtgattgactatgaggaacagaggacggtggaccctgagcaagccaggggtgtgctcaagtgtgacatgtctgatctgtccctcattggctgcctggggtacagtctcctgctcatggtcacgtgtacggtgtatgccatcaaggcccgaggtgtgccagagaccttcaatgaagccaagcccatcggcttcaccatgtacaccacctgtattatctggctggctttcgtccccatcttctttggcaccgcccagtcagctgagaagatgtacatccaaacgaccacactgactgtgtccctgagcctgagcgcgtcggtgtccctcggcatgctctatgtgcccaaaacctacgtcatcctgttccatccagagcagaacgtgcagaagcggaagcgcagcctcaagaagacctccacgatggcggccccgcccaagagcgagaactcagaggacgccaag

SEQ ID NO: 202 - protein, 915 aa, Homo sapiens
MVQLRKLLRVLTLMKFPCCVLEVLLCALAAAARGQEMYAPHSIRIEGDVTLGGLFPVHAKGPSGVPCGDIKRENGIHRLEAMLYALDQINSDPNLLPNVTLGARILDTCSRDTYALEQSLTFVQALIQKDTSDVRCTNGEPPVFVKPEKVVGVIGASGSSVSIMVANILRLFQIPQISYASTAPELSDDRRYDFFSRVVPPDSFQAQAMVDIVKALGWNYVSTLASEGSYGEKGVESFTQISKEAGGLCIAQSVRIPQERKDRTIDFDRIIKQLLDTPNSRAVVIFANDEDIKQILAAAKRADQVGHFLWVGSDSWGSKINPLHQHEDIAEGAITIQPKRATVEGFDAYFTSRTLENNRRNVWFAEYWEENFNCKLTISGSKKEDTDRKCTGQERIGKDSNYEQEGKVQFVIDAVYAMAHALHHMNKDLCADYRGVCPEMEQAGGKKLLKYIRNVNFNGSAGTPVMFNKNGDAPGRYDIFQYQTTNTSNPGYRLIGQWTDELQLNIEDMQWGKGVREIPASVCTLPCKPGQRKKTQKGTPCCWTCEPCDGYQYQFDEMTCQHCPYDQRPNENRTGCQDIPIIKLEWHSPWAVIPVFLAMLGIIATIFVMATFIRYNDTPIVRASGRELSYVLLTGIFLCYIITFLMIAKPDVAVCSFRRVFLGLGMCISYAALLTKTNRIYRIFEQGKKSVTAPRLISPTSQLAITSSLISVQLLGVFIWFGVDPPNIIIDYDEHKTMNPEQARGVLKCDITDLQIICSLGYSILLMVTCTVYAIKTRGVPENFNEAKPIGFTMYTTCIVWLAFIPIFFGTAQSAEKLYIQTTTLTISMNLSASVALGMLYMPKVYIIIFHPELNVQKRKRSFKAVVTAATMSSRLSHKPSDRPNGEAKTELCENVDPNSPAAKKKYVSYNNLVI

SEQ ID NO: 203 - protein, 915 aa, Mus musculus
MVQLGKLLRVLTLMKFPCCVLEVLLCVLAAAARGQEMYAPHSIRIEGDVTLGGLFPVHAKGPSGVPCGDIKRENGIHRLEAMLYALDQINSDPNLLPNVTLGARILDTCSRDTYALEQSLTFVQALIQKDTSDVRCTNGEPPVFVKPEKVVGVIGASGSSVSIMVANILRLFQIPQISYASTAPELSDDRRYDFFSRVVPPDSFQAQAMVDIVKALGWNYVSTLASEGSYGEKGVESFTQISKEAGGLCIAQSVRIPQERKDRTIDFDRIIKQLLDTPNSRAVVIFANDEDIKQILAAAKRADQVGHFLWVGSDSWGSKINPLHQHEDIAEGAITIQPKRATVEGFDAYFTSRTLENNRRNVWFAEYWEENFNCKLTISGSKKEDTDRKCTGQERIGKDSNYEQEGKVQFVIDAVYAMAHALHHMNKDLCADYRGVCPEMEQAGGKKLLKYIRNVNFNGSAGTPVMFNKNGDAPGRYDIFQYQTTNTTNPGYRLIGQWTDELQLNIEDMQWGKGVREIPPSVCTLPCKPGQRKKTQKGTPCCWTCEPCDGYQYQFDEMTCQHCPYDQRPNENRTGCQNIPIIKLEWHSPWAVIPVFLAMLGIIATIFVMATFIRYNDTPIVRASGRELSYVLLTGIFLCYIITFLMIAKPDVAVCSFRRVFLGLGMCISYAALLTKTNRIYRIFEQGKKSVTAPRLISPTSQLAITSSLISVQLLGVFIWFGVDPPNIIIDYDEHKTMNPEQARGVLKCDITDLQIICSLGYSILLMVTCTVYAIKTRGVPENFNEAKPIGFTMYTTCIVWLAFIPIFFGTAQSAEKLYIQTTTLTISMNLSASVALGMLYMPKVYIIIFHPELNVQKRKRSFKAVVTAATMSSRLSHKPSDRPNGEAKTELCENVDPNSPAAKKKYVSYNNLVI

SEQ ID NO: 204 - DNA, 2745 bp, Mus musculus
atggtccagctggggaagctgctccgcgtcctgactttgatgaagttcccctgctgcgtgctggaggtgctcctgtgcgtgctggcggcggcggcgcgcggccaggagatgtacgccccgcactcgatccggatcgagggggacgtcacccttggggggctgttcccagtgcacgccaagggtcccagcggagtgccctgcggcgacatcaagagggagaatgggatccacaggctggaagctatgctttatgctctcgaccagatcaacagcgatcccaacctgctgcccaacgtaacgttaggcgcgcggatcctggacacttgttccagggacacttatgcgctcgaacagtcgctcactttcgtccaggcgcttatccagaaggacacctccgacgtgcgttgcaccaacggagagcccccggttttcgtcaagccagagaaagtagttggagtgattggggcttcggggagctccgtctccatcatggtagccaacatcttgaggctttttcagatacctcagattagttatgcatccacggctcctgaactcagtgatgaccgtcgctatgacttcttctctcgcgtggtcccacctgattccttccaagcccaagctatggtagacattgtaaaggcattgggctggaattatgtatctactcttgcatctgaaggaagctatggagagaaaggtgtggagtccttcacacaaatttccaaagaagcaggtggactctgcattgcccagtccgtgagaattccccaagaacgcaaagacaggaccattgactttgatagaattatcaaacagctcttggacacccccaactccagggctgtcgtgatttttgccaacgatgaggatataaagcagatccttgcagcagccaaaagagctgaccaagtaggacattttctctgggttgggtcagacagctggggttccaaaatcaacccactgcatcagcatgaagatattgcagaaggagccatcaccatccaacctaagagagcgactgtggaaggatttgatgcttacttcacatcccggacacttgaaaacaacaggagaaatgtatggtttgccgaatactgggaagaaaacttcaactgcaagttgacaattagtggatccaaaaaagaagacacggatcgcaaatgcacaggacaggagcgaattggaaaagactctaattatgagcaggagggtaaagtacagtttgtgatcgatgctgtctatgccatggcacatgcccttcatcacatgaataaggatctgtgtgctgactaccggggagtgtgcccagaaatggagcaagcagggggcaagaagttgttgaagtatatccgcaatgttaacttcaatggtagtgctggaaccccagtgatgtttaacaaaaatggtgatgctccaggacgatatgacatcttccagtaccagacaacaaacactaccaatcctggttatcgtctcattgggcagtggacagatgaactgcagctcaatatagaggacatgcagtggggcaaaggagtccgggagatcccaccctctgtgtgcacattgccatgcaagcctgggcagaggaagaagacacagaagggaaccccttgctgctggacttgtgagccctgtgatggataccagtatcaatttgatgagatgacatgtcagcattgtccctatgaccagaggcccaatgagaaccgaactggctgtcagaacatcccaatcatcaaactggagtggcactccccctgggctgtaattcctgtcttcctggcaatgttggggatcattgccaccatctttgtcatggcaaccttcatccgctacaatgatacacccatcgtcagggcatctgggcgggaactcagctatgttttattgacaggcatctttctctgctatatcatcaccttcctaatgattgccaagccagatgtggcagtgtgttccttccgacgtgtcttcttggggttgggtatgtgtattagttatgcagcccttttaacaaaaaccaatcggatttatcgcatattcgagcagggcaagaaatcggtgacagctcccagactcataagcccaacatcacaactggcaattacctccagtttaatatcggtgcaacttctaggtgtctttatttggtttggggttgacccacccaacatcatcatagactacgatgagcataagacaatgaacccagaacaagccaggggagttctcaaatgtgacatcacagaccttcagatcatttgttctttgggatatagcattcttctcatggtcacatgtactgtgtatgccatcaagactcggggtgtaccagagaattttaatgaagccaagcccattggattcactatgtacacgacttgtatcgtatggcttgccttcatcccaatattttttggcacagcgcaatcagcagaaaagctctacatacaaaccaccacgcttacaatctccatgaacctaagtgcatcagtggcgctggggatgctatacatgccgaaagtgtacatcatcattttccaccctgaactcaatgtccagaaacggaagcgaagcttcaaggccgtagtcacagcagccaccatgtcatcgaggctgtcacacaaacccagtgacaggcccaatggtgaggcaaagacagaactttgtgaaaatgtagacccaaacagtcctgctgcaaaaaagaagtatgtcagttataataacctggttatc

SEQ ID NO: 205 - protein, 425 aa, Homo sapiens
MEPSATPGAQMGVPPGSREPSPVPPDYEDEFLRYLWRDYLYPKQYEWVLIAAYVAVFVVALVGNTLVCLAVWRNHHMRTVTNYFIVNLSLADVLVTAICLPASLLVDITESWLFGHALCKVIPYLQAVSVSVAVLTLSFIALDRWYAICHPLLFKSTARRARGSILGIWAVSLAIMVPQAAVMECSSVLPELANRTRLFSVCDERWADDLYPKIYHSCFFIVTYLAPLGLMAMAYFQIFRKLWGRQIPGTTSALVRNWKRPSDQLGDLEQGLSGEPQPRGRAFLAEVKQMRARRKTAKMLMVVLLVFALCYLPISVLNVLKRVFGMFRQASDREAVYACFTFSHWLVYANSAANPIIYNFLSGKFREQFKAAFSCCLPGLGPCGSLKAPSPRSSASHKSLSLQSRCSISKISEHVVLTSVTTVLP

SEQ ID NO: 206 - protein, 416 aa, Mus musculus
MEPSATPGAQPGVPTSSGEPFHLPPDYEDEFLRYLWRDYLYPKQYEWVLIAAYVAVFLIALVGNTLVCLAVWRNHHMRTVTNYFIVNLSLADVLVTAICLPASLLVDITESWLFGQALCKVIPYLQAVSVSVAVLTLSFIALDRWYAICHPLLFKSTARRARGSILGIWAVSLAVMVPQAAVMECSSVLPELANRTRLFSVCDEHWADELYPKIYHSCFFIVTYLAPLGLMAMAYFQIFRKLWGRQIPGTTSALVRNWKRPSEQLEAQHQGLCTEPQPRARAFLAEVKQMRARRKTAKMLMVVLLVFALCYLPISVLNVLKRVFGMFRQASDREAVYACFTFSHWLVYANSAANPIIYNFLSGKFREQFKAAFSCCLPGLGPGSSARHKSLSLQSRCSVSKVSEHVVLTTVTTVLS

SEQ ID NO: 207 - DNA, 1248 bp, Mus musculus
atggaaccctcggccactcctggggcccagcctggagtccccactagtagtggggaacccttccatctgcctccagactatgaggacgagttcctccgatacctgtggcgcgattatctctacccgaagcagtacgagtgggttctcattgcagcctacgtggctgtgttcctcatagccttggtgggcaataccctggtctgcctggctgtgtggcggaaccaccacatgaggacagtcaccaactacttcattgtcaacctgtccctggcagatgtgctggtgactgccatctgcctgcctgccagcctgttagtggacatcaccgagtcgtggctcttcggccaggctttgtgcaaggtcattccctatctccaggctgtgtcggtgtcagtggcagtgctgactctcagcttcatcgccctggaccgctggtatgccatctgccacccactgttgttcaagagcacagctcgccgtgcccgtggctccatcctgggcatctgggctgtgtcgctggctgtcatggtgccccaggctgctgtcatggagtgcagcagcgtgctgcctgagctagccaatcgcacccggctcttctctgtctgtgatgagcactgggcagatgaactctaccccaagatctatcacagctgctttttcattgtcacctacctggccccactgggcctcatggctatggcctatttccagatcttccgcaagctctggggccgccagatccctggtaccacatcagccttggtgcggaactggaaacggccctcggaacaactggaggctcagcaccagggcctctgtacagagccccagccccgggcccgagccttcctggctgaggtgaagcagatgcgagctcggaggaagacggctaagatgctgatggtagtcctgctggtttttgcactctgttatctgcccatcagtgtcctcaatgtccttaagagagtgttcgggatgttccgccaagccagcgaccgggaagccgtctacgcctgcttcaccttctcccactggctagtgtacgccaacagtgccgccaaccctatcatctacaacttcctcagtggcaaattccgggagcagttcaaggctgccttctcctgctgcctgcctggtctgggtcccggctcctctgccagacacaagtccttgtccttgcagagccgctgctccgtctccaaggtctctgagcatgtcgtgctgaccaccgtcactaccgtgctgtcc

SEQ ID NO: 208 - protein, 444 aa, Homo sapiens
MSGTKLEDSPPCRNWSSASELNETQEPFLNPTDYDDEEFLRYLWREYLHPKEYEWVLIAGYIIVFVVALIGNVLVCVAVWKNHHMRTVTNYFIVNLSLADVLVTITCLPATLVVDITETWFFGQSLCKVIPYLQTVSVSVSVLTLSCIALDRWYAICHPLMFKSTAKRARNSIVIIWIVSCIIMIPQAIVMECSTVFPGLANKTTLFTVCDERWGGEIYPKMYHICFFLVTYMAPLCLMVLAYLQIFRKLWCRQIPGTSSVVQRKWKPLQPVSQPRGPGQPTKSRMSAVAAEIKQIRARRKTARMLMVVLLVFAICYLPISILNVLKRVFGMFAHTEDRETVYAWFTFSHWLVYANSAANPIIYNFLSGKFREEFKAAFSCCCLGVHHRQEDRLTRGRTSTESRKSLTTQISNFDNISKLSEQVVLTSISTLPAANGAGPLQNW

SEQ ID NO: 209 - protein, 443 aa, Mus musculus
MSSTKLEDSLSRRNWSSASELNETQEPFLNPTDYDDEEFLRYLWREYLHPKEYEWVLIAGYIIVFVVALIGNVLVCVAVWKNHHMRTVTNYFIVNLSLADVLVTITCLPATLVVDITETWFFGQSLCKVIPYLQTVSVSVSVLTLSCIALDRWYAICHPLMFKSTAKRARNSIVVIWIVSCIIMIPQAIVMECSSMLPGLANKTTLFTVCDEHWGGEVYPKMYHICFFLVTYMAPLCLMILAYLQIFRKLWCRQIPGTSSVVQRKWKQQQPVSQPRGSGQQSKARISAVAAEIKQIRARRKTARMLMVVLLVFAICYLPISILNVLKRVFGMFTHTEDRETVYAWFTFSHWLVYANSAANPIIYNFLSGKFREEFKAAFSCCLGVHHRQGDRLARGRTSTESRKSLTTQISNFDNVSKLSEHVVLTSISTLPAANGAGPLQNW

SEQ ID NO: 210 - DNA, 1329 bp, Mus musculus
atgtccagcaccaaactggaggattccctctctcgtcgcaactggtcatctgcttcagagctgaatgaaactcaagagccgtttttaaatcccacggactatgacgacgaggaattcctgcggtacctgtggagggaatacctacacccgaaagaatatgagtgggtcctgatcgcagggtatatcatcgtgttcgttgtggctctcatcgggaacgtcctggtctgtgtggcagtgtggaagaaccaccacatgaggacagtcaccaactacttcatagtcaacctttccctagcagatgtgcttgtgaccatcacctgccttccagctaccctcgttgttgacatcactgagacttggttctttggacagtccctctgtaaggtcattccttatttacagactgtgtcagtgtctgtgtctgttcttacgttgagctgcattgccttggaccgatggtacgccatttgtcaccctttgatgttcaagagcacagccaaacgggctcgaaacagcatcgttgtcatctggatcgtctcctgcatcataatgattcctcaagccattgtcatggagtgcagcagcatgctccctggcctagccaataagaccaccctctttacagtatgtgatgaacactggggcggtgaagtttacccaaagatgtaccatatctgcttctttctggtgacatacatggcacctctgtgtcttatgatattggcttatctccaaatattccgtaaactctggtgccgacagattcccggaacttcttctgtggttcagagaaaatggaagcagcagcagccggtttctcagccccgggggtccggacagcagagcaaggctcggattagcgctgttgctgctgagataaagcagatccgagcacgaaggaaaacagcccggatgctcatggttgtacttctggtctttgcaatttgctatctaccaatcagcatcctcaatgtgctaaagagagtatttgggatgttcacacacacggaagacagagagactgtctatgcttggttcactttttctcattggcttgtatatgccaacagtgctgcaaacccaattatttataattttcttagtggaaaatttcgagaggaatttaaagctgccttttcttgttgtcttggggttcatcatcgccaaggagaccgcctcgccaggggacgcacgagcacagagagcaggaagtccctgaccacacagatcagcaactttgacaatgtatcaaaactctcagagcacgtggtgctcaccagcataagcacactcccagcagccaacggggcaggaccgcttcaaaactgg

SEQ ID NO: 211 - protein, 1346 aa, Homo sapiens
MKSPRRTTLCLMFIVIYSSKAALNWNYESTIHPLSLHEHEPAGEEALRQKRAVATKSPTAEEYTVNIEISFENASFLDPIKAYLNSLSFPIHGNNTDQITDILSINVTTVCRPAGNEIWCSCETGYGWPRERCLHNLICQERDVFLPGHHCSCLKELPPNGPFCLLQEDVTLNMRVRLNVGFQEDLMNTSSALYRSYKTDLETAFRKGYGILPGFKGVTVTGFKSGSVVVTYEVKTTPPSLELIHKANEQVVQSLNQTYKMDYNSFQAVTINESNFFVTPEIIFEGDTVSLVCEKEVLSSNVSWRYEEQQLEIQNSSRFSIYTALFNNMTSVSKLTIHNITPGDAGEYVCKLILDIFEYECKKKIDVMPIQILANEEMKVMCDNNPVSLNCCSQGNVNWSKVEWKQEGKINIPGTPETDIDSSCSRYTLKADGTQCPSGSSGTTVIYTCEFISAYGARGSANIKVTFISVANLTITPDPISVSEGQNFSIKCISDVSNYDEVYWNTSAGIKIYQRFYTTRRYLDGAESVLTVKTSTREWNGTYHCIFRYKNSYSIATKDVIVHPLPLKLNIMVDPLEATVSCSGSHHIKCCIEEDGDYKVTFHTGSSSLPAAKEVNKKQVCYKHNFNASSVSWCSKTVDVCCHFTNAANNSVWSPSMKLNLVPGENITCQDPVIGVGEPGKVIQKLCRFSNVPSSPESPIGGTITYKCVGSQWEEKRNDCISAPINSLLQMAKALIKSPSQDEMLPTYLKDLSISIDKAEHEISSSPGSLGAIINILDLLSTVPTQVNSEMMTHVLSTVNVILGKPVLNTWKVLQQQWTNQSSQLLHSVERFSQALQSGDSPPLSFSQTNVQMSSMVIKSSHPETYQQRFVFPYFDLWGNVVIDKSYLENLQSDSSIVTMAFPTLQAILAQDIQENNFAESLVMTTTVSHNTTMPFRISMTFKNNSPSGGETKCVFWNFRLANNTGGWDSSGCYVEEGDGDNVTCICDHLTSFSILMSPDSPDPSSLLGILLDIISYVGVGFSILSLAACLVVEAVVWKSVTKNRTSYMRHTCIVNIAASLLVANTWFIVVAAIQDNRYILCKTACVAATFFIHFFYLSVFFWMLTLGLMLFYRLVFILHETSRSTQKAIAFCLGYGCPLAISVITLGATQPREVYTRKNVCWLNWEDTKALLAFAIPALIIVVVNITITIVVITKILRPSIGDKPCKQEKSSLFQISKSIGVLTPLLGLTWGFGLTTVFPGTNLVFHIIFAILNVFQGLFILLFGCLWDLKVQEALLNKFSLSRWSSQHSKSTSLGSSTPVFSMSSPISRRFNNLFGKTGTYNVSTPEATSSSLENSSSASSLLN

SEQ ID NO: 212 - protein, 1348 aa, Mus musculus
MRSPRTFTFYFLLLVICSSEAALSTPTEPIVQPSILQEHELAGEELLRPKRAAAAGDRVAEEYMVDIEISFENVSFLESIRAHLNNLSFPIRGTEADILNIAMTTVCTPAGNDLLCFCEKGYQWSEERCLHSLTCQDYDSALPGGYCSCLKGLPPQGPFCQLPEAFITLKLKVRLNIGFQEDLKNTSSALYRSYKTDLERAFRAGYRTLPGFRSVTVTQFTKGSVVVNYVVRVTSAPLPGSIHKANEQVIQNLNHTYKMDYNSFQGTPSNETKFTVIPEFIFEGDNVTLECETEFVTSNTSWYYGEKRSDIQNSDKYSIHTTVINNISLITRLTIYNFTQHDAGMYGCNVTLDIFEYGTVRKLDVTPIRILAKEERKVVCDNHPISLNCCSENIANWSSIEWKQEGKISILGNPESDLESSCSTYTLKADGTQCPSGSSGTTVIYTCEFVSAYGARGSKNIAVTFTSVANLTITRDPISVSEGQSFSITCLSDVSSFDEVYWNTSAGIKIHPRFYTMRRYQDGAESVLMVKTSTREWNGTYHCIFRYKNSYSIATKDVTVHPLPLVSDIMMDPLEASGLCTSSHQFKCCVEEDAGEEYAVTFHVDSSSFPAEREVIGKQACYTYSLPANLPRCPKDIAVFCHFTNAANSSVRSPSMKLKLIPRENVTCQDPIIGIGDPGKVIQKLCQFSGVYGSPGQAIGGTVTYKCVGTQWKEESRACISAPINGLLQVAKALIKSPTQDQKLPTYLRDLSVSAGKEEQDIRSSPGSLGAIISILDLLSTVPTQVNSEMMRDILATINVILDKSALNSWEKLLQQQSNQSSQFLHSVERFSQALQLGDSTPPFLAHPNVQMKSMVIKRGHPQIYQQQFIFKDSDLWGDVAIDECQLGNLQPDSSIVTVAFPTLKAILAQDVQRKTSSNSLVMTTTVSHNIVKPFRISMTFKNNHRSGGKPQCVFWNFSLANNTGGWDSSGCSVEDDGRDNRDRVFCKCNHLTSFSILMSPDSPDPGSLLKILLDIISYIGLGFSIVSLAACLVVEAMVWKSVTKNRTSYMRHICIVNIAFCLLIADIWFIVAGAIHDGRYPLNETACVAATFFIHFFYLSVFFWMLTLGLMLFYRLIFILHDASKSTQKAIAFSLGYGCPLIISSITVGVTQPQEVYMRKNACWLNWEDTRALLAFAIPALIIVVVNVSITVVVITKILRPSIGDKPGKQEKSSLFQISKSIGVLTPLLGLTWGFGLATVIQGSNAVFHIIFTLLNAFQGLFILLFGCLWDQKVQEALLHKFSLSRWSSQHSKSTSIGSSTPVFSMSSPISRRFNNLFGKTGTYNVSTPETTSSSLENSSSAYSLLN

SEQ ID NO: 213 - DNA, 4044 bp, Mus musculus
atgagatcgccaaggaccttcacgttctacttcctgcttcttgtgatttgttcttcagaagctgcgctgagcacaccaacagagcccattgttcaaccttcaattctccaagaacatgagctagccggggaagagctactgaggccaaaaagagcagctgcagcgggtgatcgcgtggcggaagaatacatggtggatattgagatcagctttgaaaatgtctccttcctggagtccatcagagctcacttgaacaacctcagttttccaattcgagggaccgaagctgacattttgaacatagcaatgactacagtctgcactcctgctggaaatgacctcttgtgcttctgtgagaaaggctaccagtggtctgaggaaaggtgtctccactctctcacttgtcaagactatgacagtgccctgccaggcggctactgcagttgtctgaaaggacttcctccccagggacctttctgccagctcccagaagcattcattaccttaaaactcaaagtcagactgaacataggatttcaagaagacctaaagaacacgtcttctgccctctataggtcctacaagactgatctggaaagagcgttccgagcgggttacagaactttaccaggattcagatcggtgactgtgacacagttcaccaagggcagcgtggttgtgaactacgtagtccgggttacatcggcaccactgcctggatctattcataaagccaatgaacaagtcatacagaacctcaaccatacttacaaaatggactacaactccttccagggaaccccgagcaatgagacgaaattcactgtcataccagaattcatctttgagggagacaatgtgactctggagtgtgaaactgagttcgtgacctccaacacgtcttggtactatggagaaaaacgctctgacatccagaacagcgacaaatactccattcacaccactgtcatcaacaatataagcctgatcacccgccttaccatttacaacttcacacagcatgatgcgggcatgtatggttgcaatgtgacattggatatttttgaatatggaacagtcagaaaattagatgtcactcccatccggattttggccaaggaggagagaaaggtggtgtgtgacaaccatcctatatcgctgaactgctgcagcgagaatattgcaaactggagcagtattgaatggaaacaggaagggaagataagcattctagggaacccagaatcagacctagagtctagctgcagcacttacacgctcaaggcagatggaacccagtgtcccagtgggtcttctggaacaacagtcatctacacatgcgagttcgtcagtgcctatggagccagaggcagtaagaacatagctgtgaccttcacctctgtagccaacctaacaataacccgggacccaatttctgtttctgagggacaaagcttttctataacctgcctcagcgatgtgagtagctttgatgaggtgtactggaacacctcagctggtattaaaatccacccaaggttttataccatgaggaggtatcaggatggagcagagtcggtgctgatggtgaagacctccacccgagagtggaacggaacctaccactgcatatttagatataagaattcatacagcattgccaccaaagatgtcaccgttcacccgctgcctctggtgtcagacatcatgatggatcctttggaagccagtggtctgtgtaccagttcccatcaattcaaatgctgcgtagaagaggatgcaggggaagagtacgctgtgactttccacgtggactcctcatcctttcccgctgaaagagaagttatcggcaagcaagcatgctacacatacagtctcccagcgaacttacctcgatgtcccaaagacatcgcagtgttctgccacttcaccaatgcagccaacagctcagtccggagcccatctatgaagctcaaacttattccaagggagaatgtcacatgccaggatcccatcattggcattggggatcctgggaaagtcattcagaagctgtgccagttctcaggtgtttacggaagccctggacaggccatcggcgggactgtcacttacaaatgtgtgggcacccagtggaaggaggagtcaagggcctgcatctcagctccaatcaatggtttgctccaggtggccaaggctttgatcaagagccccacccaggaccagaagctccctacatacctgagggacctttctgttagtgctgggaaggaagaacaggacatccgctcatctccaggaagcctgggagccatcatcagcatccttgacttgctctcaacggttcccacccaagtgaattcagaaatgatgagagacatacttgctaccattaacgtcatcttagacaagtctgccttgaactcctgggagaagttgctacagcaacagagcaatcagagttctcagttcctgcactccgtggaaaggttttcccaagccctccagctgggagacagcactcctccattcctcgcccaccctaacgttcagatgaagagcatggtgataaaacgtggccacccccaaatctaccaacagcagtttatcttcaaagactctgacctgtggggtgatgtagccattgatgagtgtcagctgggaaacttgcagcctgattcatcgatcgttactgtggctttcccaactctcaaagccatccttgcccaggatgtacagagaaagacatcctccaacagcttagtaatgacaaccactgtcagccataacattgtcaagccatttaggatttctatgacttttaagaacaaccatcgttcgggtggcaagccacagtgtgtcttctggaacttcagtcttgccaacaatacagggggctgggacagcagtgggtgctctgtggaagatgatggtagggacaatagggacagagtcttctgcaagtgtaaccacctgacgtcattctccatcctcatgtccccagactccccagatccagggtctcttttaaaaatacttctggatatcatttcttacatcgggttggggttttccatagtcagcttagctgcctgtctagttgtggaagccatggtgtggaaatctgtgaccaagaaccgaacttcctatatgcgccacatctgcatagtcaacattgccttttgccttctgattgctgacatctggttcattgtggctggtgctatccacgacggtcgctacccactcaacgaaacagcctgtgtggccgccacattcttcattcacttcttctacctcagtgtcttcttctggatgctaactctaggcctcatgctcttctaccggctgattttcattctacacgatgcaagcaagtccactcagaaagccatcgcattttctctaggctatggctgtcccctcattatctcctctatcacagtgggggttacgcagccacaggaagtctacatgaggaagaacgcgtgttggctcaactgggaggacaccagagcactgctggcttttgccatccccgcgttgattattgtggtggtaaatgtgagcatcacagttgtggtcatcaccaagatcctgaggccctccattggggacaagccaggcaagcaagagaagagcagcctattccagatcagcaagagtatcggggtcctcacaccactcttggggctcacttggggtttcggtcttgccacagtgatccagggaagcaatgctgtgttccacatcatatttactctcctcaatgccttccaggggctcttcattttgctctttggctgcctctgggatcagaaggtgcaggaagctttgctgcataagttttcattgtcaaggtggtcttctcaacactcaaagtcaacatccataggttcgtcaacacccgtgttttcaatgagttctccaatatcccgaagatttaataatctttttggtaaaacaggaacatataacgtttccaccccagagacaaccagttcatccctggaaaattcctctagtgcttactcactgctcaac

SEQ ID NO: 214 - protein, 1403 aa, Homo sapiens
MVSSGCRMRSLWFIIVISFLPNTEGFSRAALPFGLVRRELSCEGYSIDLRCPGSDVIMIESANYGRTDDKICDADPFQMENTDCYLPDAFKIMTQRCNNRTQCIVVTGSDVFPDPCPGTYKYLEVQYECVPYIFVCPGTLKAIVDSPCIYEAEQKAGAWCKDPLQAADKIYFMPWTPYRTDTLIEYASLEDFQNSRQTTTYKLPNRVDGTGFVVYDGAVFFNKERTRNIVKFDLRTRIKSGEAIINYANYHDTSPYRWGGKTDIDLAVDENGLWVIYATEQNNGMIVISQLNPYTLRFEATWETVYDKRAASNAFMICGVLYVVRSVYQDNESETGKNSIDYIYNTRLNRGEYVDVPFPNQYQYIAAVDYNPRDNQLYVWNNNFILRYSLEFGPPDPAQVPTTAVTITSSAELFKTIISTTSTTSQKGPMSTTVAGSQEGSKGTKPPPAVSTTKIPPITNIFPLPERFCEALDSKGIKWPQTQRGMMVERPCPKGTRGTASYLCMISTGTWNPKGPDLSNCTSHWVNQLAQKIRSGENAASLANELAKHTKGPVFAGDVSSSVRLMEQLVDILDAQLQELKPSEKDSAGRSYNKAIVDTVDNLLRPEALESWKHMNSSEQAHTATMLLDTLEEGAFVLADNLLEPTRVSMPTENIVLEVAVLSTEGQIQDFKFPLGIKGAGSSIQLSANTVKQNSRNGLAKLVFIIYRSLGQFLSTENATIKLGADFIGRNSTIAVNSHVISVSINKESSRVYLTDPVLFTLPHIDPDNYFNANCSFWNYSERTMMGYWSTQGCKLVDTNKTRTTCACSHLTNFAILMAHREIAYKDGVHELLLTVITWVGIVISLVCLAICIFTFCFFRGLQSDRNTIHKNLCINLFIAEFIFLIGIDKTKYAIACPIFAGLLHFFFLAAFAWMCLEGVQLYLMLVEVFESEYSRKKYYYVAGYLFPATVVGVSAAIDYKSYGTEKACWLHVDNYFIWSFIGPVTFIILLNIIFLVITLCKMVKHSNTLKPDSSRLENIKSWVLGAFALLCLLGLTWSFGLLFINEETIVMAYLFTIFNAFQGVFIFIFHCALQKKVRKEYGKCFRHSYCCGGLPTESPHSSVKASTTRTSARYSSGTQSRIRRMWNDTVRKQSESSFISGDINSTSTLNQGHSLNNARDTSAMDTLPLNGNFNNSYSLHKGDYNDSVQVVDCGLSLNDTAFEKMIISELVHNNLRGSSKTHNLELTLPVKPVIGGSSSEDDAIVADASSLMHSDNPGLELHHKELEAPLIPQRTHSLLYQPQKKVKSEGTDSYVSQLTAEAEDHLQSPNRDSLYTSMPNLRDSPYPESSPDMEEDLSPSRRSENEDIYYKSMPNLGAGHQLQMCYQISRGNSDGYIIPINKEGCIPEGDVREGQMQLVTSL

SEQ ID NO: 215 - protein, 1379 aa, Mus musculus
GFSRAALPFGLVRRELSCEGYSIDLRCPGSDVIMIESANYGRTDDKICDADPFQMENTDCYLPDAFKIMTQRCNNRTQCIVVTGSDVFPDPCPGTYKYLEVQYECVPYIFVCPGTLKAIVDSPCIYEAEQKSGAWCKDPLQAADKIYFMPWTPYRTDTLIEYASLEDFQNSRQTTTYKLPNRVDGTGFVVYDGAVFFNKERTRNIVKFDLRTRIKSGEAIINYANYHDTSPYRWGGKTDIDLAVDENGLWVIYATEQNNGMIVISQLNPYTLRFEATWETAYDKRAASNAFMICGVLYVVRSVYQDNESEAGKNTIDYIYNTRLSRGEYVDVPFPNQYQYIAAVDYNPRDNQLYVWNNNFILRYSLEFGPPDPAQVPTTAVTITSSAELFKTTISTTSSASQRGPVSSTAAGPQDGSRGTKPPPAVSTTKIPPVTNIFPLPERFCEALDWKGIKWPQTQRGMMVERPCPKGTRGTASYLCMASTGTWNPKGPDLSNCTSHWVNQLAQKIRSGENAASLANELAKHTKGHVFAGDVSSSVRLMEQLVDILDAQLQELKPSEKDSAGRSYNKAIVDTVDNLLRAEALESWKHMNSSEQAHTATMLLDTLEEGAFVLADNLLEPTRVSMPTENIVLEVAVLSTEGQVQDFKFPLGLKGLGSSIQLSANTVKQNSRNGLAKLVFIIYRSLGQFLSTENATIKLGADLMGRNSTIAVNSPVISVSINKESSRVYLTDPVLFTLPHIDPDNYFNANCSFWNYSERTMMGYWSTQGCKLVDTNKTRTTCACSHLTNFAILMAHREIAYKDGVHHLLLTVITWVGIVVSLVCLAICIFTFCFFRGLQSDRNTIHKNLCINLFIAEFIFLIGIDKTKYTIACPVFAGLLHFFFLAAFSWMCLEGVQLYLMLVEVFESEYSRKKYYYVAGYLFPATVVGVSAAIDYKSYGTVQACWLHVDNYFIWSFIGPVTFIILLNIIFLVITLCKMVKHSNTLKPDSSRLENIKSWVLGAFALLCLLGLTWSFGLLFVNEETVVMAYLFTAFNAFQGLFIFIFHCALQKKVRKEYGKCFRHWYCCGGLPTESPHSSVKASTTRTSARYSSGTQSRIRRMWNDTVRKQSESSFISGDINSTSTLNQGHSLNNARDTSAMDTLPLNGNFNNSYSLRKADYHDGVQVVDCGLSLNDTAFEKMIISELVHNNLRGGNKTHNLELKLPVKPVIGGSSSEDDAIVADASSLMHGDNPGLEFRHKELEAPLIPQRTHSLLYQPQKKVKPEATDSYVSQLTAEADDHLQSPNRDSLYTSMPNLRDSPYPESSPDMAEDLSPSRRSENEDIYYKSMPNLGAGRHLHMCYQISRGNSDGYIIPINKEGCIPEGDVREGQMQLVTSL

SEQ ID NO: 216 - DNA, 4137 bp, Mus musculus
ggtttcagcagagcagccttaccattcgggttagttagacgagagctatcctgtgagggttattctatagacctgcgatgtccgggcagtgacgtcatcatgatcgagagtgcgaactacggtcggacggacgacaagatctgcgatgcagacccctttcaaatggagaacacagactgctacctccctgatgccttcaaaatcatgactcaaaggtgcaacaatcgaacacagtgtatagtagttaccgggtcagatgtatttcctgatccatgtcccggaacttacaaataccttgaagttcaatatgaatgtgtcccttacatctttgtgtgtcctggaaccttgaaagcaattgtggactcaccatgtatatatgaagctgagcagaagtcaggggcttggtgcaaggacccccttcaggctgcagataaaatttattttatgccctggactccctaccgcaccgatacgttaatagaatatgcctctttagaagattttcaaaacagccgccagacaacaacatacaaacttccaaaccgagtagacggtactggatttgtggtgtatgatggagccgtcttctttaacaaggaaagaaccagaaacattgttaagtttgacttgaggactagaatcaagagcggcgaggctatcatcaactatgccaactaccacgatacgtcaccctacagatggggtgggaagacagacattgacctcgcagtggatgagaacggcttatgggtcatttatgccacggagcagaacaatggaatgatcgtgatcagccagctcaacccttacactcttcgattcgaggcaacctgggagacagcgtatgacaagcgtgcggcgtccaatgctttcatgatatgtggggttctctatgtggtcaggtcagtgtaccaagacaatgaaagcgaagcaggcaagaacaccattgactacatctacaacacgcgactaagccggggcgagtacgtggacgttccttttcccaaccagtaccagtatattgctgcagtggattataatccaagagacaaccaactctacgtatggaacaataacttcattttacggtattccctggagtttggtcctcctgaccctgcccaagtgcctaccacagctgtgacaataacttcttcagctgagctgttcaaaaccacaatatccaccacgagcagtgcctcccagcgaggccccgtgagcagcactgcagctggtcctcaggacggaagcagagggacaaagccacctccagccgtctctacaaccaaaattcctcctgtaacaaatatttttcccctgccagagagattctgcgaagcgttagactggaaggggataaagtggcctcagacacaaagggggatgatggttgagcgaccctgtcccaagggaacaagagggacggcctcgtatctgtgcatggcttccacgggaacatggaacccgaagggccctgatcttagcaactgcacgtctcactgggtgaaccagctggcccagaagatcagaagtggagagaatgctgcgagcctggccaatgaactagctaagcacaccaaggggcatgtgtttgcaggggacgtgagctcctctgtgaggctgatggaacagttggtggacatcctggatgctcagctgcaggagctgaagccgagtgagaaggattcggctgggaggagctataacaaggcaattgtggacacggtagacaaccttctgagagctgaggctttggaatcctggaaacacatgaattcttcagagcaggcgcacacagccacaatgttgttggataccttggaagaaggagcattcgtcctagcagacaaccttttggaaccaaccagggtctccatgccaacagaaaatattgttttagaagttgctgtcctcagcacggaagggcaggtccaagactttaaattccctctgggcttaaaggggttgggcagctccatccagctctctgccaacacggtcaaacagaacagcaggaatgggctggccaagctggtattcatcatttaccggagcctgggacaattcctaagcactgagaacgcaaccataaagctgggtgcagacctcatgggtcggaacagcaccattgcggtgaactctcccgtcatctccgtctccatcaataaggagtccagccgcgtgtacctgacagatcccgtgcttttcacactgccacacattgatcctgacaattatttcaatgcaaactgctccttctggaactactcagagagaaccatgatgggatattggtctacccagggctgcaagctggttgacactaataaaactcgcacaacgtgcgcttgcagccacctaaccaattttgctattctcatggcccacagggaaattgcgtataaagatggagtgcaccacctgttgctgacagtcatcacctgggtgggcatcgttgtctccctcgtctgcctggctatctgcatcttcaccttctgtttcttccgagggctacaaagtgaccgcaatactatccacaagaacctttgtatcaaccttttcattgctgaatttatttttctcatcggcatcgataagacaaaatacacgattgcatgccccgtgttcgcagggcttcttcactttttcttcctggctgctttttcctggatgtgcctggaaggtgtgcagctctacctaatgttggttgaggttttcgagagcgaatattcaaggaagaaatattactatgtcgctgggtacctgttcccggccacagtggtcggcgtctcagcagccattgactacaagagttacgggacagtccaggcttgctggcttcacgttgataactatttcatatggagtttcatcgggcctgttactttcattattctgctaaatattattttcctggtgatcacgctgtgcaaaatggtgaaacattcaaacactctgaaaccagattctagcaggttggaaaacattaagtcttgggtacttggcgcgttcgccctgctgtgtctcctgggcctcacctggtcctttgggttgctttttgttaacgaggagactgttgtcatggcgtatctcttcaccgcctttaatgctttccagggactcttcattttcatcttccactgtgctcttcaaaagaaagtacgaaaagagtatggcaagtgcttcagacactggtactgctgtggcggcctcccgaccgagagcccgcacagctctgtgaaggcatccaccacccgcaccagtgctcggtactcctctggcacacagagccgtataagaaggatgtggaatgacaccgtgaggaagcagtctgaatcgtcttttatctcaggtgacatcaatagcacttctacccttaaccaaggacattcactgaacaatgcccgggacacaagtgccatggatactctaccgctaaatggtaacttcaacaacagctattccctgcgcaaggcggactaccacgacggcgtgcaggtcgtggactgtggactaagtctgaacgacaccgcgtttgagaaaatgatcatttcagagttagtgcacaacaacctccggggcggcaacaaaacccacaacttggagctcaagctcccggttaaaccggtgattggcggcagcagcagtgaagatgacgcgattgtggctgacgcctcatctttgatgcatggtgacaacccagggctggagttccgccacaaagagctggaggcgccgctcatcccccagcggactcactcgcttctgtaccaaccccagaaaaaagtgaagccggaggcaacagacagctacgtctcccagctgacggccgaggccgacgaccacctccagtcccccaacagagactctctgtacacgagcatgcccaacctaagagactctccctacccggagagcagcccagacatggcagaggacctgtctccctccaggaggagtgagaacgaggacatttactataaaagtatgcccaaccttggagctggccgccatctccacatgtgctaccagatcagcaggggcaatagcgatggttacatcatccccattaacaaagaagggtgcatccctgagggggacgtccgggaaggacagatgcagctggtgacaagtctt

SEQ ID NO: 217 - protein, 1469 aa, Homo sapiens
MARLAAVLWNLCVTAVLVTSATQGLSRAGLPFGLMRRELACEGYPIELRCPGSDVIMVENANYGRTDDKICDADPFQMENVQCYLPDAFKIMSQRCNNRTQCVVVAGSDAFPDPCPGTYKYLEVQYDCVPYIFVCPGTLQKVLEPTSTHESEHQSGAWCKDPLQAGDRIYVMPWIPYRTDTLTEYASWEDYVAARHTTTYRLPNRVDGTGFVVYDGAVFYNKERTRNIVKYDLRTRIKSGETVINTANYHDTSPYRWGGKTDIDLAVDENGLWVIYATEGNNGRLVVSQLNPYTLRFEGTWETGYDKRSASNAFMVCGVLYVLRSVYVDDDSEAAGNRVDYAFNTNANREEPVSLTFPNPYQFISSVDYNPRDNQLYVWNNYFVVRYSLEFGPPDPSAGPATSPPLSTTTTARPTPLTSTASPAATTPLRRAPLTTHPVGAINQLGPDLPPATAPVPSTRRPPAPNLHVSPELFCEPREVRRVQWPATQQGMLVERPCPKGTRGIASFQCLPALGLWNPRGPDLSNCTSPWVNQVAQKIKSGENAANIASELARHTRGSIYAGDVSSSVKLMEQLLDILDAQLQALRPIERESAGKNYNKMHKRERTCKDYIKAVVETVDNLLRPEALESWKDMNATEQVHTATMLLDVLEEGAFLLADNVREPARFLAAKENVVLEVTVLNTEGQVQELVFPQEEYPRKNSIQLSAKTIKQNSRNGVVKVVFILYNNLGLFLSTENATVKLAGEAGPGGPGGASLVVNSQVIAASINKESSRVFLMDPVIFTVAHLEDKNHFNANCSFWNYSERSMLGYWSTQGCRLVESNKTHTTCACSHLTNFAVLMAHREIYQGRINELLLSVITWVGIVISLVCLAICISTFCFLRGLQTDRNTIHKNLCINLFLAELLFLVGIDKTQYEIACPIFAGLLHYFFLAAFSWLCLEGVHLYLLLVEVFESEYSRTKYYYLGGYCFPALVVGIAAAIDYRSYGTEKACWLRVDNYFIWSFIGPVSFVIVVNLVFLMVTLHKMIRSSSVLKPDSSRLDNIKSWALGAIALLFLLGLTWAFGLLFINKESVVMAYLFTTFNAFQGVFIFVFHCALQKKVHKEYSKCLRHSYCCIRSPPGGTHGSLKTSAMRSNTRYYTGTQSRIRRMWNDTVRKQTESSFMAGDINSTPTLNRGTMGNHLLTNPVLQPRGGTSPYNTLIAESVGFNPSSPPVFNSPGSYREPKHPLGGREACGMDTLPLNGNFNNSYSLRSGDFPPGDGGPEPPRGRNLADAAAFEKMIISELVHNNLRGSSSAAKGPPPPEPPVPPVPGGGGEEEAGGPGGADRAEIELLYKALEEPLLLPRAQSVLYQSDLDESESCTAEDGATSRPLSSPPGRDSLYASGANLRDSPSYPDSSPEGPSEALPPPPPAPPGPPEIYYTSRPPALVARNPLQGYYQVRRPSHEGYLAAPGLEGPGPDGDGQMQLVTSL

SEQ ID NO: 218 - protein, 1466 aa, Mus musculus
MARLAAALWSLCVTTVLVTSATQGLSRAGLPFGLMRRELACEGYPIELRCPGSDVIMVENANYGRTDDKICDADPFQMENVQCYLPDAFKIMSQRCNNRTQCVVVAGSDAFPDPCPGTYKYLEVQYDCVPYIFVCPGTLQKVLEPTSTHESEHQSGAWCKDPLQAGDRIYVMPWIPYRTDTLTEYASWEDYVAARHTTTYRLPNRVDGTGFVVYDGAVFYNKERTRNIVKYDLRTRIKSGETVINTANYHDTSPYRWGGKTDIDLAVDENGLWVIYATEGNNGRLVVSQLNPYTLRFEGTWETGYDKRSASNAFMVCGVLYVLRSVYVDDDSEAAGNRVDYAFNTNANREEPVSLAFPNPYQFVSSVDYNPRDNQLYVWNNYFVVRYSLEFGPPDPSAGPATSPPLSTTTTARPTPLTSTASPAATTPLRRAPLTTHPVGAINQLGPDLPPATAPAPSTRRPPAPNLHVSPELFCEPREVRRVQWPATQQGMLVERPCPKGTRGIASFQCLPALGLWNPRGPDLSNCTSPWVNQVAQKIKSGENAANIASELARHTRGSIYAGDVSSSVKLMEQLLDILDAQLQALRPIERESAGKNYNKMHKRERTCKDYIKAVVETVDNLLRPEALESWKDMNATEQVHTATMLLDVLEEGAFLLADNVREPARFLAAKQNVVLEVTVLNTEGQVQELVFPQEYPSENSIQLSANTIKQNSRNGVVKVVFILYNNLGLFLSTENATVKLAGEAGTGGPGGASLVVNSQVIAASINKESSRVFLMDPVIFTVAHLEAKNHFNANCSFWNYSERSMLGYWSTQGCRLVESNKTHTTCACSHLTNFAVLMAHREIYQGRINELLLSVITWVGIVISLVCLAICISTFCFLRGLQTDRNTIHKNLCINLFLAELLFLVGIDKTQYEVACPIFAGLLHYFFLAAFSWLCLEGVHLYLLLVEVFESEYSRTKYYYLGGYCFPALVVGIAAAIDYRSYGTEKACWLRVDNYFIWSFIGPVSFVIVVNLVFLMVTLHKMIRSSSVLKPDSSRLDNIKSWALGAIALLFLLGLTWAFGLLFINKESVVMAYLFTTFNAFQGVFIFVFHCALQKKVHKEYSKCLRHSYCCIRSPPGGTHGSLKTSAMRSNTRYYTGTQSRIRRMWNDTVRKQTESSFMAGDINSTPTLNRGTMGNHLLTNPVLQPRGGTSPYNTLIAESVGFNPSSPPVFNSPGSYREPKHPLGGREACGMDTLPLNGNFNNSYSLRSGDFPPGDGGPEPPRGRNLADAAAFEKMIISELVHNNLRGASGGAKGPPPEPPVPPVPGVSEDEAGGPGSADRAEIELLYKALEEPLLLPRAQSVLYQSDLDESESCTAEDGATSRPLSSPPGRDSLYASGANLRDSPSYPDSSPEGPNEALPPPPPAPPGPPEIYYTSRPPALVARNPLQGYYQVRRPSHEGYLAAPSLEGPGPDGDGQMQLVTSL

SEQ ID NO: 219 - DNA, 4398 bp, Mus musculus
atggcccgcttggctgcagcactctggagtctctgtgtgacgactgtccttgtcacctctgccacccaaggcctgagccgggctgggctcccatttgggttgatgcgccgggagctagcatgtgagggctaccccatcgagctgcggtgcccggggagtgatgtcatcatggtggagaatgcaaactacgggcgcacagatgacaagatctgcgatgccgaccctttccagatggagaatgtgcagtgctacttgcctgacgccttcaaaatcatgtcacagaggtgtaataaccgaacccagtgtgtggtggtggccggctctgacgcctttcctgacccctgtcctggaacctacaaatacctggaggtgcagtacgactgtgtcccttacatcttcgtgtgcccagggaccctgcagaaggtgctggagcccacctctacacatgagtcagagcatcagtctggtgcatggtgcaaggacccgctgcaggcaggtgaccgtatctacgttatgccctggatcccctaccgcacggacacattgactgaatatgcctcatgggaggactatgtagccgcacgccacaccaccacgtacagactgcccaaccgtgtagatggcactggctttgtggtctacgatggcgcagtcttctacaacaaggagcgcactcgcaacattgtcaaatatgacctgcggacccgcatcaagagcggggaaactgtcataaacacagccaactaccacgatacctcaccttaccgctggggaggtaaaaccgacattgacctggcagtagatgagaacggactgtgggtcatctatgcaactgagggcaacaatgggcgcttggtggtaagccagctcaacccctacacgttgcgttttgagggcacttgggaaacaggctatgacaagcgctcggcctccaatgccttcatggtgtgcggcgtcctctatgtgctgcgttctgtctatgtggacgatgatagcgaggccgcaggcaaccgcgtggactatgccttcaacaccaatgcgaaccgtgaggagcccgtcagtctggccttccccaacccctaccagttcgtatcttctgttgactacaacccccgggacaaccagctctatgtatggaacaactactttgttgtgcgctatagcctggagtttggacccccagatcccagtgctggcccagccacttccccgcctctcagtaccaccaccacagcccggcccacacccctcaccagcacagcctcgcctgcagccaccactccactccgccgggcacccctcaccacacacccagtgggtgccatcaaccagctgggacctgacctgcctccagccacagctccagcacccagtacccgaaggcctccagcccccaatctgcatgtgtcccctgagctcttctgtgaacccagagaggtccggcgggtccagtggccagctacccaacagggtatgctggtggagagaccttgccccaagggaactcgaggaattgcctcattccagtgcctcccagctctggggctctggaatcctcggggccctgacctcagcaactgcacttctccctgggtcaaccaagtagcccagaagatcaagagtggagagaatgcggccaacattgccagtgagctggcccgccacacacggggctctatctatgctggggacgtgtcctcctcagtgaagctgatggaacaactgctagatatcctggatgcccagctccaggccctacggcccattgaacgagagtcagccggcaagaactacaataagatgcacaagcgagagagaacctgcaaggactacatcaaggctgtggtggagacagtggataacctgcttcggccggaggcgcttgagtcatggaaagacatgaatgccaccgaacaggttcatacagccaccatgcttctagatgtcctggaggagggtgccttcctgctggctgacaatgtcagagaacctgctcgcttcttggctgccaagcagaacgtggtcctggaggtaactgtgctgaacacggagggccaagtgcaggagttggtgttcccccaagagtatcccagtgagaactccattcagctctccgccaacaccatcaagcagaacagccgcaacggtgtggtgaaagttgtcttcattctctacaacaacctgggcctcttcttgtccacggagaatgccacagtgaagctggcaggtgaggcagggacaggtggccctggaggtgcctccctggtggtcaactcacaggtcatcgcagcatctatcaataaggagtctagccgcgtcttcctcatggaccctgtcatctttactgtagcccacttggaggccaagaaccacttcaatgcaaactgctccttctggaactactcagagcgctccatgctgggctactggtcaacccagggctgccgattggtggagtccaataagacccataccacatgtgcctgcagccacctcaccaacttcgcagtgctcatggctcaccgagagatctaccaaggccgtattaatgagctgctgctgtcagtcatcacctgggttggtattgtcatctccctggtctgtctggctatctgcatctccaccttctgcttcctgcggggcttgcagactgaccgcaacaccatccacaagaatctgtgcatcaacctcttccttgcggagctgctcttcctggttggaatagataaaactcagtatgaggtcgcctgccctatctttgcgggactgctgcactacttcttcctggccgccttctcctggctgtgcctggagggcgtgcacctctacctgttgctggtggaggtgttcgagagcgagtattcacgcaccaagtactattacctaggtggctactgcttcccagccctggtggtcggcatcgcagcagccattgactaccgaagctacggcactgaaaaggcctgctggctgagggtggataactacttcatctggagcttcattgggcccgtctcgtttgtcattgtggtgaacctggtgttcctcatggtgaccctgcacaagatgatccgaagctcatcagtgctcaagcctgactctagtcgccttgacaacatcaagtcctgggcgctgggtgccattgcactgctcttcctgctgggcctcacctgggctttcggcctcctcttcatcaacaaagagtcagtagtcatggcctatctcttcactaccttcaacgccttccagggggtcttcatctttgtctttcactgcgccttacagaaaaaggtgcacaaggagtacagcaagtgcctgcgtcactcctactgctgcatccgctccccacctgggggcactcacggctcccttaagacctcagccatgcgaagtaacacccgatactacacagggacccagagccgaatccggaggatgtggaatgacaccgtgaggaagcagacagagtcctcctttatggcaggtgacatcaacagcacccccaccctgaaccgaggtaccatggggaaccacctactgaccaaccccgtgctacagcctcgtgggggcactagcccatacaatacactcattgcagagtccgtgggcttcaatccctcctcgcccccagtcttcaactccccaggaagctacagggaacccaagcaccccttgggaggccgggaagcctgtggcatggacaccctgccacttaacggcaacttcaacaacagctactccttgcgaagcggtgatttccctccaggggatgggggtcccgagccaccccgaggccggaacctggcagatgctgccgcctttgagaagatgatcatctcagagctggtgcacaacaacctgcgaggggccagtgggggtgccaaagggcctccaccagagccacctgtgccacctgtgccaggggtcagtgaggacgaggccggtggaccagggagtgctgaccgggcagagattgaacttctctacaaggccctggaggagccgctgctgctgccccgggcccagtcggtgctgtaccagagtgatctggatgagtcggagagctgtacggcagaggatggggccaccagccggcccctctcctcccctcccggccgggactccctctatgccagcggggccaacctgcgggactcgccctcctacccggacagcagcccggaagggcctaatgaggccctgcccccgcccccacctgctccccctgggcccccagaaatctactacacctctcgcccgccggccctggtggctcggaatcccctacagggctactaccaggtgcggcggcccagccatgaaggctacctggcagcccccagcctcgaggggccagggcccgatggggacgggcaaatgcagttggtcactagtctc

SEQ ID NO: 220 - protein, 1240 aa, Homo sapiens
MWPSQLLIFMMLLAPIIHAFSRAPIPMAVVRRELSCESYPIELRCPGTDVIMIESANYGRTDDKICDSDPAQMENIRCYLPDAYKIMSQRCNNRTQCAVVAGPDVFPDPCPGTYKYLEVQYECVPYKVEQKVFLCPGLLKGVYQSEHLFESDHQSGAWCKDPLQASDKIYYMPWTPYRTDTLTEYSSKDDFIAGRPTTTYKLPHRVDGTGFVVYDGALFFNKERTRNIVKFDLRTRIKSGEAIIANANYHDTSPYRWGGKSDIDLAVDENGLWVIYATEQNNGKIVISQLNPYTLRIEGTWDTAYDKRSASNAFMICGILYVVKSVYEDDDNEATGNKIDYIYNTDQSKDSLVDVPFPNSYQYIAAVDYNPRDNLLYVWNNYHVVKYSLDFGPLDSRSGQAHHGQVSYISPPIHLDSELERPSVKDISTTGPLGMGSTTTSTTLRTTTLSPGRSTTPSVSGRRNRSTSTPSPAVEVLDDMTTHLPSASSQIPALEESCEAVEAREIMWFKTRQGQIAKQPCPAGTIGVSTYLCLAPDGIWDPQGPDLSNCSSPWVNHITQKLKSGETAANIARELAEQTRNHLNAGDITYSVRAMDQLVGLLDVQLRNLTPGGKDSAARSLNKLQKRERSCRAYVQAMVETVNNLLQPQALNAWRDLTTSDQLRAATMLLHTVEESAFVLADNLLKTDIVRENTDNIKLEVARLSTEGNLEDLKFPENMGHGSTIQLSANTLKQNGRNGEIRVAFVLYNNLGPYLSTENASMKLGTEALSTNHSVIVNSPVITAAINKEFSNKVYLADPVVFTVKHIKQSEENFNPNCSFWSYSKRTMTGYWSTQGCRLLTTNKTHTTCSCNHLTNFAVLMAHVEVKHSDAVHDLLLDVITWVGILLSLVCLLICIFTFCFFRGLQSDRNTIHKNLCISLFVAELLFLIGINRTDQPIACAVFAALLHFFFLAAFTWMFLEGVQLYIMLVEVFESEHSRRKYFYLVGYGMPALIVAVSAAVDYRSYGTDKVCWLRLDTYFIWSFIGPATLIIMLNVIFLGIALYKMFHHTAILKPESGCLDNINYEDNRPFIKSWVIGAIALLCLLGLTWAFGLMYINESTVIMAYLFTIFNSLQGMFIFIFHCVLQKKVRKEYGKCLRTHCCSGKSTESSIGSGKTSGSRTPGRYSTGSQSRIRRMWNDTVRKQSESSFITGDINSSASLNREPYRETSMGVKLNIAYQIGASEQCQGYKCHGYSTTEW

SEQ ID NO: 221 - protein, 1303 aa, Mus musculus
MWPPQLLILTMLLAPVVHGGKHNERHPALAAPLRHAERSPGGALPPRHLLQQPAAERSTAHRGQGPRGAARGVRGPGAPGAQIAAQAFSRAPIPMAVVRRELSCESYPIELRCPGTDVIMIESANYGRTDDKICDSDPAQMENIRCYLPDAYKIMSQRCNNRTQCAVVAGPDVFPDPCPGTYKYLEVQYECVPYIFLCPGLLKGVYQSEHLFESDHQSGAWCKDPLQASDKIYYMPWTPYRTDTLTEYSSKDDFIAGRPTTTYKLPHRVDGTGFVVYDGALFFNKERTRNIVKFDLRTRIKSGEAIIANANYHDTSPYRWGGKSDIDLAVDENGLWVIYATEQNNGKIVISQLNPYTLRIEGTWDTAYDKRSASNAFMICGILYVVKSVYEDDDNEATGNKIDYIYNTDQSKDSLVDVPFPNSYQYIAAVDYNPRDNLLYVWNNYHVVKYSLDFGPLDSRSGPVHHGQVSYISPPIHLDSELERPPVRGISTTGSLGMGSTTTSTTLRTTTWNIGRSTTASLPGRRNRSTSTPSPAVEVLDDVTTHLPSAASQIPAMEESCEAVEAREIMWFKTRQGQVAKQPCPAGTIGVSTYLCLAPDGIWDPQGPDLSNCSSPWVNHITQKLKSGETAANIARELAEQTRNHLNAGDITYSVRAMDQLVGLLDVQLRNLTPGGKDSAARSLNKLQKRERSCRAYVQAMVETVNNLLQPQALNAWRDLTTSDQLRAATMLLDTVEESAFVLADNLLKTDIVRENTDNIQLEVARLSTEGNLEDLKFPENMGHGSTIQLSANTLKQNGRNGEIRVAFVLYNNLGPYLSTENASMKLGTEAMSTNHSVIVNSPVITAAINKEFSNKVYLADPVVFTVKHIKQSEENFNPNCSFWSYSKRTMTGYWSTQGCRLLTTNKTHTTCSCNHLTNFAVLMAHVEVKHSDAVHDLLLDVITWVGILLSLVCLLICIFTFCFFRGLQSDRNTIHKNLCISLFVAELLFLIGINRTDQPIACAVFAALLHFFFLAAFTWMFLEGVQLYIMLVEVFESEHSRRKYFYLVGYGMPALIVAVSAAVDYRSYGTDKVCWLRLDTYFIWSFIGPATLIIMLNVIFLGIALYKMFHHTAILKPESGCLDNINYEDNRPFIKSWVIGAIALLCLLGLTWAFGLMYINESTVIMAYLFTIFNSLQGMFIFIFHCVLQKKVRKEYGKCLRTHCCSGKSTESSIGSGKTSGSRTPGRYSTGSQSRIRRMWNDTVRKQSESSFITGDINSSASLNREPYRETSMGVKLNIAYQIGASEQCQGYKCHGYSTTEW

SEQ ID NO: 222 - DNA, 3831 bp, Mus musculus
atgtggccaccacagctactcatcctcacgatgcttttagcacctgtagttcatggtggcaagcacaatgagagacatccagccctcgctgctccactgcgacacgctgagcgcagcccaggaggcgctctccctcccagacatctccttcagcagccagcggcagagcgctcaacggctcatcgaggacaggggccacgcggagctgccagaggagtccgtggaccaggtgccccaggagcacagattgcagcccaagctttcagccgcgccccaattcccatggcagtggtccgcagagagctctcctgtgagagctaccccattgagctccgttgtccgggcacagacgtcatcatgatcgagagcgccaactacgggaggaccgatgacaagatctgtgactcggaccctgctcagatggagaacattcggtgttatctgccagatgcctataagattatgtctcaaagatgcaataacagaacccagtgtgcagtggtggcaggtcctgatgtatttccagacccatgtccgggaacatataaataccttgaagtgcagtatgaatgtgtcccttattttctttgtcctggactgctaaaaggagtgtaccagagtgaacacttgtttgaatctgaccaccaatctggggcatggtgcaaggaccctctacaggcttctgacaagatttactatatgccctggactccctacagaactgacaccctgacagagtattcgtccaaagatgacttcattgctggaaggccaacaactacctacaagctccctcacagagtggatggcactggatttgtagtatacgatggtgccctcttcttcaacaaggagcggacaaggaacattgtaaagtttgatttgaggactaggataaagagtggagaggcaatcatagcaaatgctaattaccatgacacctccccataccgatggggtggcaagtccgacatagacttggcagtggatgaaaatggattatgggtaatctatgcaacagaacagaacaatggcaagattgtcattagccagttgaacccttacaccctacggattgaggggacatgggacactgcctatgataaaaggtcagcttccaatgcattcatgatttgtgggattctgtatgtggtcaaatctgtatatgaggatgatgacaacgaggccaccggtaataagattgactacatttacaacactgaccaaagcaaggatagcttggtggatgtaccctttcccaactcttaccagtacatagcagctgtggattacaatcccagggacaatctgctctatgtgtggaataactaccacgttgtgaaatactctttggacttcgggcctctggatagtagatcagggccggtacatcatggacaagtctcctacatctctccaccaattcacctcgactctgaactagaaaggccccctgtcagagggatttctaccacaggatccctgggtatgggaagcacgaccaccagcaccaccctccggaccacaacctggaacataggcaggagtaccaccgcatccttgccgggcagaagaaaccgcagtaccagcacgccatcccccgcggtagaggtgctggatgacgtcaccacacacctgccctcggcagcctcccaaatcccagctatggaagagagctgcgaggctgtggaagcccgagaaatcatgtggtttaagaccagacaggggcaggtagcaaagcagccatgcccagcaggaaccataggtgtatcaacttacctatgtcttgctcctgatggaatatgggacccccaaggaccagatctcagcaactgctcttctccttgggtcaatcacataacacagaagctgaaatccggagaaacagctgccaatattgccagagagctagcagaacagacaagaaatcacttgaacgctggggacatcacctactctgtccgtgccatggaccagctggttggcctcttggatgtccagctcaggaatttgacaccagggggaaaagacagcgcagcccgcagcttgaacaaggcgatggtggagacagttaacaacctccttcagccacaagctttgaatgcctggagagacctgacgacaagtgatcaactgcgtgcggccaccatgttgcttgacactgtggaggagagcgctttcgtgttagctgataaccttttgaagaccgacattgtcagggagaatacagacaatattttagaagttgcaagactgagcacggaaggaaacctagaagatctaaaattcccagagaacatgggccacggaagtaccatccagctctcagcaaacacattaaagcaaaatggccggaatggagagattagagtggcttttgtcctgtataataacctgggtccttatttgtctacggagaatgccagtatgaagttgggcacagaagctatgtccacaaatcactcggttatcgtcaattcccctgttattacagcagcaataaataaggaattcagtaataaagtgtatttggctgatcctgtggtatttactgttaaacacatcaagcagtcagaagaaaatttcaaccctaactgttcattttggagctattccaagcgcacaatgacaggttattggtcaacacaaggctgtcgactcctgacaaccaacaagacacatactacatgctcctgtaaccacctcaccaactttgcagtattgatggcacatgtggaagttaagcacagcgatgcagtccacgatcttcttctggatgtgatcacgtgggttggcatcttgctgtcccttgtctgtctcctgatttgcatcttcacattctgcttcttccggggactccagagtgaccgcaacaccattcacaagaacctctgcatcagcctgttcgtggcagaactgctcttcctgattggaatcaacagaaccgaccaaccaattgcctgtgcagtgttcgcggctcttttgcatttcttcttcttggcggccttcacctggatgtttctagaaggggtgcagctgtatatcatgctggtggaggtctttgagagcgagcattcccgtaggaagtacttttatctggtcggctatgggatgcccgcgctcatcgtggccgtttctgcggccgtcgactacaggagctacggaacagacaaagtgtgttggcttcgccttgacacctacttcatttggagttttataggaccggcgaccttgataattatgctgaatgtcatcttccttgggattgctttatacaaaatgtttcaccatactgccatactgaaacctgaatcaggctgtcttgacaatatctcatgggttataggtgcaatagctctgctctgcctgttaggattgacctgggcctttggactcatgtatattaatgaaagcacagtcatcatggcgtatctcttcaccattttcaattctctacagggaatgtttatattcattttccactgtgttctacagaagaaggtacggaaagagtatgggaaatgcctccgcacgcattgctgtagtgggaaaagcacggagagttcgattggctcagggaaaacatctggttctcgaactccaggacggtactccacaggctcgcagagccggattcggagaatgtggaatgacactgtccgaaagcagtcagagtcgtccttcatcaccggagacataaacagctcagcatcgctcaacagagagccctacagagagacaagtatgggagtaaagctaaacattgcatatcaaggggcttctgaacaatgccagggatacaagtgtcatggatactctaccactgaatgg

SEQ ID NO: 223 - protein, 828 aa, Homo sapiens
MRLEGEGRSARAGQNLSRAGSARRGAPRDLSMNNLTELQPGLFHHLRFLEELRLSGNHLSHIPGQAFSGLYSLKILMLQNNQLGGIPAEALWELPSLQSLDLNYNKLQEFPVAIRTLGRLQELGFHNNNIKAIPEKAFMGNPLLQTIHFYDNPIQFVGRSAFQYLPKLHTLSLNGAMDIQEFPDLKGTTSLEILTLTRAGIRLLPSGMCQQLPRLRVLELSHNQIEELPSLHRCQKLEEIGLQHNRIWEIGADTFSQLSSLQALDLSWNAIRSIHPEAFSTLHSLVKLDLTDNQLTTLPLAGLGGLMHLKLKGNLALSQAFSKDSFPKLRILEVPYAYQCCPYGMCASFFKASGQWEAEDLHLDDEESSKRPLGLLARQAENHYDQDLDELQLEMEDSKPHPSVQCSPTPGPFKPCEYLFESWGIRLAVWAIVLLSVLCNGLVLLTVFAGGPVPLPPVKFVVGAIAGANTLTGISCGLLASVDALTFGQFSEYGARWETGLGCRATGFLAVLGSEASVLLLTLAAVQCSVSVSCVRAYGKSPSLGSVRAGVLGCLALAGLAAALPLASVGEYGASPLCLPYAPPEGQPAALGFTVALVMMNSFCFLVVAGAYIKLYCDLPRGDFEAVWDCAMVRHVAWLIFADGLLYCPVAFLSFASMLGLFPVTPEAVKSVLLVVLPLPACLNPLLYLLFNPHFRDDLRRLRPRAGDSGPLAYAAAGELEKSSCDSTQALVAFSDVDLILEASEAGRPPGLETYGFPSVTLISCQQPGAPRLEGSHCVEPEGNHFGNPQPSMDGELLLRAEGSTPAGGGLSGGGGFQPSGLALLHTY

SEQ ID NO: 224 - protein, 796 aa, Mus musculus
MNNLTELQPGLFHHLRFLEELRLSGNHLSHIPGQAFSGLHSLKILMLQSNQLRGIPAEALWELPSLQSLDLNYNELQEFPLAIRTLGRLQELGFHNNNIKAIPEKAFMGSPLLQTMHFYDNPIQFVGRSAFQYLSKLHTLSLNGATDIQEFPDLKGTTSLEILTLTRAGIRLLPPGVCQQLPRLRILELSHNQIEELPSLHRCQKLEEMGLRHNRIKEIGADTFSQLGSLQALDLSWNAIRAIHPEAFSTLRSLVKLDLTDNQLTTLPLAGLGGLMHLKLKGNLALSQAFSKDSFPKLRILEVPYAYQCCAYGICASFFKTSGQWQAEDFHPEEEEAPKRPLGLLAGQAENHDLDLDELQMGTEDSKPHPSVQCSPVPGPFKPCEHLFESWGIRLAVWAIVLLSVLCNGLVLLTVFASGPSPLSPVKLVVGAMAGANALSGISCGLLASVDALTYGQFAEYGARWESGLGCQATGFLAVLGSEASVLLLTLAAVQCSISVTCVRAYGKAPSPGSVRAGALGCLALAGLAAALPLASVGEYGASPLCLPYAPPEGRPAALGFAVALVMMNSLCFLVVAGAYIKLYCDLPRGDFEAVWDCAMVRHVAWLIFADGLLYCPVAFLSFASMLGLFPVTPEAVKSVLLVVLPLPACLNPLLYLLFNPHFRDDLRRLWPSPRSPGPLAYAAAGELEKSSCDSTQALVAFSDVDLILEASEAGQPPGLETYGFPSVTLISRHQPGATRLEGNHFVESDGTKFGNPQPPMKGELLLKAEGATLAGCGSSVGGALWPSGSLFASHL

SEQ ID NO: 225 - DNA, 2376 bp, Mus musculus
ctggatgacaatgcactcaccgagatccccgtcagagctctcaacaaccttcctgccctacaagccatgaccttggctctcaaccatatccgccacatccctgactatgccttccagaacctcaccagtcttgtggtgctgcatctacataacaaccgcatccagcatgtggggacccacagcttcgaggggctgcacaatctggagacactagacctgaactataatgagctgcaggagttccccttggctatccggaccctgggcaggctgcaggaattgggtttccataacaacaacatcaaggctatcccagagaaagccttcatgggcagccctctcctgcagacaatacatttttatgacaacccaatccagtttgtgggaaggtcagcattccagtacctgtctaaactgcatacgctatctttgaatggtgccactgatatccaagagttcccagacctcaaaggcaccactagcctggagatcctgaccctgacccgtgcgggcatcagactgctcccaccgggagtgtgccaacagctgcctaggctccgaatcctggagctgtctcataatcagatcgaggagttacccagcctgcacaggtgtcagaagctggaggaaattggcctccgacataaccggatcaaggaaattggtgcagataccttcagccagctgggctccttgcaagctttagacctgagttggaatgccatccgtgccatccaccctgaggctttctcaacccttcgatccttggttaagctggacctgactgacaaccagctgaccacactgcccctggctgggctgggaggcctgatgcacctgaagctcaaagggaacttggccctgtctcaggccttctccaaggacagtttcccaaaactgaggatcctggaggtgccctacgcctaccagtgctgtgcctacggcatctgtgccagcttcttcaagacctctgggcagtggcaggccgaggactttcatccagaggaagaggaggcaccaaagaggcccctgggtctccttgctggacaagctgagaaccactatgacctagacctggatgagctccagatggggacagaggactcaaagccacaccccagtgtccagtgcagccctgttccaggccccttcaagccctgcgagcacctctttgagagctggggcatccgccttgctgtgtgggccatcgtgttactctccgtactctgtaacgggctggtgctgctgacagtctttgccagcggacccagcccgctgtcccccgtcaagcttgtggtgggtgcgatggcaggcgccaacgccctgtcgggcatttcctgtggtctcctggcctcggtggacgccttgacctatggtcagttcgctgagtatggagcccgctgggagagcggtctgggctgccaggctacgggcttcctggctgtcctgggttcagaggcgtcggtgctgctgctcacactggcggccgtgcagtgcagcatctccgtgacctgcgtccgagcctacgggaaggcgccgtcgcctggcagcgtccgcgcaggcgcactgggatgcctggcgctggccgggctggccgcagcactgccgctggcctcggtgggagagtatggcgcctccccactctgcctgccctacgccccacccgagggccggccggctgccctgggcttcgctgtagccctggtgatgatgaactcgctctgcttcctggtggtggccggcgcctacatcaagctctactgtgacctgccacggggtgactttgaggccgtgtgggactgcgccatggtgcgccacgtggcctggctcatctttgcagatggcctcctctactgccccgtggccttcctcagctttgcctctatgctgggcctcttccctgtcacccccgaggctgtcaagtcagtccttctggtggtgctgcctctgcctgcctgcctcaacccactgctctacctgctcttcaaccctcacttccgggatgaccttcggcggctctggccaagccctcggtccccagggcccctagcctacgctgcagccggtgagctggagaagagctcctgcgactccacccaagcgctggtggctttctcagatgtggatcttattctggaagcttctgaggctgggcagcctcctgggctagagacctatggcttcccttcagtgaccctcatctcccgacatcagccgggggctaccaggctggagggaaaccattttgtagagtctgatggaaccaagtttgggaacccacaacctcccatgaagggagaactgctgctgaaggcagagggagccactttggcaggctgtggctcttccgtgggtggagccctctggccctctggc

SEQ ID NO: 226 - protein, 757 aa, Homo sapiens
MTSGSVFFYILIFGKYFSHGGGQDVKCSLGYFPCGNITKCLPQLLHCNGVDDCGNQADEDNCGDNNGWSMQFDKYFASYYKMTSQYPFEAETPECLVGSVPVQCLCQGLELDCDETNLRAVPSVSSNVTAMSLQWNLIRKLPPDCFKNYHDLQKLYLQNNKITSISIYAFRGLNSLTKLYLSHNRITFLKPGVFEDLHRLEWLIIEDNHLSRISPPTFYGLNSLILLVLMNNVLTRLPDKPLCQHMPRLHWLDLEGNHIHNLRNLTFISCSNLTVLVMRKNKINHLNENTFAPLQKLDELDLGSNKIENLPPLIFKDLKELSQLNLSYNPIQKIQANQFDYLVKLKSLSLEGIEISNIQQRMFRPLMNLSHIYFKKFQYCGYAPHVRSCKPNTDGISSLENLLASIIQRVFVWVVSAVTCFGNIFVICMRPYIRSENKLYAMSIISLCCADCLMGIYLFVIGGFDLKFRGEYNKHAQLWMESTHCQLVGSLAILSTEVSVLLLTFLTLEKYICIVYPFRCVRPGKCRTITVLILIWITGFIVAFIPLSNKEFFKNYYGTNGVCFPLHSEDTESIGAQIYSVAIFLGINLAAFIIIVFSYGSMFYSVHQSAITATEIRNQVKKEMILAKRFFFIVFTDALCWIPIFVVKFLSLLQVEIPGTITSWVVIFILPINSALNPILYTLTTRPFKEMIHRFWYNYRQRKSMDSKGQKTYAPSFIWVEMWPLQEMPPELMKPDLFTYPCEMSLISQSTRLNSYS

SEQ ID NO: 227 - protein, 759 aa, Mus musculus
  misc_feature (123)..(123): Xaa can be any naturally occurring amino acid
MTSGPFFFCIFIIGKYFTLGSAQDVSCPLGSFPCGNMSRCLPQLLHCNGVDDCGNRADEDHCGDNNGWSLQLDKYFANYYKLASTNSFEAETSECLVGSVPMHCLCRDLELDCDEANLRAVPXKTELCVCFRSLQRNFIRTLPPNGFRKYHELQKLCLQNNRIHSVSVSAFRGLRSLTKLYLSHNRITFLKPGVFEDLHRLEWLIIEDNHLSRISPLTFYGLNSLILLVLMNNALTRLPDKPLCQHMPRLHWLDFEGNRIHNLRNLTFISCNNLTVLVMRKNKINYLNEHAFTHLQKLDELDLGSNKIENLPPNIFKDLKELSQLNISYNPIQKIEVNQFDCLAKLKSLSLEGIEISNIQQRMFRPLINLSHIYFKKFQYCGYAPHVRSCKPNTDGISSLENLLASIIQRVFVWVVSAITCFGNIFVICMRPYIRSENKLHAMSIISLCCADCLMGVYLFVIGAFDLKFRGEYNKHAQPWMESVHCQFMGSLAILSTEVSVLLLTFLTLEKYICIVYPFRCLRPRKCRTITVLIFIWIIGFIVAFAPLGNKEFFKNYYGTNGVCFPLHSEDTGSTGAQIYSVVIFLGINLVAFIIIVFSYGSMFYSVHQSSVTVTEIQKQVKKEVVLAKRFFFIVFTDALCWIPIFILKFLSLLQVEIPDSITSWVVIFILPINSALNPIIYTLTTRPFKEMIHQLWHNYRQRRSVDRKETQKAYAPSFIWVEMWPLQEMSSGFMKPGAFTDPCDLSLVSQSSRLNSYS

SEQ ID NO: 228 - DNA, 2277 bp, Mus musculus
  misc_feature (367)..(368): n is a, c, g, or t
atgacatctggtccattcttcttctgcatcttcattattggaaaatatttcactctcggaagtgcacaggatgtcagttgtcccctcggctccttcccctgtgggaacatgagcaggtgcctgcctcagctgcttcactgcaatggtgtggacgactgcgggaaccgagctgatgaggaccactgcggagacaacaatgggtggtctctgcaactggacaaatattttgctaattactataaactggcttccactaactcctttgaggcagaaacttccgaatgcttggttggctctgtgcccatgcattgtttgtgccgagatctagaacttgactgtgatgaagccaatttacgagctgtcccanncaagactgaactgtgtgtgtgtttcaggtccctgcagaggaacttcataagaacactccctcccaacggcttcaggaagtaccatgagctgcagaagctgtgcctgcaaaacaataggattcactccgtgagcgtctctgccttcagaggactgcgcagcctcactaaactgtacctcagtcataacagaataaccttcctaaagccaggagtttttgaagatctccacagactggaatggctgataattgaagacaatcacctcagtcgaatttccccactcacattttacggactaaattctcttattctcttagtgctgatgaataatgccctcacccgtttgcctgacaaacccctctgtcagcacatgccccgcctgcactggctggactttgaaggcaaccgtatccataatttaagaaatttgacttttatttcctgcaataatttaactgttttggtaatgaggaagaacaaaatcaattacttaaatgaacatgcatttacacacctccagaaactagatgaattggatttaggaagtaataagattgaaaatcttccaccgaacatatttaaggatctgaaggagctgtcgcaattgaatatttcttataacccaatccagaaaattgaagtaaatcaattcgattgtcttgccaaactcaagtctctcagccttgaaggaatagaaatttcaaatatccaacaaaggatgtttagaccgctcataaatctctctcacatctattttaagaaatttcagtactgtggatacgcaccacatgtgcgcagctgtaagcccaacacggatgggatttcatctctagagaacctcttggcaagcatcatccagagagtctttgtctgggttgtatctgccattacctgctttggaaacatttttgttatttgtatgcgaccatacatcagatctgagaacaagctgcatgccatgtcgatcatttctctctgctgtgctgactgcctaatgggggtgtatctatttgtgattggtgcctttgacctcaagtttcggggagagtacaataagcacgcacagccgtggatggagagtgttcattgtcagttcatggggtcgttggccattctgtccacagaagtatccgttttacttttaacatttctgacattggaaaagtacatctgcattgtgtatccttttcggtgtttaaggcctcgaaaatgcagaacaatcacggttctgattttcatttggattattgggtttatagtggcttttgctccacttggcaataaggaatttttcaaaaactactatggcaccaatggagtatgctttcctcttcattcagaagacacgggaagtactggagcccagatttattcagtggtaatttttcttggtattaacctggtggcatttatcatcattgtgttctcctatggaagcatgttttacagtgttcatcaaagctccgtaacagtaaccgaaatacagaagcaagtgaagaaggaggtggttctcgccaaacgctttttctttatcgttttcaccgacgcgctgtgctggattcccatcttcatactgaaatttctttcactgcttcaggtggaaataccagattctattacctcttgggtggtgatttttattctgcctatcaacagtgctttgaacccaattatctacacgttgaccactagacctttcaaggaaatgatccatcaactctggcacaactacagacaaagaaggtctgttgacaggaaagagactcagaaggcatatgctccatcattcatctgggtggaaatgtggcccttgcaggagatgtcctctgggttcatgaagccaggcgctttcacagacccctgtgatctgtcgctagtttctcagtcatctagactcaattcttattcg

SEQ ID NO: 229 - protein, 362 aa, Homo sapiens
MSENGSFANCCEAGGWAVRPGWSGAGSARPSRTPRPPWVAPALSAVLIVTTAVDVVGNLLVILSVLRNRKLRNAGNLFLVSLALADLVVAFYPYPLILVAIFYDGWALGEEHCKASAFVMGLSVIGSVFNITAIAINRYCYICHSMAYHRIYRRWHTPLHICLIWLLTVVALLPNFFVGSLEYDPRIYSCTFIQTASTQYTAAVVVIHFLLPIAVVSFCYLRIWVLVLQARRKAKPESRLCLKPSDLRSFLTMFVVFVIFAICWAPLNCIGLAVAINPQEMAPQIPEGLFVTSYLLAYFNSCLNAIVYGLLNQNFRREYKRILLALWNPRHCIQDASKGSHAEGLQSPAPPIIGVQHQADAL

SEQ ID NO: 230 - protein, 379 aa, Mus musculus
MPENSSIPNCCEASGLAARPSWSGSAGARPPVTARAPWVAPMLSTVVVVTTAVDFVGNLLVILSVLRNRKLRNAGNLFVVSLALADLVIALYPYPLILVAIIRDGWVLGEAHCKASAFVMGLSVIGSVFNITAIAINRYCCICHSTTYHRVCSHWYTPIYISLVWLLTLVALVPNFFVGSLEYDPRIYSCTFIQTASTQYTAAVVAIHFLLPMAVVSFCYLRIWVLVLQARRKAKAERKLRLRPSDLRSFLTMFAVFVVFAICWAPLNCIGLAVAINPEAMALQVPEGLFVTSYFLAYFNSCLNAIVYGLLNQNFRREYKEDHFGLYGTLGAAYSMLPNTVLLRSDRARRHLLPGLPCLSRKVLSSLHQLSGPSSKPVK

SEQ ID NO: 231 - DNA, 1137 bp, Mus musculus
atgcctgagaacagctcaatccctaactgctgtgaggccagcgggctggcagcgcgccctagttggtctgggtcagccggagccaggccccctgtgactgcccgggccccctgggtggctcccatgctatctacagtagtcgtcgtcaccacagccgtggacttcgtggggaacctgcttgtcatcctctcagtgctcaggaaccgcaagctgcggaacgcaggtaatttgtttgtggtgagtctggccttggctgacttggtgatagccttgtacccttacccactgatccttgtggccattatccgtgacggttgggtccttggggaggcccactgcaaggccagtgcctttgtgatgggcctgagtgtcattggctctgtcttcaacatcacagccattgccatcaaccgctactgctgcatctgtcatagtaccacctaccaccgggtctgcagtcactggtatactcccatctacatcagcctcgtctggctcctcactctggtggctttggtgcccaatttctttgtggggtctttagagtatgatccacgcatctattcctgcaccttcatccagacagccagcacacagtacacggcagctgtggtggccatccacttcctccttcccatggctgtggtgtccttctgctacctgcgaatctgggtactggtgctccaggcccgaaggaaggccaaggctgagaggaagctgcgtctgagaccgagtgatttgcgcagtttcctaaccatgtttgcagtgtttgtggtttttgccatatgctgggcccccctcaactgtatcggccttgcagtggccatcaacccagaggcaatggctctccaggtcccagaagggctctttgtcaccagttacttcttagcttactttaacagctgccttaatgccattgtttatgggctcctgaaccagaacttccgcagggagtacaaagaggatcattttggcctatatggaacactaggcgctgcatacagcatgcttccaaacactgtcttactgaggagcgacagggcccgacgccacctgctgccagggctaccgtgcctgtcaaggaaggtgctctctagcctgcatcagctcagtgggcctagcagcaaacctgtgaag

SEQ ID NO: 232 - protein, 430 aa, Homo sapiens
MEGEPSQPPNSSWPLSQNGTNTEATPATNLTFSSYYQHTSPVAAMFIVAYALIFLLCMVGNTLVCFIVLKNRHMHTVTNMFILNLAVSDLLVGIFCMPTTLVDNLITGWPFDNATCKMSGLVQGMSVSASVFTLVAIAVERFRCIVHPFREKLTLRKALVTIAVIWALALLIMCPSAVTLTVTREEHHFMVDARNRSYPLYSCWEAWPEKGMRRVYTTVLFSHIYLAPLALIVVMYARIARKLCQAPGPAPGGEEAADPRASRRRARVVHMLVMVALFFTLSWLPLWALLLLIDYGQLSAPQLHLVTVYAFPFAHWLAFFNSSANPIIYGYFNENFRRGFQAAFRARLCPRPSGSHKEAYSERPGGLLHRRVFVVVRPSDSGLPSESGPSSGAPRPGRLPLRNGRVAHHGLPREGPGCSHLPLTIPAWDI

SEQ ID NO: 233 - protein, 501 aa, Mus musculus
MSVLDSTFESAWAKGMYHDTALCGTGDQPIALLMLGKHSELHPHPRVGFLVVKSPLTLLRFGPDSCAPFTPAEPSQPPNGSWPPSLNESDAETAPVASLTFSSYYQHSSPVAAMFIAAYALIFLLCMVGNTLVCFIVLKNRHMRTVTNMFILNLAVSDLLVGIFCMPTTLVDNLITGWPFDNATCKMSGLVQGMSVSASVFTLVAIAVERFRCIVHPFREKLTLRKALLTIAVIWALALLIMCPSAVTLTVTREEHHFMLDARNRSYPLYSCWEAWPEKGMRKVYTAVLFAHIYLAPLALIVVMYARIARKLCQAPGPARDAEEAVAEGGRASRRRARVVHMLVMVALFFTLSWLPLWVLLLLIDYGELSELQLHLLSVYAFPLAHWLAFFHSSANPIIYGYFNENFRRGFQAAFRAQLCWLPWAAHKQAYSERPGRLLRRRVVVDVQPSDSGLPSESGPSSGVPGPNRLPLRNGRVAHQDGPREGPGCNHMPLTIPAWNI

SEQ ID NO: 234 - DNA, 1503 bp, Mus musculus
atgagtgtccttgactccaccttcgaaagtgcttgggctaaaggcatgtaccatgatactgctttatgtggtactggggatcaacccatagccttactcatgttaggcaagcactctgagctgcatccccatccaagggttggctttttagtggtgaaaagcccgttaactcttcttcgctttggtcctgactcttgtgctcccttcactccagcggaaccctcccagcctcccaacggcagctggcccccgagtctgaacgagagtgatgctgaaaccgccccggtggccagcctcaccttctcttcctactaccagcactcctctccggtggccgccatgttcatcgccgcctacgcgctcatcttcctcctctgcatggtgggcaacaccctggtctgcttcatcgtgcttaagaaccggcacatgcgcactgtcaccaacatgttcatcctcaacctggccgtcagcgacctgctggtgggcatcttctgcatgcccacaaccctcgtggacaaccttatcacaggttggccttttgacaatgccacatgcaagatgagcggcttggtacagggcatgtccgtgtctgcgtcggttttcacactggtggccattgccgtggagaggttccgctgcatcgtacaccctttccgtgagaagctgaccctccggaaggcgctgctcaccatagcggtgatctgggcgctggcgctgctcatcatgtgtccctcggcggtcactctgaccgtcacgcgagaggagcatcacttcatgctggatgctcgcaaccgctcctaccctctctactcgtgctgggaggcctggcccgagaagggcatgcgcaaggtctacaccgccgtgctcttcgcgcacatctatctggcgccgctggcgctcatcgtggtgatgtacgcgcgcatcgcgcgcaagctgtgccaggcccccggtccagcgcgcgacgcggaggaggcggtggccgagggtggccgcgcgtcgcgccgcagggcccgcgtggtgcatatgctggtcatggtggcgctcttcttcaccttgtcctggctgccactctgggtgctgctgctgctcatcgactacggggagctgagcgagctgcagctgcacttgctgtccgtctacgccttcccgttggcacactggctggccttcttccacagcagcgccaaccccattatctacggctacttcaacgagaacttccgccgcggcttccaggctgccttccgggcacagctctgctggcttccctgggccgcccacaagcaagcctactccgagcggcctggccgcctcctgcgcaggcgggtggtggtggacgtgcaacccagcgactcagggctgccatcggagtctggccccagcagtggggtcccagggcctaaccggctgccattgcgcaatgggcgtgtggcccaccaggatggcccgagggaagggcctggctgcaaccacatgcccctcactatcccagcctggaacatt

SEQ ID NO: 235-236 - skipped (2 entries)

SEQ ID NO: 237 - protein, 407 aa, Homo sapiens
MSLNSSLSCRKELSNLTEEEGGEGGVIITQFIAIIVITIFVCLGNLVIVVTLYKKSYLLTLSNKFVFSLTLSNFLLSVLVLPFVVTSSIRREWIFGVVWCNFSALLYLLISSASMLTLGVIAIDRYYAVLYPMVYPMKITGNRAVMALVYIWLHSLIGCLPPLFGWSSVEFDEFKWMCVAAWHREPGYTAFWQIWCALFPFLVMLVCYGFIFRVARVKARKVHCGTVVIVEEDAQRTGRKNSSTSTSSSGSRRNAFQGVVYSANQCKALITILVVLGAFMVTWGPYMVVIASEALWGKSSVSPSLETWATWLSFASAVCHPLIYGLWNKTVRKELLGMCFGDRYYREPFVQRQRTSRLFSISNRITDLGLSPHLTALMAGGQPLGHSSSTGDTGFSCSQDSGNLRAL

SEQ ID NO: 238 - protein, 446 aa, Mus musculus
MSLNSSLSYRKELSNLTATEGGEGGAVSEFIAIIIITVLVCLGNLVIVVTLYKKSYLLTLSNKFVFSLTLSNFLLSVLVLPFVVTSSIRREWIFGVVWCNFSALLYLLISSASMLTLGVIAIDRYYAVLYPMVYPMKITGNRAVMALVYIWLHSLIGCLPPLFGWSSVEFDEFKWMCVAAWHQEPGYTIFWQIWCALFPFLIMLVCYGFIFRVARVKARKVHCGTVVTVEEDSQRSGRKNSSTSTSSSGSRRNALQGVVYSANQCKALITILVVIGAFMVTWGPYMVVITSEALWGKNCVSPTLETWATWLSFTSAICHPLIYGLWNKTVRKELLGMCFGDRYYRESFVQRQRTSRLFSISNRITDLGLSPHLTALMAGGQSLGHSSSTGDTGFSYSQDSGKVVKTLKTPHLCKLAVLTAAGRPATPQGLWRAVEDCGGEMVRGRS

SEQ ID NO: 239 - DNA, 1338 bp, Mus musculus
atgagcctcaactcctccctcagctacaggaaggaactgagcaacctcactgcaacagagggtggtgaagggggtgccgtctctgagttcatcgccatcatcatcatcactgtcctcgtctgcctgggcaacctggtcattgtagtcaccttgtacaagaagtcctacctcctcaccctcagcaacaagttcgtcttcagcctgaccttgtccaacttcctgttgtcggtgctggtgctgccgttcgtggtgactagctccatccggagggaatggattttcggcgtggtttggtgcaacttctctgccctcctctacctgctgatcagctcagccagcatgctcacgcttggggtcattgccatcgatcggtactacgccgtcctgtatccaatggtgtaccccatgaagatcacagggaaccgagctgtgatggctctcgtctacatctggctccactctctcattggctgtctgccgcccctatttggttggtcatcggtggagtttgatgagttcaagtggatgtgtgtggccgcgtggcaccaggaacccggctacaccattttctggcagatctggtgtgccctgttcccctttctcatcatgctagtgtgctacggtttcatcttccgggtggccagggtcaaggcccgaaaggtgcactgtggcacggtggtcactgtggaggaggactctcagaggagcgggaggaagaattctagtacctccacttcctcctccggcagtaggaggaatgcccttcaaggagtggtctattcagctaaccagtgcaaagccctcatcaccatcctggtggtcattggcgccttcatggtcacctggggcccctacatggttgtcattacctcagaggcactctgggggaagaactgtgtctccccaaccctggagacttgggccacatggctgtcctttaccagtgccatctgccaccctctgatctacggactctggaacaagactgtgcgcaaggagctcctgggcatgtgctttggggaccgttattaccgggaatcctttgtgcagcgacagaggacctccaggctcttcagcatttccaacaggatcacagacttgggtctgtccccacatctcacggcgctcatggcaggcggacagtccctgggacacagcagcagcaccggtgacacaggcttcagctactctcaggattcaggtaaggttgtaaaaaccctgaaaacccctcacttgtgtaagttggctgtgttaactgctgctgggagaccagccactccccaaggactgtggagggctgtggaggactgtggaggggagatggtaagaggcagaagc

SEQ ID NO: 240 - protein, 440 aa, Homo sapiens
MRPHLSPPLQQLLLPVLLACAAHSTGALPRLCDVLQVLWEEQDQCLQELSREQTGDLGTEQPVPGCEGMWDNISCWPSSVPGRMVEVECPRFLRMLTSRNGSLFRNCTQDGWSETFPRPNLACGVNVNDSSNEKRHSYLLKLKVMYTVGYSSSLVMLLVALGILCAFRRLHCTRNYIHMHLFVSFILRALSNFIKDAVLFSSDDVTYCDAHRAGCKLVMVLFQYCIMANYSWLLVEGLYLHTLLAISFFSERKYLQGFVAFGWGSPAIFVALWAIARHFLEDVGCWDINANASIWWIIRGPVILSILINFILFINILRILMRKLRTQETRGNEVSHYKRLARSTLLLIPLFGIHYIVFAFSPEDAMEIQLFFELALGSFQGLVVAVLYCFLNGEVQLEVQKKWQQWHLREFPLHPVASFSNSTKASHLEQSQGTCRTSII

SEQ ID NO: 241 - protein, 398 aa, Mus musculus
GALPRLCDVRRVLLEERAECLRELSEEKKALGPKTASGCERFWDNMSCWPSSALAQTVEVPCPKFLRMFSGRNGSLFRNCTKDGWSETFPRPDLACGVNMNGSFNERRHAYLLKLKVMYTVGYSSSLAMLLVALSILCSFRRLHCTRNYIHMHLFVSFILRALSNFIKDAVLFPADDVTYCDAHRNLWRLPLVPRAQSAPAALETRPLVRLLFSGLCQLPATDKWQSLGEVAGYWSSPAIFVALWAVTRHFLEDFGCWDINSNASIWWVIRGPVILSIVINFIFFINILRILMRKLRTQETRGNETHHYKRLAKSTLLLIPLFGIHYIVFAFSPEGAMEVQLFFELALGSFQGLVVAVLYCFLNGEVQLEVQKKWRQWHLQEFPLRPVALSNSFSNAT

SEQ ID NO: 242 - DNA, 1194 bp, Mus musculus
ggagctctgcccagattgtgtgatgtgcggcgtgtgctgctcgaggaacgggccgagtgcctgcgggaactctccgaagagaagaaggcgctgggcccgaagacagcatcaggctgtgagaggttttgggacaacatgagctgctggccctcctcggcactggcacagacagtggaagtgccatgtccgaagttcctgaggatgttctctggcagaaatgggtctctgttccggaactgcacaaaggatggctggtcagaaaccttccccaggcctgacctggcctgtggggtcaacatgaatggctcctttaatgagagacggcatgcatacctgctgaagctcaaggtcatgtacactgtaggctacagttcctccttggccatgctcctggtcgccctcagcatcctgtgctctttccggaggctgcactgcactcgcaactacatccacatgcacctgtttgtgtccttcatccttcgcgccctgtccaacttcatcaaggacgccgtactcttccccgcagatgacgtcacctactgtgatgcccacaggaatctgtggaggctgcctttggttccgagggctcagagcgccccagctgctctggaaactagacctctggtgagacttctcttttctggactctgccaactcccagctacagacaaatggcaaagtctgggagaagttgccggttattggagttctccagccatttttgttgctttgtgggctgtcaccagacactttctggaggactttggatgctgggacatcaactccaacgcttccatctggtgggtcattcgagggcctgtgattctgtccatcgtgatcaatttcatctttttcataaacattctaagaatcctgatgagaaaacttagaactcaagaaacaagaggaaatgaaacacaccattataagcgcctggccaagtccaccctcctgctgatccctctctttggcatccactacattgtcttcgccttctccccagagggtgccatggaggtccagctgttctttgaattggccctgggctccttccaggggctggtggtagctgtcctttactgcttcctcaatggtgaggtgcagctggaagttcagaaaaaatggcgccagtggcacctccaagagttcccgctgcgccctgtggccctcagcaactccttcagcaacgccacc

SEQ ID NO: 243 - protein, 373 aa, Homo sapiens
MANTTGEPEEVSGALSPPSASAYVKLVLLGLIMCVSLAGNAILSLLVLKERALHKAPYYFLLDLCLADGIRSAVCFPFVLASVRHGSSWTFSALSCKIVAFMAVLFCFHAAFMLFCISVTRYMAIAHHRFYAKRMTLWTCAAVICMAWTLSVAMAFPPVFDVGTYKFIREEDQCIFEHRYFKANDTLGFMLMLAVLMAATHAVYGKLLLFEYRHRKMKPVQMVPAISQNWTFHGPGATGQAAANWIAGFGRGPMPPTLLGIRQNGHAASRRLLGMDEVKGEKQLGRMFYAITLLFLLLWSPYIVACYWRVFVKACAVPHRYLATAVWMSFAQAAVNPIVCFLLNKDLKKCLRTHAPCWGTGGAPAPREPYCVM

SEQ ID NO: 244 - protein, 373 aa, Mus musculus
MANTTGEPEEVSGALSLPSASAYVKLVLLGLIMCVSLAGNAILSLLVLKERALHKAPYYFLLDLCLADGIRSAICFPFVLASVRHGSSWTFSALSCKIVAFMAVLFCFHAAFMLFCISVTRYMAIAHHRFYAKRMTLWTCAAVICMAWTLSVAMAFPPVFDVGTYKFIREEDQCIFEHRYFKANDTLGFMLMLAVLMAATHAVYGKLLLFEYRHRKMKPVQMVPAISQNWTFHGPGATGQAAANWIAGFGRGPMPPTLLGIRQNGHAASRRLLGMDEVKGEKQLGRMFYAITLLFLLLWSPYIVACYWRVFVKACAVPHRYLATAVWMSFAQAAVNPIVCFLLNKDLKKCLRTHAPCWGTGGAPAPREPYCVM

SEQ ID NO: 245 - DNA, 1119 bp, Mus musculus
atggccaacaccaccggagagcccgaagaggtgagcggcgcactgtctctgccatcagcatcggcttatgtgaagctggtgctgctgggactgatcatgtgtgtaagcctggcaggcaatgccatcttgtccctgctggtgctcaaggagcgtgccctgcacaaggctccttactactttctgctggacctgtgcctagccgatggcatacgctctgccatctgcttcccctttgtactggcttctgtgcgccatggctcctcatggaccttcagtgcactcagctgtaagattgtggcctttatggctgtgctcttttgcttccatgcggccttcatgctgttctgcatcagcgtcacccgctacatggccatcgcccaccaccgcttctatgccaagcgcatgacactctggacatgcgcagctgtcatctgcatggcctggaccttgtctgtggccatggctttcccacctgtctttgatgtgggcacctacaagtttatccgagaggaggaccagtgcatctttgagcatcgctacttcaaagcaaatgacacactgggctttatgcttatgttggctgtgctcatggcagccacacatgctgtctatggcaagctgctactcttcgagtatcgtcaccgcaagatgaagccagtgcagatggtgccagccatcagccaaaactggacattccatggccctggggctaccggccaggctgctgccaactggatcgctggttttggccgtgggcccatgccaccaactctgctgggtatccggcagaatgggcatgcagctagccggcggctactgggcatggacgaggtcaagggtgaaaagcagctgggccgaatgttctacgcgattacactgctcttcctgctcctctggtcaccatacattgtggcctgctactggcgagtgtttgtgaaagcctgcgctgtgccccaccgctacttggccactgctgtttggatgagcttcgcccaggctgccgtcaacccaatcgtctgcttcctgcttaacaaggacctcaagaagtgcctgaggactcatgccccttgctggggcacaggaggtgccccagctcccagagaaccctactgtgtcatg

SEQ ID NO: 246 - protein, 347 aa, Mus musculus
MNTPDPWSSPEVQFCFAAANSSCPRKARPALVVCAMYLIMIGAIVMTMLGNMAVIISIAHFKQLHSPTNFLILSMATTDFLLSCVVMPFSMIRSIESCWYFGDLFCKVHSCCDIMLCTTSIFHLCFISVDRHYAVCDPLHYVTQITTRVVGVFLLISWSVPIFFAFGLVFSELNLIGAEDFVAAIDCTGLCVLIFNKLWGVLASFIAFFLPGTVMVGIYIHIFTVAQKHARQIGTGPRTKQALSESKMKATSKKESKATKTLSIVMGVFVLCWLPFFVLTITDPFIDFTTPEDLYNVFLWLGYFNSTFNPIIYGMFYPWFRKALRMIVTGTIFRSDSSTSSLHPAHP

SEQ ID NO: 247 - DNA, 1041 bp, Mus musculus
atgaatacacccgacccctggagctccccagaagtacagttttgctttgctgctgcaaacagttcttgcccaaggaaggcgaggcctgcgctcgttgtctgtgccatgtacctcatcatgattggagcgatagtgatgaccatgctgggaaacatggctgtgatcatctctattgcccacttcaagcagctccactccccaaccaacttccttattctctccatggctaccacagacttcctgttgagttgcgtggtcatgcccttcagtatgatccggtccatcgagtcatgctggtacttcggagacctcttttgcaaagttcacagctgctgtgacatcatgctctgtaccacatccattttccacctctgcttcatctcagttgaccgccactatgccgtctgcgaccctttgcactacgtcacccaaatcacgacccgggtggtaggggtctttctactcatcagttggtctgttcccatcttttttgcctttggcttggtattctcagaattaaatctgattggtgctgaggattttgtcgcagccattgactgtacaggtttgtgtgtgttgatatttaacaagctctggggagttctggcttccttcatagctttctttctgcctgggacagtcatggtagggatttacatacacattttcacagttgcccagaaacatgccaggcagattggtacaggtcctaggacaaaacaggccctctcagaaagcaaaatgaaggccacatcaaaaaaggaaagcaaggccaccaagactttaagcattgtcatgggagtgtttgtgttgtgttggctacccttttttgtcttgacaatcacagaccctttcattgattttacaacccctgaagatttgtataatgttttcctttggcttggttattttaattccactttcaatcccatcatatatggcatgttctatccctggtttcgaaaggccctgaggatgatagtcacaggaacgatcttccgctctgactcttctacctcaagcctgcatcctgcacatcct

SEQ ID NO: 248 - protein, 348 aa, Homo sapiens
MVNNFSQAEAVELCYKNVNESCIKTPYSPGPRSILYAVLGFGAVLAAFGNLLVMIAILHFKQLHTPTNFLIASLACADFLVGVTVMPFSTVRSVESCWYFGDSYCKFHTCFDTSFCFASLFHLCCISVDRYIAVTDPLTYPTKFTVSVSGICIVLSWFFSVTYSFSIFYTGANEEGIEELVVALTCVGGCQAPLNQNWVLLCFLLFFIPNVAMVFIYSKIFLVAKHQARKIESTASQAQSSSESYKERVAKRERKAAKTLGIAMAAFLVSWLPYLVDAVIDAYMNFITPPYVYEILVWCVYYNSAMNPLIYAFFYQWFGKAIKLIVSGKVLRTDSSTTNLFSEEVETD

SEQ ID NO: 249 - protein, 348 aa, Mus musculus
MTSDFSPEPPMELCYENVNGSCIKSSYAPWPRAILYGVLGLGALLAVFGNLLVIIAILHFKQLHTPTNFLVASLACADFLVGVTVMPFSTVRSVESCWYFGESYCKFHTCFDTSFCFASLFHLCCISIDRYIAVTDPLTYPTKFTVSVSGLCIALSWFFSVTYSFSIFYTGANEEGIEELVVALTCVGGCQAPLNQNWVLLCFLLFFLPTVVMVFLYGRIFLVAKYQARKIEGTANQAQASSESYKERVAKRERKAAKTLGIAMAAFLVSWLPYIIDAVIDAYMNFITPAYVYEILVWCVYYNSAMNPLIYAFFYPWFRKAIKLIVSGKVFRADSSTTNLFSEEAGAG

SEQ ID NO: 250 - DNA, 1044 bp, Mus musculus
atgacaagcgacttctccccagaaccgcccatggagctctgctatgagaatgtgaacggatcctgcattaaaagctcttacgcaccctggcctcgagccatcctctatggggtcctcggtttgggagccctgctggcagtgtttgggaacttactggtcatcattgccatcctccactttaaacagctgcacacgcctacgaacttcctggtggcctccctggcctgtgctgacttcttggtgggggtgacagtgatgcccttcagcacggtgcgttctgtggagagctgctggtactttggggagagttactgtaagttccacacgtgtttcgacacctccttctgttttgcgtctctgtttcatttatgctgcatctccattgaccggtacattgcagttacagatccactgacctatccgaccaagttcactgtatcggtttctggactgtgcattgctctctcttggttcttttctgtcacatacagcttttccatcttttacacgggagccaatgaggaagggattgaggaattagtggttgctctgacctgtgtgggaggctgccaggctccactgaatcaaaattgggttttactttgtttccttttgttctttctgcccactgtggtcatggtgtttctatatggtcggatatttttggtggcaaagtatcaggctaggaagatagagggtacagccaaccaagctcaggcctcctctgagagctataaggaaagagtagccaaaagagagaggaaggctgccaagaccttggggatcgccatggctgcatttctcgtgtcctggctgccatacattattgatgcggttattgacgcttacatgaacttcataactcctgcgtacgtctatgagatattagtgtggtgtgtttactacaattcagctatgaaccccttgatatacgcctttttttatccttggtttcgtaaggcaataaaacttattgtgagtggcaaagtcttcagggctgattcatcaacaactaatctattctctgaagaggcaggtgcaggt

SEQ ID NO: 251 - protein, 445 aa, Homo sapiens
MRVSVPGPAAAAAPAAGREPSTPGGGSGGGGAVAAASGAAVPGSVQLALSVLHALLYAALFAFAYLQLWRLLLYRERRLSYQSLCLFLCLLWAALRTTLFSAAFSLSGSLPLLRPPAHLHFFPHWLLYCFPSCLQFSTLCLLNLYLAEVICKVRCATELDRHKILLHLGFIMASLLFLVVNLTCAMLVHGDVPENQLKWTVFVRALINDSLFILCAISLVCYICKITKMSSANVYLESKITGSHSFLWLNSTPLCGMSLCQTVIVGSVVILLYSSRACYNLVVVTISQDTLESPFNYGWDNLSDKAHVEDISGEEYIVFGMVLFLWEHVPAWSVVLFFRAQRLNQNLAPAGMINSHSYSSRAYFFDNPRRYDSDDDLPRLGSSREGSLPNSQSLGWYGTMTGCGSSSYTVTPHLNGPMTDTAPLLFTCSNLDLNNHHSLYVTPQN

SEQ ID NO: 252 - protein, 422 aa, Mus musculus
MRVSVSGPAAAAVPTAGREPSTSGGGAVAASGAAVPGSVQLALSVLHALLYAALFAFAYLQLWRLLLYRERRLSYQSLCLFLCLAWAALRTTLFSAAFSLSGSLPLLRPPSRLHFFPHWLLYCFPSCLQFSTLCLLNLYLAEVICKVRCATELDKHKILLHLGFILASLLFLAVNLTCAMLVHGDVPINLKWTVFIRALINDSLFILCAISLVSYICKITKMSSANVYLESKGMSLCQTVIVGSVVILLYSSRACYNLVVITISQDTLESPFNYGWDNLSDKAQGEDGNGGDYIVFGMVLFLWEHVPAWSVVLFFRAQRLNQNLAPAGMISSHSYSSRAFFFDNPRRYDSDDDLPRLGNSREGSLSNSQTLGWYGTMTGCGGGTYTVTPPLNGPVTDTAPLLFTCSNLDIRNHHSLYVTPQN

SEQ ID NO: 253 - DNA, 1540 bp, Mus musculus
agtgcggagcgagcgcctcaaaagctcgggtttctcagctgattgtctccagccgagagttgtttgctgctgctgcggagccgagccgcggcccgaggaaccgagccccccggggggaaggggaggcgggcccgagggcagccgcggccatcgcgcggggctgcgactcctgtcacggcgctgcccggggccgcaggctggggcgggcgggaggtccggggggcgctcgggccgcttccttcccgcgctccctccccgctgctcgcgtcccctcatgagggtatcagtgtccgggccggcggccgccgcggtccccacggccggccgcgaaccctcgacgtccggcgggggcgccgtcgcggcctcgggcgccgcggttcccggttcggtgcagctggcgctgagcgtgctgcacgcgctgctctacgccgcgctcttcgcctttgcctacctgcagctgtggcggctgctcctgtaccgcgagcggcggctcagttaccagagcctctgcctcttcctgtgtctcgcgtgggcagcgctcaggaccacgctcttctcggccgccttctccctcagcggctctctgcccctgctgcggccaccctctcgcctgcacttcttcccgcactggctgctctactgcttcccctcctgcctacagttctccacgctctgtctcctcaacctctacctggcagaggtgatatgtaaagtcagatgtgccactgaacttgacaaacacaaaattctactgcatttgggctttatactggcaagcctcctcttcttagcagtgaacttgacctgtgcaatgctagtccacggagatgtcccaatcaatcttaaatggactgtgtttattcgagcactaattaacgatagcctgtttattctctgtgccatctctttagttagctacatatgcaaaattacaaaaatgtcatcagcaaatgtctacctcgaatcaaagggtatgtctctgtgccagactgtcatcgtgggctctgtagtcattcttctctactcttccagagcttgttataatctggtagtgatcaccatatcacaggataccttagagagtccatttaattatggctgggataatctttcagataaggctcagggagaagacggaaatggaggagactacattgtctttggaatggtcctctttctgtgggagcatgtaccagcatggtcagtggtactatttttccgggcacagagattaaaccagaatctggcacctgctggcatgataagcagccacagctacagctccagggctttctttttcgacaatccaagacggtatgacagtgacgacgacttgccaagactggggaactcacgggaaggaagtttatcaaactcgcaaactttgggctggtacggcaccatgactgggtgtggcggcggcacctacacagtcacacccccactgaatggacctgtgacagacactgctcctttgctcttcacgtgcagtaatttagatataaggaatcaccatagcttatacgtaactccacagaac

SEQ ID NO: 254 - protein, 468 aa, Homo sapiens
MAGVVHVSLAALLLLPMAPAMHSDCIFKKEQAMCLEKIQRANELMGFNDSSPGCPGMWDNITCWKPAHVGEMVLVSCPELFRIFNPDQVWETETIGESDFGDSNSLDLSDMGVVSRNCTEDGWSEPFPHYFDACGFDEYESETGDQDYYYLSVKALYTVGYSTSLVTLTTAMVILCRFRKLHCTRNFIHMNLFVSFMLRAISVFIKDWILYAEQDSNHCFISTVECKAVMVFFHYCVVSNYFWLFIEGLYLFTLLVETFFPERRYFYWYTIIGWGTPTVCVTVWATLRLYFDDTGCWDMNDSTALWWVIKGPVVGSIMVNFVLFIGIIVILVQKLQSPDMGGNESSIYLRLARSTLLLIPLFGIHYTVFAFSPENVSKRERLVFELGLGSFQGFVVAVLYCFLNGEVQAEIKRKWRSWKVNRYFAVDFKHRHPSLASSGVNGGTQLSILSKSSSQIRMSGLPADNLAT

SEQ ID NO: 255 - protein, 496 aa, Mus musculus
MARTLQLSLTALLLLPMAIAMHSDCIFKKEQAMCLERIQRANDLMGLNESSPGCPGMWDNITCWKPAQIGEMVLVSCPEVFRIFNPDQVWMTETIGDSGFADSNSLEITDMGVVGRNCTEDGWSEPFPHYFDACGFDDYEPESGDQDYYYLSVKALYTVGYSTSLVTLTTAMVILCRFRKLHCTRNFIHMNLFVSFMLRAISVFIKDWILYAEQDSSHCFVSTVECKAVMVFFHYCVVSNYFWLFIEGLYLFTLLVETFFPERRYFYWYTIIGWGTPTVCVTVWAVLRLYFDDAGCWDMNDSTALWWVIKGPVVGSIMVNFVLFIGIIIILVQKLQSPDMGGNESSIYFSCVQKCYCKPQRAQQHSCKMSELSTITLRLARSTLLLIPLFGIHYTVFAFSPENVSKRERLVFELGLGSFQGFVVAVLYCFLNGEVQAEIKRKWRSWKVNRYFTMDFKHRHPSLASSGVNGGTQLSILSKSSSQLRMSSLPADNLAT

SEQ ID NO: 256 - protein, 404 aa, Homo sapiens
MSVKPSWGPGPSEGVTAVPTSDLGEIHNWTELLDLFNHTLSECHVELSQSTKRVVLFALYLAMFVVGLVENLLVICVNWRGSGRAGLMNLYILNMAIADLGIVLSLPVWMLEVTLDYTWLWGSFSCRFTHYFYFVNMYSSIFFLVCLSVDRYVTLTSASPSWQRYQHRVRRAMCAGIWVLSAIIPLPEVVHIQLVEGPEPMCLFMAPFETYSTWALAVALSTTILGFLLPFPLITVFNVLTACRLRQPGQPKSRRHCLLLCAYVAVFVMCWLPYHVTLLLLTLHGTHISLHCHLVHLLYFFYDVIDCFSMLHCVINPILYNFLSPHFRGRLLNAVVHYLPKDQTKAGTCASSSSCSTQHSIIITKGDSQPAAAAPHPEPSLSFQAHHLLPNTSPISPTQPLTPS

SEQ ID NO: 257 - protein, 395 aa, Mus musculus
MSVIPSPRPVSTLEPDNDFRDIHNWTELLHLFNQTFTDCHIEFNENTKHVVLFVFYLAIFVVGLVENVLVICVNCRRSGRVGMLNLYILNMAIADLGIILSLPVWMLEVMLEYTWLWGSFSCRFIHYFYLVNMYSSIFFLTCLSIDRYVTLTNTSPSWQRHQHRIRRAVCAGVWVLSAIIPLPEVVHIQLLDGSEPMCLFLAPFETYSAWALAVALSATILGFLLPFLLIAVFNILTACRLRRQRQTESRRHCLLMWAYIVVFAICWLPYQVTMLLLTLHGTHIFLHCHLVNLLYFFYEIIDCFSMLHCVANPILYNFLSPSFRGRLLSLVVRYLPKEQARAAGGRASSSSSTQHSIIITKEGSLPLQRISTPTPSETFRRPLRLQTPHLHSAIL

SEQ ID NO: 258 - protein, 326 aa, Homo sapiens
MPPSISAFQAAYIGIEVLIALVSVPGNVLVIWAVKVNQALRDATFCFIVSLAVADVAVGALVIPLAILINIGPQTYFHTCLMVACPVLILTQSSILALLAIAVDRYLRVKIPLRYKMVVTPRRAAVAIAGCWILSFVVGLTPMFGWNNLSAVERAWAANGSMGEPVIKCEFEKVISMEYMVYFNFFVWVLPPLLLMVLIYLEVFYLIRKQLNKKVSASSGDPQKYYGKELKIAKSLALILFLFALSWLPLHILNCITLFCPSCHKPSILTYIAIFLTHGNSAMNPIVYAFRIQKFRVTFLKIWNDHFRCQPAPPIDEDLPEERPDD

SEQ ID NO: 259 - protein, 326 aa, Mus musculus
MPPYISAFQAAYIGIEVLIALVSVPGNVLVIWAVKVNQALRDATFCFIVSLAVADVAVGALVIPLAILINIGPQTYFHTCLMVACPVLILTQSSILALLAIAVDRYLRVKIPLRYKTVVTQRRAAVAIAGCWILSLVVGLTPMFGWNNLSEVEQAWIANGSVGEPVIKCEFEKVISMEYMVYFNFFVWVLPPLLLMVLIYLEVFYLIRKQLNKKVSASSGDPQKYYGKELKIAKSLALILFLFALSWLPLHILNCITLFCPTCQKPSILIYIAIFLTHGNSAMNPIVYAFRIHKFRVTFLKIWNDHFRCQPKPPIEEDIPEEKAED

SEQ ID NO: 260 - protein, 412 aa, Homo sapiens
MPIMGSSVYITVELAIAVLAILGNVLVCWAVWLNSNLQNVTNYFVVSLAAADIAVGVLAIPFAITISTGFCAACHGCLFIACFVLVLTQSSIFSLLAIAIDRYIAIRIPLRYNGLVTGTRAKGIIAICWVLSFAIGLTPMLGWNNCGQPKEGKNHSQGCGEGQVACLFEDVVPMNYMVYFNFFACVLVPLLLMLGVYLRIFLAARRQLKQMESQPLPGERARSTLQKEVHAAKSLAIIVGLFALCWLPLHIINCFTFFCPDCSHAPLWLMYLAIVLSHTNSVVNPFIYAYRIREFRQTFRKIIRSHVLRQQEPFKAAGTSARVLAAHGSDGEQVSLRLNGHPPGVWANGSAPHPERRPNGYALGLVSGGSAQESQGNTGLPDVELLSHELKGVCPEPPGLDDPLAQDGAGVS

SEQ ID NO: 261 - protein, 410 aa, Mus musculus
MGSSVYIMVELAIAVLAILGNVLVCWAVWINSNLQNVTNFFVVSLAAADIAVGVLAIPFAITISTGFCAACHGCLFIACFVLVLTQSSIFSLLAIAIDRYIAIRIPLRYNGLVTGMKAKGIIAICWVLSFAIGLTPMLGWNNCSQTDENSTKTCGEGRVTCLFEDVVPMNYMVYYNFFAFVLLPLLLMLAIYLRIFLAARRQLKQMESQPLPGERTRSTLQKEVHAAKSLAIIVGLFALCWLPLHIINCFTFFCSTCQHAPPWLMYLAIILSHSNSVVNPFIYAYRIREFRQTFRKIIRTHVLRRQEPFRAGGSSAWALAAHSTEGEQVSLRLNGHPLGVWANGSAPHSGRRPNGYTLGPGGGGSTQGSPGDVELLTQEHQEGQEHPGLGDHLAQGRVGTASWSSEFAPS

SEQ ID NO: 262 - protein, 332 aa, Homo sapiens
MLLETQDALYVALELVIAALSVAGNVLVCAAVGTANTLQTPTNYFLVSLAAADVAVGLFAIPFAITISLGFCTDFYGCLFLACFVLVLTQSSIFSLLAVAVDRYLAICVPLRYKSLVTGTRARGVIAVLWVLAFGIGLTPFLGWNSKDSATNNCTEPWDGTTNESCCLVKCLFENVVPMSYMVYFNFFGCVLPPLLIMLVIYIKIFLVACRQLQRTELMDHSRTTLQREIHAAKSLAMIVGIFALCWLPVHAVNCVTLFQPAQGKNKPKWAMNMAILLSHANSVVNPIVYAYRNRDFRYTFHKIISRYLLCQADVKSGNGQAGVQPALGVGL

SEQ ID NO: 263 - protein, 332 aa, Mus musculus
MQLETQDALYVALELVIAALAVAGNVLVCAAVGASSALQTPTNYFLVSLATADVAVGLFAIPFAITISLGFCTDFHGCLFLACFVLVLTQSSIFSLLAVAVDRYLAIRVPLRYKGLVTGTRARGIIAVLWVLAFGIGLTPFLGWNSKDSATSNCTELGDGIANKSCCPLTCLFENVVPMSYMVYFNFFGCVLPPLLIMLVIYIKIFMVACKQLQSMELMDHSRTTLQREIHAAKSLAMIVGIFALCWLPVHAINCITLFHPALAKDKPKWVMNVAILLSHANSVVNPIVYAYRNRDFRYSFHKIISRYVLCQAETKGGSGQAGAQSTLSLGL

SEQ ID NO: 264 - protein, 318 aa, Homo sapiens
MPNNSTALSLANVTYITMEIFIGLCAIVGNVLVICVVKLNPSLQTTTFYFIVSLALADIAVGVLVMPLAIVVSLGITIHFYSCLFMTCLLLIFTHASIMSLLAIAVDRYLRVKLTVRYKRVTTHRRIWLALGLCWLVSFLVGLTPMFGWNMKLTSEYHRNVTFLSCQFVSVMRMDYMVYFSFLTWIFIPLVVMCAIYLDIFYIIRNKLSLNLSNSKETGAFYGREFKTAKSLFLVLFLFALSWLPLSIINCIIYFNGEVPQLVLYMGILLSHANSMMNPIVYAYKIKKFKETYLLILKACVVCHPSDSLDTSIEKNSE

SEQ ID NO: 265 - protein, 319 aa, Mus musculus
MEADNTTETDWLNITYITMEAAIGLCAVVGNMLVIWVVKLNPTLRTTTVYFIVSLALADIAVGVLVIPLAIAVSLQVKMHFYACLFMSCVLLIFTHASIMSLLAIAVHRYLRVKLTVRYRTVTTQRRIWLFLGLCWLVSFLVGLTPMFGWNRKATLASSQNSSTLLCHFRSVVSLDYMVFFSFITWILVPLVVMCIIYLDIFYIIRNKLSQNLTGFRETRAFYGREFKTAKSLFLVLFLFALCWLPLSIINFVSYFDVKIPDVAMCLGILLSHANSMMNPIVYACKIKKFKETYFLILRAVRLCQTSDSLDSNMEQTTE

SEQ ID NO: 266 - protein, 466 aa, Homo sapiens
MVFLSGNASDSSNCTQPPAPVNISKAILLGVILGGLILFGVLGNILVILSVACHRHLHSVTHYYIVNLAVADLLLTSTVLPFSAIFEVLGYWAFGRVFCNIWAAVDVLCCTASIMGLCIISIDRYIGVSYPLRYPTIVTQRRGLMALLCVWALSLVISIGPLFGWRQPAPEDETICQINEEPGYVLFSALGSFYLPLAIILVMYCRVYVVAKRESRGLKSGLKTDKSDSEQVTLRIHRKNAPAGGSGMASAKTKTHFSVRLLKFSREKKAAKTLGIVVGCFVLCWLPFFLVMPIGSFFPDFKPSETVFKIVFWLGYLNSCINPIIYPCSSQEFKKAFQNVLRIQCLCRKQSSKHALGYTLHPPSQAVEGQHKDMVRIPVGSRETFYRISKTDGVCEWKFFSSMPRGSARITVSKDQSSCTTARVRSKSFLQVCCCVGPSTPSLDKNHQVPTIKVHTISLSENGEEV

SEQ ID NO: 267 - protein, 466 aa, Mus musculus
MVLLSENASEGSNCTHPPAQVNISKAILLGVILGGLIIFGVLGNILVILSVACHRHLHSVTHYYIVNLAVADLLLTSTVLPFSAIFEILGYWAFGRVFCNIWAAVDVLCCTASIMGLCIISIDRYIGVSYPLRYPTIVTQRRGVRALLCVWALSLVISIGPLFGWRQQAPEDETICQINEEPGYVLFSALGSFYVPLTIILVMYCRVYVVAKRESRGLKSGLKTDKSDSEQVTLRIHRKNVPAEGSGVSSAKNKTHFSVRLLKFSREKKAAKTLGIVVGCFVLCWLPFFLVMPIGSFFPNFKPPETVFKIVFWLGYLNSCINPIIYPCSSQEFKKAFQNVLRIQCLRRRQSSKHALGYTLHPPSQAVEEQHRGMVRIPVGSGETFYKISKTDGVCEWKFFSSMPQGSARITMPKDQSACTTARVRSKSFLQVCCCVGSSTPRPEENHQVPTIKIHTISLGENGEEV

SEQ ID NO: 268 - protein, 519 aa, Homo sapiens
MNPDLDTGHNTSAPAHWGELKNANFTGPNQTSSNSTLPQLDITRAISVGLVLGAFILFAIVGNILVILSVACNRHLRTPTNYFIVNLAMADLLLSFTVLPFSAALEVLGYWVLGRIFCDIWAAVDVLCCTASILSLCAISIDRYIGVRYSLQYPTLVTRRKAILALLSVWVLSTVISIGPLLGWKEPAPNDDKECGVTEEPFYALFSSLGSFYIPLAVILVMYCRVYIVAKRTTKNLEAGVMKEMSNSKELTLRIHSKNFHEDTLSSTKAKGHNPRSSIAVKLFKFSREKKAAKTLGIVVGMFILCWLPFFIALPLGSLFSTLKPPDAVFKVVFWLGYFNSCLNPIIYPCSSKEFKRAFVRILGCQCRGRRRRRRRRRRLGGCAYTYRPWTRGGSLERSQSRKDSLDDSGSCLSGSQRTLPSASPSPGYLGRGAPPPVELCAFPEWKAPGALLSLPAPEPPGRRGRHDSGPLFTFKLLTEPESPGTDGGASNGGCEAAADVANGQPGFKSNMPLAPGQF

SEQ ID NO: 269 - protein, 514 aa, Mus musculus
MNPDLDTGHNTSAPAHWGELKDANFTGPNQTSSNSTLPQLDVTRAISVGCLGAFILFAIVGNILVILSVACNRHLRTPTNYFIVNLAIADLLLSFTDLPFSATLEVLGYWVLGRIFCDIWAAVDVLCCTASILSLCAISIDRYIGVRYSLQYPTLVTRRKAILALLSVWVLSTVISIGPLLGWKEPAPNDDKECGVTEEPFYALFSSLGSFYIPLAVILVMYCRVYIVAKRTTKNLEAGVMKEMSNSKELTLRIHSKNFHEDTLSSTKAKGHNPRSSIAVKLFKFSREKKAAKTLGIVVGMFILCWLPFFIALPLGSLFSTLKPPDAVFKVVFWLGYFNSCLNPIIYPCSSKEFKRAFMRILGCQCRGGRRRRRRRRLGACAYTYRPWTRGGSLERSQSRKDSLDDSGSCMSGSQRTLPSASPSPGYLGRGTQPPVELCAFPEWKPGALLSLPEPPGRRGRLDSGPLFTFKLLGEPESPGTEGDASNGGCDTTTDLANGQPGFKSNMPLAPGHF

SEQ ID NO: 270 - protein, 572 aa, Homo sapiens
MTFRDLLSVSFEGPRPDSSAGGSSAGGGGGSAGGAAPSEGPAVGGVPGGAGGGGGVVGAGSGEDNRSSAGEPGSAGAGGDVNGTAAVGGLVVSAQGVGVGVFLAAFILMAVAGNLLVILSVACNRHLQTVTNYFIVNLAVADLLLSATVLPFSATMEVLGFWAFGRAFCDVWAAVDVLCCTASILSLCTISVDRYVGVRHSLKYPAIMTERKAAAILALLWVVALVVSVGPLLGWKEPVPPDERFCGITEEAGYAVFSSVCSFYLPMAVIVVMYCRVYVVARSTTRSLEAGVKRERGKASEVVLRIHCRGAATGADGAHGMRSAKGHTFRSSLSVRLLKFSREKKAAKTLAIVVGVFVLCWFPFFFVLPLGSLFPQLKPSEGVFKVIFWLGYFNSCVNPLIYPCSSREFKRAFLRLLRCQCRRRRRRRPLWRVYGHHWRASTSGLRQDCAPSSGDAPPGAPLALTALPDPDPEPPGTPEMQAPVASRRKPPSAFREWRLLGPFRRPTTQLRAKVSSLSHKIRAGGAQRAEAACAQRSEVEAVSLGVPHEVAEGATCQAYELADYSNLRETDI

SEQ ID NO: 271 - protein, 562 aa, Mus musculus
MTFRDILSVTFEGPRASSSTGGSGAGGGAGTVGPEGPAVGGVPGATGGSAVVGTGSGEDNQSSTAEAGAAASGEVNGSAAVGGLVVSAQGVGVGVFLAAFILTAVAGNLLVILSVACNRHLQTVTNYFIVNLAVADLLLSAAVLPFSATMEVLGFWPFGRTFCDVWAAVDVLCCTASILSLCTISVDRYVGVRHSLKYPAIMTERKAAAILALLWAVALVVSVGPLLGWKEPVPPDERFCGITEEVGYAIFSSVCSFYLPMAVIVVMYCRVYVVARSTTRSLEAGIKREPGKASEVVLRIHCRGAATSAKGNPGTQSSKGHTLRSSLSVRLLKFSREKKAAKTLAIVVGVFVLCWFPFFFVLPLGSLFPQLKPSEGVFKVIFWLGYFNSCVNPLIYPCSSREFKRAFLRLLRCQCRRRRRRLWPSLRPPLASLDRRPALRLCPQPAHRTPRGSPSPHCTPRPGLRRHAGGAGFGLRPSKASLRLREWRLLGPLQRPTTQLRAKVSSLSHKFRSGGARRAETACALRSEVEAVSLNVPQDGAEAVICQAYEPGDLSNLRETDI

SEQ ID NO: 272 - protein, 450 aa, Homo sapiens
MGSLQPDAGNASWNGTEAPGGGARATPYSLQVTLTLVCLAGLLMLLTVFGNVLVIIAVFTSRALKAPQNLFLVSLASADILVATLVIPFSLANEVMGYWYFGKAWCEIYLALDVLFCTSSIVHLCAISLDRYWSITQAIEYNLKRTPRRIKAIIITVWVISAVISFPPLISIEKKGGGGGPQPAEPRCEINDQKWYVISSCIGSFFAPCLIMILVYVRIYQIAKRRTRVPPSRRGPDAVAAPPGGTERRPNGLGPERSAGPGGAEAEPLPTQLNGAPGEPAPAGPRDTDALDLEESSSSDHAERPPGPRRPERGPRGKGKARASQVKPGDSLPRRGPGATGIGTPAAGPGEERVGAAKASRWRGRQNREKRFTFVLAVVIGVFVVCWFPFFFTYTLTAVGCSVPRTLFKFFFWFGYCNSSLNPVIYTIFNHDFRRAFKKILCRGDRKRIV

SEQ ID NO: 273 - protein, 450 aa, Mus musculus
MGSLQPDAGNSSWNGTEAPGGGTRATPYSLQVTLTLVCLAGLLMLFTVFGNVLVIIAVFTSRALKAPQNLFLVSLASADILVATLVIPFSLANEVMGYWYFGKVWCEIYLALDVLFCTSSIVHLCAISLDRYWSITQAIEYNLKRTPRRIKAIIVTVWVISAVISFPPLISIEKKGAGGGQQPAEPSCKINDQKWYVISSSIGSFFAPCLIMILVYVRIYQIAKRRTRVPPSRRGPDACSAPPGGADRRPNGLGPERGAGPTGAEAEPLPTQLNGAPGEPAPAGPRDGDALDLEESSSSEHAERPPGPRRPDRGPRAKGKTRASQVKPGDSLPRRGPGAAGPGASGSGHGEERGGGAKASRWRGRQNREKRFTFVLAVVIGVFVVCWFPFFFTYTLIAVGCPVPSQLFNFFFWFGYCNSSLNPVIYTIFNHDFRRAFKKILCRGDRKRIV

SEQ ID NO: 274 - protein, 450 aa, Homo sapiens
MDHQDPYSVQATAAIAAAITFLILFTIFGNALVILAVLTSRSLRAPQNLFLVSLAAADILVATLIIPFSLANELLGYWYFRRTWCEVYLALDVLFCTSSIVHLCAISLDRYWAVSRALEYNSKRTPRRIKCIILTVWLIAAVISLPPLIYKGDQGPQPRGRPQCKLNQEAWYILASSIGSFFAPCLIMILVYLRIYLIAKRSNRRGPRAKGGPGQGESKQPRPDHGGALASAKLPALASVASAREVNGHSKSTGEKEEGETPEDTGTRALPPSWAALPNSGQGQKEGVCGASPEDEAEEEEEEEEEEEECEPQAVPVSPASACSPPLQQPQGSRVLATLRGQVLLGRGVGAIGGQWWRRRAHVTREKRFTFVLAVVIGVFVLCWFPFFFSYSLGAICPKHCKVPHGLFQFFFWIGYCNSSLNPVIYTIFNQDFRRAFRRILCRPWTQTAW

SEQ ID NO: 275 - protein, 448 aa, Mus musculus
MVHQEPYSVQATAAIASAITFLILFTIFGNALVILAVLTSRSLRAPQNLFLVSLAAADILVATLIIPFSLANELLGYWYFWRAWCEVYLALDVLFCTSSIVHLCAISLDRYWAVSRALEYNSKRTPRRIKCIILTVWLIAAVISLPPLIYKGDQRPEPHGLPQCELNQEAWYILASSIGSFFAPCLIMILVYLRIYVIAKRSHCRGLGAKRGSGEGESKKPRPAAGGVPASAKVPTLVSPLSSVGEANGHPKPPREKEEGETPEDPEARALPPNWSALPRSVQDQKKGTSGATAEKGAEEDEEEVEECEPQTLPASPASVFNPPLQQPQTSRVLATLRGQVLLSKNVGVASGQWWRRRTQLSREKRFTFVLAVVIGVFVVCWFPFFFSYSLGAICPQHCKVPHGLFQFFFWIGYCNSSLNPVIYTIFNQDFRRAFRRILCRQWTQTGW

SEQ ID NO: 276 - protein, 461 aa, Homo sapiens
MASPALAAALAVAAAAGPNASGAGERGSGGVANASGASWGPPRGQYSAGAVAGLAAVVGFLIVFTVVGNVLVVIAVLTSRALRAPQNLFLVSLASADILVATLVMPFSLANELMAYWYFGQVWCGVYLALDVLFCTSSIVHLCAISLDRYWSVTQAVEYNLKRTPRRVKATIVAVWLISAVISFPPLVSLYRQPDGAAYPQCGLNDETWYILSSCIGSFFAPCLIMGLVYARIYRVAKRRTRTLSEKRAPVGPDGASPTTENGLGAAAGEARTGTARPRPPTWSRTRAAQRPRGGAPGPLRRGGRRRAGAEGGAGGADGQGAGPGAAQSGALTASRSPGPGGRLSRASSRSVEFFLSRRRRARSSVCRRKVAQAREKRFTFVLAVVMGVFVLCWFPFFFIYSLYGICREACQVPGPLFKFFFWIGYCNSSLNPVIYTVFNQDFRPSFKHILFRRRRRGFRQ

SEQ ID NO: 277 - protein, 458 aa, Mus musculus
MASPALAAALAAAAAEGPNGSDAGEWGSGGGANASGTDWVPPPGQYSAGAVAGLAAVVGFLIVFTVVGNVLVVIAVLTSRALRAPQNLFLVSLASADILVATLVMPFSLANELMAYWYFGQVWCGVYLALDVLFCTSSIVHLCAISLDRYWSVTQAVEYNLKRTPRRVKATIVAVWLISAVISFPPLVSFYRRPDGAAYPQCGLNDETWYILSSCIGSFFAPCLIMGLVYARIYRVAKLRTRTLSEKRGPAGPDGASPTTENGLGKAAGENGHCAPPRTEVEPDESSAAERRRRRGALRRGGRRREGAEGDTGSADGPGPGLAAEQGARTASRSPGPGGRLSRASSRSVEFFLSRRRRARSSVCRRKVAQAREKRFTFVLAVVMGVFVLCWFPFFFSYSLYGICREACQLPEPLFKFFFWIGYCNSSLNPVIYTVFNQDFRRSFKHILFRRRRRGFRQ

SEQ ID NO: 278 - protein, 477 aa, Homo sapiens
MGAGVLVLGASEPGNLSSAAPLPDGAATAARLLVPASPPASLLPPASESPEPLSQQWTAGMGLLMALIVLLIVAGNVLVIVAIAKTPRLQTLTNLFIMSLASADLVMGLLVVPFGATIVVWGRWEYGSFFCELWTSVDVLCVTASIETLCVIALDRYLAITSPFRYQSLLTRARARGLVCTVWAISALVSFLPILMHWWRAESDEARRCYNDPKCCDFVTNRAYAIASSVVSFYVPLCIMAFVYLRVFREAQKQVKKIDSCERRFLGGPARPPSPSPSPVPAPAPPPGPPRPAAAAATAPLANGRAGKRRPSRLVALREQKALKTLGIIMGVFTLCWLPFFLANVVKAFHRELVPDRLFVFFNWLGYANSAFNPIIYCRSPDFRKAFQGLLCCARRAARRRHATHGDRPRASGCLARPGPPPSPGAASDDDDDDVVGATPPARLLEPWAGCNGGAAADSDSSLDEPCRPGFASESKV

SEQ ID NO: 279 - protein, 466 aa, Mus musculus
MGAGALALGASEPCNLSSAAPLPDGAATAARLLVLASPPASLLPPASEGSAPLSQQWTAGMGLLVALIVLLIVVGNVLVIVAIAKTPRLQTLTNLFIMSLASADLVMGLLVVPFGATIVVWGRWEYGSFFCELWTSVDVLCVTASIETLCVIALDRYLAITSPFRYQSLLTRARARALVCTVWAISALVSFLPILMHWWRAESDEARRCYNDPKCCDFVTNRAYAIASSVVSFYVPLCIMAFVYLRVFREAQKQVKKIDSCERRFLGGPARPPSPEPSPSPGPPRPADSLANGRSSKRRPSRLVALREQKALKTLGIIMGVFTLCWLPFFLANVVKAFHRDLVPDRLFVFFNWLGYANSAFNPIIYCRSPDFRKAFQRLLCCARRAACRRRAAHGDRPRASGCLARAGPPPSPGAPSDDDDDDAGTTPPARLLEPWTGCNGGTTTVDSDSSLDEPGRQGFSSESKV

SEQ ID NO: 280 - protein, 413 aa, Homo sapiens
MGQPGNGSAFLLAPNRSHAPDHDVTQQRDEVWVVGMGIVMSLIVLAIVFGNVLVITAIAKFERLQTVTNYFITSLACADLVMGLAVVPFGAAHILMKMWTFGNFWCEFWTSIDVLCVTASIETLCVIAVDRYFAITSPFKYQSLLTKNKARVIILMVWIVSGLTSFLPIQMHWYRATHQEAINCYANETCCDFFTNQAYAIASSIVSFYVPLVIMVFVYSRVFQEAKRQLQKIDKSEGRFHVQNLSQVEQDGRTGHGLRRSSKFCLKEHKALKTLGIIMGTFTLCWLPFFIVNIVHVIQDNLIRKEVYILLNWIGYVNSGFNPLIYCRSPDFRIAFQELLCLRRSSLKAYGNGYSSNGNTGEQSGYHVEQEKENKLLCEDLPGTEDFVGHQGTVPSDNIDSQGRNCSTNDSLL

SEQ ID NO: 281 - protein, 418 aa, Mus musculus
MGPHGNDSDFLLAPNGSRAPDHDVTQERDEAWVVGMAILMSVIVLAIVFGNVLVITAIAKFERLQTVTNYFIISLACADLVMGLAVVPFGASHILMKMWNFGNFWCEFWTSIDVLCVTASIETLCVIAVDRYVAITSPFKYQSLLTKNKARVVILMVWIVSGLTSFLPIQMHWYRATHKKAIDCYTEETCCDFFTNQAYAIASSIVSFYVPLCVMVFVYSRVFQVAKRQLQKIDKSEGRFHAQNLSQVEQDGRSGHGLRRSSKFCLKEHKALKTLGIIMGTFTLCWLPFFIVNIVHVIRDNLIPKEVYILLNWLGYVNSAFNPLIYCRSPDFRIAFQELLCLRRSSSKTYGNGYSSNSNGRTDYTGEPNTCQLGQEREQELLCEDPPGMEGFVNCQGTVPSLSVDSQGRNCSTNDSPL

SEQ ID NO: 282 - protein, 408 aa, Homo sapiens
MAPWPHENSSLAPWPDLPTLAPNTANTSGLPGVPWEAALAGALLALAVLATVGGNLLVIVAIAWTPRLQTMTNVFVTSLAAADLVMGLLVVPPAATLALTGHWPLGATGCELWTSVDVLCVTASIETLCALAVDRYLAVTNPLRYGALVTKRCARTAVVLVWVVSAAVSFAPIMSQWWRVGADAEAQRCHSNPRCCAFASNMPYVLLSSSVSFYLPLLVMLFVYARVFVVATRQLRLLRGELGRFPPEESPPAPSRSLAPAPVGTCAPPEGVPACGRRPARLLPLREHRALCTLGLIMGTFTLCWLPFFLANVLRALGGPSLVPGPAFLALNWLGYANSAFNPLIYCRSPDFRSAFRRLLCRCGRRLPPEPCAAARPALFPSGVPAARSSPAQPRLCQRLDGASWGVS

SEQ ID NO: 283 - protein, 400 aa, Mus musculus
MAPWPHRNGSLALWSDAPTLDPSAANTSGLPGVPWAAALAGALLALATVGGNLLVIIAIARTPRLQTITNVFVTSLAAADLVVGLLVMPPGATLALTGHWPLGETGCELWTSVDVLCVTASIETLCALAVDRYLAVTNPLRYGTLVTKRRARAAVVLVWIVSAAVSFAPIMSQWWRVGADAEAQECHSNPRCCSFASNMPYALLSSSVSFYLPLLVMLFVYARVFVVAKRQRHLLRRELGRFSPEESPPSPSRSPSPATGGTPAAPDGVPPCGRRPARLLPLREHRALRTLGLIMGIFSLCWLPFFLANVLRALAGPSLVPSGVFIALNWLGYANSAFNPVIYCRSPDFRDAFRRLLCSYGGRGPEEPRAVTFPASPVEARQSPPLNRFDGYEGARPFPT

SEQ ID NO: 284 - protein, 359 aa, Homo sapiens [sequence omitted]

SEQ ID NO: 285 - protein, 359 aa, Mus musculus
MALNSSTEDGIKRIQDDCPRAGRHSYIFVMIPTLYSIIFVVGIFGNSLVVIVIYFYMKLKTVASVFLLNLALADLCFLLTLPLWAVYTAMEYRWPFGNHLCKIASASVSFNLYASVFLLTCLSIDRYLAIVHPMKSRLRRTMLVAKVTCIIIWLMAGLASLPAVIHRNVYFIENTNITVCAFHYESRNSTLPIGLGLTKNILGFLFPFLIILTSYTLIWKALKKAYEIQKNKPRNDDIFRIIMAIVLFFFFSWVPHQIFTFLDVLIQLGVIHDCKIADIVDTAMPITICIAYFNNCLNPLFYGFLGKKFKKYFLQLLKYIPPKAKSHSSLSTKMSTLSYRPSDNMSSAAKKPASCSEVE

SEQ ID NO: 286 - protein, 363 aa, Homo sapiens
MKGNSTLATTSKNITSGLHFGLVNISGNNESTLNCSQKPSDKHLDAIPILYYIIFVIGFLVNIVVVTLFCCQKGPKKVSSIYIFNLAVADLLLLATLPLWATYYSYRYDWLFGPVMCKVFGSFLTLNMFASIFFITCMSVDRYQSVIYPFLSQRRNPWQASYIVPLVWCMACLSSLPTFYFRDVRTIEYLGVNACIMAFPPEKYAQWSAGIALMKNILGFIIPLIFIATCYFGIRKHLLKTNSYGKNRITRDQVLKMAAAVVLAFIICWLPFHVLTFLDALAWMGVINSCEVIAVIDLALPFAILLGFTNSCVNPFLYCFVGNRFQQKLRSVFRVPITWLQGKRESMSCRKSSSLREMETFVS

SEQ ID NO: 287 - protein, 363 aa, Mus musculus
MKDNFSFAATSRNITSSRPFDNLNATGTNESAFNCSHKPSDKHLEAIPVLYYMIFVIGFAVNIVVVSLFCCQKGPKKVSSIYIFNLALADLLLLATLPLWATYYSYRYDWLFGPVMCKVFGSFLTLNMFASIFFITCMSVDRYQSVIYPFLSQRRNPWQASYVVPLVWCMACLSSLPTFYFRDVRTIEYLGVNACIMAFPPEKYAQWSAGIALMKNILGFIIPLIFIATCYFGIRKHLLKTNSYGKNRITRDQVLKMAAAVVLAFIICWLPFHVLTFLDALTWMGIINSCEVIAVIDLALPFAILLGFTNSCVNPFLYCFVGNRFQQKLRSVFRVPITWLQGKRETMSCRKGSSLREMDTFVS

SEQ ID NO: 288 - protein, 380 aa, Homo sapiens
MEEGGDFDNYYGADNQSECEYTDWKSSGALIPAIYMLVFLLGTTGNGLVLWTVFRSSREKRRSADIFIASLAVADLTFVVTLPLWATYTYRDYDWPFGTFFCKLSSYLIFVNMYASVFCLTGLSFDRYLAIVRPVANARLRLRVSGAVATAVLWVLAALLAMPVMVLRTTGDLENTTKVQCYMDYSMVATVSSEWAWEVGLGVSSTTVGFVVPFTIMLTCYFFIAQTIAGHFRKERIEGLRKRRRLLSIIVVLVVTFALCWMPYHLVKTLYMLGSLLHWPCDFDLFLMNIFPYCTCISYVNSCLNPFLYAFFDPRFRQACTSMLCCGQSRCAGTSHSSSGEKSASYSSGHSQGPGPNMGKGGEQMHEKSIPYSQETLVVD

SEQ ID NO: 289 - protein, 377 aa, Mus musculus
MEDDGYNYYGADNQSECDYADWKPSGALIPAIYMLVFLLGTTGNGLVLWTVFRTSREKRRSADIFIASLAVADLTFVVTLPLWATYTYREFDWPFGTFSCKLSSYLIFVNMYASVFCLTGLSFDRYLAIVRPVANARLRLRVSGAVATAVLWVLAALLAVPVMVFRSTDASENGTKIQCYMDYSMVATSNSEWAWEVGLGVSSTAVGFVVPFTIMLTCYFFIAQTIAGHFRKERIEGLRKRRRLLSIIVVLVVTFALCWMPYHLVKTLYMLGSLLHWPCDFDIFLMNVFPYCTCISYVNSCLNPFLYAFFDPRFRQACTSMLCCDQSGCKGTPHSSSAEKSASYSSGHSQGPGPNMGKGGEQMHEKSIPYSQETLVD

SEQ ID NO: 290 - protein, 418 aa, Homo sapiens
MRLSAGPDAGPSGNSSPWWPLATGAGNTSREAEALGEGNGPPRDVRNEELAKLEIAVLAVTFAVAVLGNSSVLLALHRTPRKTSRMHLFIRHLSLADLAVAFFQVLPQMCWDITYRFRGPDWLCRVVKHLQVFGMFASAYMLVVMTADRYIAVCHPLKTLQQPARRSRLMIAAAWVLSFVLSTPQYFVFSMIEVNNVTKARDCWATFIQPWGSRAYVTWMTGGIFVAPVVILGTCYGFICYNIWCNVRGKTASRQSKGAEQAGVAFQKGFLLAPCVSSVKSISRAKIRTVKMTFVIVTAYIVCWAPFFIIQMWSVWDPMSVWTESENPTITITALLGSLNSCCNPWIYMFFSGHLLQDCVQSFPCCQNMKEKFNKEDTDSMSRRQTFYSNNRSPTNSTGMWKDSPKSSKSIKFIPVST

SEQ ID NO: 291 - protein, 423 aa, Mus musculus
MSFPRGSHDLPAGNSSPWWPLTTEGANSSREAAGLGEGGSPPGDVRNEELAKLEVTVLAVIFVVAVLGNSSVLLALHRTPRKTSRMHLFIRHLSLADLAVAFFQVLPQLCWDITYRFRGPDWLCRVVKHLQVFAMFASSYMLVVMTADRYIAVCHPLKTLQQPARRSRLMIAASWGLSFVLSIPQYFIFSVIEFEVNNGTKAQDCWATFIPPWGTRAYVTWMTSGVFVVPVIILGTCYGFICYHIWRNVRGKTASRQSKGGKGSGEAAGPFHKGLLVTPCVSSVKSISRAKIRTVKMTFVIVSAYILCWTPFFIVQMWSVWDTNFVWTDSENPSTTITALLASLNSCCNPWIYMFFSGHLLQDCVQSFPCCQSIAQKFAKDDSDSMSRRQTSYSNNRSPTNSTGTWKDSPKSSKSIRFIPVST

SEQ ID NO: 292 - protein, 424 aa, Homo sapiens
MDSGPLWDANPTPRGTLSAPNATTPWLGRDEELAKVEIGVLATVLVLATGGNLAVLLTLGQLGRKRSRMHLFVLHLALTDLAVALFQVLPQLLWDITYRFQGPDLLCRAVKYLQVLSMFASTYMLLAMTLDRYLAVCHPLRSLQQPGQSTYLLIAAPWLLAAIFSLPQVFIFSLREVIQGSGVLDCWADFGFPWGPRAYLTWTTLAIFVLPVTMLTACYSLICHEICKNLKVKTQAWRVGGGGWRTWDRPSPSTLAATTRGLPSRVSSINTISRAKIRTVKMTFVIVLAYIACWAPFFSVQMWSVWDKNAPDEDSTNVAFTISMLLGNLNSCCNPWIYMGFNSHLLPRPLRHLACCGGPQPRMRRRLSDGSLSSRHTTLLTRSSCPATLSLSLSLTLSGRPRPEESPRDLELADGEGTAETIIF

SEQ ID NO: 293 - protein, 421 aa, Mus musculus
MDSEPSWTATPSPGGTLFVPNTTTPWLGRDEELAKVEIGILATVLVLATGGNLAVLLILGLQGHKRSRMHLFVLHLALTDLGVALFQVLPQLLWDITYRFQGSDLLCRAVKYLQVLSMFASTYMLLAMTLDRYLAVCHPLRSLQQPSQSTYPLIAAPWLLAAILSLPQVFIFSLREVIQGSGVLDCWADFYFSWGPRAYITWTTMAIFVLPVVVLTACYGLICHEIYKNLKVKTQAGREERRGWPKSSSSAAAAATRGLPSRVSSISTISRAKIRTVKMTFVIVLAYIACWAPFFSVQMWSVWDENAPNEDSTNVAFTISMLLGNLSSCCNPWIYMGFNSHLLPRSLSHRACCRGSKPRVHRQLSNSSLASRRTTLLTHTCGPSTLRLSLNLSLHAKPKPAGSLKDLEQVDGEATMETSIS

SEQ ID NO: 294 - protein, 371 aa, Homo sapiens
MLMASTTSAVPGHPSLPSLPSNSSQERPLDTRDPLLARAELALLSIVFVAVALSNGLVLAALARRGRRGHWAPIHVFIGHLCLADLAVALFQVLPQLAWKATDRFRGPDALCRAVKYLQMVGMYASSYMILAMTLDRHRAICRPMLAYRHGSGAHWNRPVLVAWAFSLLLSLPQLFIFAQRNVEGGSGVTDCWACFAEPWGRRTYVTWIALMVFVAPTLGIAACQVLIFREIHASLVPGPSERPGGRRRGRRTGSPGEGAHVSAAVAKTVRMTLVIVVVYVLCWAPFFLVQLWAAWDPEAPLEGAPFVLLMLLASLNSCTNPWIYASFSSSVSSELRSLLCCARGRTPPSLGPQDESCTTASSSLAKDTSS

SEQ ID NO: 295 - protein, 371 aa, Mus musculus
MILVSTTSAVPGALSSPSSPSNSSQEELLDDRDPLLVRAELALLSTIFVAVALSNGLVLGALIRRGRRGRWAPMHVFISHLCLADLAVALFQVLPQLAWDATDRFHGPDALCRAVKYLQMVGMYASSYMILAMTLDRHRAICRPMLAYRHGGGARWNRPVLVAWAFSLLLSLPQLFIFAQRDVGNGSGVFDCWARFAEPWGLRAYVTWIALMVFVAPALGIAACQVLIFREIHASLVPGPSERAGRRRRGHRTGSPSEGAHVSAAMAKTVRMTLVIVIVYVLCWAPFFLVQLWAAWDPEAPLERPPFVLLMLLASLNSCTNPWIYASFSSSVSSELRSLLCCAQRHTTHSLGPQDESCATASSSLMKDTPS

SEQ ID NO: 296 - protein, 353 aa, Homo sapiens
MASSWPPLELQSSNQSQLFPQNATACDNAPEAWDLLHRVLPTFIISICFFGLLGNLFVLLVFLLPRRQLNVAEIYLANLAASDLVFVLGLPFWAENIWNQFNWPFGALLCRVINGVIKANLFISIFLVVAISQDRYRVLVHPMASGRQQRRRQARVTCVLIWVVGGLLSIPTFLLRSIQAVPDLNITACILLLPHEAWHFARIVELNILGFLLPLAAIVFFNYHILASLRTREEVSRTRVRGPKDSKTTALILTLVVAFLVCWAPYHFFAFLEFLFQVQAVRGCFWEDFIDLGLQLANFFAFTNSSLNPVIYVFVGRLFRTKVWELYKQCTPKSLAPISSSHRKEIFQLFWRN

SEQ ID NO: 297 - protein, 334 aa, Mus musculus
MASQASLKLQPSNQSQQAPPNITSCEGAPEAWDLLCRVLPGFVITVCFFGLLGNLLVLSFFLLPWRRWWQQRRQRLTIAEIYLANLAASDLVFVLGLPFWAENVGNRFNWPFGSDLCRVVSGVIKANLFISIFLVVAISQDRYRLLVYPMTSWGNRRRRQAQVTCLLIWVAGGLLSTPTFLLRSVKVVPDLNISACILLFPHEAWHFVRMVELNVLGFLLPLAAILYFNFHILASLRGQKEASRTRCGGPKDSKTMGLILTLVASFLVCWAPYHFFAFLDFLVQVRVIQDCFWKELTDLGLQLANFFAFVNSCLNPLIYVFAGRLFKTRVLGTL

SEQ ID NO: 298 - protein, 391 aa, Homo sapiens
MFSPWKISMFLSVREDSVPTTASFSADMLNVTLQGPTLNGTFAQSKCPQVEWLGWLNTIQPPFLWVLFVLATLENIFVLSVFCLHKSSCTVAEIYLGNLAAADLILACGLPFWAITISNNFDWLFGETLCRVVNAIISMNLYSSICFLMLVSIDRYLALVKTMSMGRMRGVRWAKLYSLVIWGCTLLLSSPMLVFRTMKEYSDEGHNVTACVISYPSLIWEVFTNMLLNVVGFLLPLSVITFCTMQIMQVLRNNEMQKFKEIQTERRATVLVLVVLLLFIICWLPFQISTFLDTLHRLGILSSCQDERIIDVITQIASFMAYSNSCLNPLVYVIVGKRFRKKSWEVYQGVCQKGGCRSEPIQMENSMGTLRTSISVERQIHKLQDWAGSRQ

SEQ ID NO: 299 - protein, 392 aa, Mus musculus
MPCSWKLLGFLSVHEPMPTAASFGIEMFNVTTQVLGSALNGTLSKDNCPDTEWWSWLNAIQAPFLWVLFLLAALENLFVLSVFFLHKNSCTVAEIYLGNLAAADLILACGLPFWAITIANNFDWVFGEVLCRVVNTMIYMNLYSSICFLMLVSIDRYLALVKTMSMGRMRGVRWAKLYSLVIWGCTLLLSSPMLVFRTMREYSEEGHNVTACVIVYPSRSWEVFTNVLLNLVGFLLPLSVITFCTVRILQVLRNNEMKKFKEVQTERKATVLVLAVLGLFVLCWVPFQISTFLDTLLRLGVLSGCWDEHAVDVITQISSYVAYSNSGLNPLVYVIVGKRFRKKSREVYRVLCQKGGCMGEPVQMENSMGTLRTSISVERQIHKLQDWAGKKQ

SEQ ID NO: 300 - protein, 372 aa, Homo sapiens
MNYPLTLEMDLENLEDLFWELDRLDNYNDTSLVENHLCPATEGPLMASFKAVFVPVAYSLIFLLGVIGNVLVLVILERHRQTRSSTETFLFHLAVADLLLVFILPFAVAEGSVGWVLGTFLCKTVIALHKVNFYCSSLLLACIAVDRYLAIVHAVHAYRHRRLLSIHITCGTIWLVGFLLALPEILFAKVSQGHHNNSLPRCTFSQENQAETHAWFTSRFLYHVAGFLLPMLVMGWCYVGVVHRLRQAQRRPQRQKAVRVAILVTSIFFLCWSPYHIVIFLDTLARLKAVDNTCKLNGSLPVAITMCEFLGLAHCCLNPMLYTFAGVKFRSDLSRLLTKLGCTGPASLCQLFPSWRRSSLSESENATSLTTF

SEQ ID NO: 301 - protein, 374 aa, Mus musculus
MNYPLTLDMGSITYNMDDLYKELAFYSNSTEIPLQDSNFCSTVEGPLLTSFKAVFMPVAYSLIFLLGMMGNILVLVILERHRHTRSSTETFLFHLAVADLLLVFILPFAVAEGSVGWVLGTFLCKTVIALHKINFYCSSLLVACIAVDRYLAIVHAVHAYRRRRLLSIHITCTAIWLAGFLFALPELLFAKVGQPHNNDSLPQCTFSQENEAETRAWFTSRFLYHIGGFLLPMLVMGWCYVGVVHRLLQAQRRPQRQKAVRVAILVTSIFFLCWSPYHIVIFLDTLERLKAVNSSCELSGYLSVAITLCEFLGLAHCCLNPMLYTFAGVKFRSDLSRLLTKLGCAGPASLCQLFPNWRKSSLSESENATSLTTF

SEQ ID NO: 302 - protein, 399 aa, Homo sapiens
MAQRQPHSPNQTLISITNDTESSSSVVSNDNTNKGWSGDNSPGIEALCAIYITYAVIISVGILGNAILIKVFFKTKSMQTVPNIFITSLAFGDLLLLLTCVPVDATHYLAEGWLFGRIGCKVLSFIRLTSVGVSVFTLTILSADRYKAVVKPLERQPSNAILKTCVKAGCVWIVSMIFALPEAIFSNVYTFRDPNKNMTFESCTSYPVSKKLLQEIHSLLCFLVFYIIPLSIISVYYSLIARTLYKSTLNIPTEEQSHARKQIESRKRIARTVLVLVALFALCWLPNHLLYLYHSFTSQTYVDPSAMHFIFTIFSRVLAFSNSCVNPFALYWLSKSFQKHFKAQLFCCKAERPEPPVADTSLTTLAVMGTVPGTGSIQMSEISVTSFTGCSVKQAEDRF

SEQ ID NO: 303 - protein, 399 aa, Mus musculus
MSQRQSQSPNQTLISITNDTETSSSVVSNDTTHKGWTGDNSPGIEALCAIYITYAGIISVGILGNAILIKVFFKTKSMQTVPNIFITSLAFGDLLLLLTCVPVDATHYLAEGWLFGKVGCKVLSFIRLTSVGVSVFTLTILSADRYKAVVKPLERQPPNAILKTCAKAGGIWIVSMIFALPEAIFSNVYTFQDPNRNVTFESCNSYPISERLLQEIHSLLCFLVFYIIPLSIISVYYSLIARTLYKSTLNIPTEEQSHARKQIESRKRIAKTVLVLVALFALCWLPNHLLYLYHSFTYESYANHSDVPFVIIIFSRVLAFSNSCVNPFALYWLSKTFQQHFKAQLCCLKAEQPEPPLGDIPLNNLTVMGRVPATGSAHVSEISVTLFSGSSAKKGEDKV

SEQ ID NO: 304 - protein, 482 aa, Homo sapiens [sequence omitted]

SEQ ID NO: 305 - protein, 477 aa, Mus musculus
MESFDADTNSTDLHSRPLFQPQDIASMVILGLTCLLGLLGNGLVLWVAGVKMKTTVNTVWFLHLTLADFLCCLSLPFSLAHLILQGHWPYGLFLCKLIPSIIILNMFASVFLLTAISLDRCLIVHKPIWCQNHRNVRTAFAICGCVWVVAFVMCVPVFVYRDLFIMDNRSICRYNFDSSRSYDYWDYVYKLSLPESNSTDNSTAQLTGHMNDRSAPSSVQARDYFWTVTTALQSQPFLTSPEDSFSLDSANQQPHYGGKPPNVLTAAVPSGFPVEDRKSNTLNADAFLSAHTELFPTASSGHLYPYDFQGDYVDQFTYDNHVPTPLMAITITRLVVGFLVPFFIMVICYSLIVFRMRKTNFTKSRNKTFRVAVAVVTVFFICWTPYHLVGVLLLITDPESSLGEAVMSWDHMSIALASANSCFNPFLYALLGKDFRKKARQSIKGILEAAFSEELTHSTNCTQDKASSKRNNMSTDV

SEQ ID NO: 306 - protein, 350 aa, Homo sapiens
MNSFNYTTPDYGHYDDKDTLDLNTPVDKTSNTLRVPDILALVIFAVVFLVGVLGNALVVWVTAFEAKRTINAIWFLNLAVADFLSCLALPILFTSIVQHHHWPFGGAACSILPSLILLNMYASILLLATISADRFLLVFKPIWCQNFRGAGLAWIACAVAWGLALLLTIPSFLYRVVREEYFPPKVLCGVDYSHDKRRERAVAIVRLVLGFLWPLLTLTICYTFILLRTWSRRATRSTKTLKVVVAVVASFFIFWLPYQVTGIMMSFLEPSSPTFLLLNKLDSLCVSFAYINCCINPIIYVVAGQGFQGRLRKSLPSLLRNVLTEESVVRESKSFTRSTVDTMAQKTQAV

SEQ ID NO: 307 - protein, 347 aa, Mus musculus
MNSSFEINYDHYGTMDPNIPADGIHLPKRQPGDVAALIIYSVVFLVGVPGNALVVWVTAFEPDGPSNAIWFLNLAVADLLSCLAMPVLFTTVLNHNYWYFDATACIVLPSLILLNMYASILLLATISADRFLLVFKPIWCQKVRGTGLAWMACGVAWVLALLLTIPSFVYREAYKDFYSEHTVCGINYGGGSFPKEKAVAILRLMVGFVLPLLTLNICYTFLLLRTWSRKATRSTKTLKVVMAVVICFFIFWLPYQVTGVMIAWLPPSSPTLKRVEKLNSLCVSLAYINCCVNPIIYVMAGQGFHGRLLRSLPSIIRNALSEDSVGRDSKTFTPSTDDTSPRKSQAV

SEQ ID NO: 308 - protein, 490 aa, Homo sapiens [sequence omitted]

SEQ ID NO: 309 - protein, 515 aa, Mus musculus
MRFLLVNRFTLLLLLLVSPTPVLQAPTNLTDSGLDQEPFLYLVGRKKLLDAQYKCYDRIHQLPSYEGEGLYCNRTWDGWMCWDDTPAGATAYQHCPDYFPDFDTAEKVSKYCDENGEWFRHPDSNRTWSNYTLCNAFTSEKLQNAYVLYYLALVGHSLSIAALVASMLIFWIFKNLSCQRVTLHKHMFLTYILNSIIIIIHLVEVVPNGDLVRRDPMHIFHHNTHMWTMQWELSPPLPLCAHEGKMDPHASEVISCKVLHFLHQYMMSCNYFWMLCEGIYLHTLIVMAVFTDEQRLRWYYLLGWGFPIVPTIIHAITRALYYNDNCWLSAETHLLYIIHGPVMVALVVNFFFLLNIVRVLVTKMRQTHEAESYMYLKAVKATMVLVPLLGIQFVVFPWRPSNKVLGKIYDYLMHSLIHFQGFFVATIYCFCNHEVQVTLKRQWTQFKIQWSQRWGRRRPTNRVVSAPRAVAFAEPDGLPIYICHQEPRNPPISNNEGEESTEMIPMNVIQQDASA

SEQ ID NO: 310 - protein, 461 aa, Homo sapiens [sequence omitted]

SEQ ID NO: 311 - protein, 463 aa, Mus musculus
MDKKHILCFLVLLPLNMALISAESEEGVNQTDLGVTRNKIMTAQYECYQKIMQDPIQQAEGLYCNRTWDGWLCWNDVAAGTESMQYCPDYFQDFDPSEKVTKICDQDGHWFRHPDSNRTWTNYTLCNNSTHEKVKTALNLFYLTIIGHGLSIASLIISLIIFFYFKSLSCQRITLHKNLFFSFICNSIVTIIHLTAVANNQALVATNPVSCKVSQFIHLYLMGCNYFWMLCEGVYLHTLIVVAVFAEKQHLMWYYFLGWGFPLLPACIHAIARSLYYNDNCWISSDTHLLYIIHGPICAALLVNLFFLLNIVRVLITKLKVTHQVESNLYMKAVRATLILVPLLGIEFVLFPWRPEGKVAEEVYDYVMHILMHFQGLLVATIFCFFNGEVQAILRRNWNQYKIQFGNGFSHSDALRSASYTVSTISDMQGYSHDCPTEHLNGKSIQDIENVALKSENTYDLVM

SEQ ID NO: 312 - protein, 1078 aa, Homo sapiens
MAFYSCCWVLLALTWHTSAYGPDQRAQKKGDIILGGLFPIHFGVAAKDQDLKSRPESVECIRYNFRGFRWLQAMIFAIEEINSSPALLPNLTLGYRIFDTCNTVSKALEATLSFVAQNKIDSLNLDEFCNCSEHIPSTIAVVGATGSGVSTAVANLLGLFYIPQVSYASSSRLLSNKNQFKSFLRTIPNDEHQATAMADIIEYFRWNWVGTIAADDDYGRPGIEKFREEAEERDICIDFSELISQYSDEEEIQHVVEVIQNSTAKVIVVFSSGPDLEPLIKEIVRRNITGKIWLASEAWASSSLIAMPQYFHVVGGTIGFALKAGQIPGFREFLKKVHPRKSVHNGFAKEFWEETFNCHLQEGAKGPLPVDTFLRGHEESGDRFSNSSTAFRPLCTGDENISSVETPYIDYTHLRISYNVYLAVYSIAHALQDIYTCLPGRGLFTNGSCADIKKVEAWQVLKHLRHLNFTNNMGEQVTFDECGDLVGNYSIINWHLSPEDGSIVFKEVGYYNVYAKKGERLFINEEKILWSGFSREVPFSNCSRDCLAGTRKGIIEGEPTCCFECVECPDGEYSDETDASACNKCPDDFWSNENHTSCIAKEIEFLSWTEPFGIALTLFAVLGIFLTAFVLGVFIKFRNTPIVKATNRELSYLLLFSLLCCFSSSLFFIGEPQDWTCRLRQPAFGISFVLCISCILVKTNRVLLVFEAKIPTSFHRKWWGLNLQFLLVFLCTFMQIVICVIWLYTAPPSSYRNQELEDEIIFITCHEGSLMALGFLIGYTCLLAAICFFFAFKSRKLPENFNEAKFITFSMLIFFIVWISFIPAYASTYGKFVSAVEVIAILAASFGLLACIFFNKIYIILFKPSRNTIEEVRCSTAAHAFKVAARATLRRSNVSRKRSSSLGGSTGSTPSSSISSKSNSEDPFPQPERQKQQQPLALTQQEQQQQPLTLPQQQRSQQQPRCKQKVIFGSGTVTFSLSFDEPQKNAMAHRNSTHQNSLEAQKSSDTLTRHQPLLPLQCGETDLDLTVQETGLQGPVGGDQRPEVEDPEELSPALVVSSSQSFVISGGGSTVTENVVNS

SEQ ID NO: 313 - protein, 1079 aa, Mus musculus
MAWFGYCLALLALTWHSSAYGPDQRAQKKGDIILGGLFPIHFGVAAKDQDLKSRPESVECIRYNFRGFRWLQAMIFAIEEINSSPALLPNMTLGYRIFDTCNTVSKALEATLSFVAQNKIDSLNLDEFCNCSEHIPSTIAVVGATGSGVSTAVANLLGLFYIPQVSYASSSRLLSNKNQFKSFLRTIPNDEHQATAMADIIEYFRWNWVGTIAADDDYGRPGIEKFREEAEERDICIDFSELISQYSDEEEIQQVVEVIQNSTAKVIVVFSSGPDLEPLIKEIVRRNITGRIWLASEAWASSSLIAMPEYFHVVGGTIGFGLKAGQIPGFREFLQKVHPRKSVHNGFAKEFWEETFNCHLQDGAKGPLPVDTFVRSHEEGGNRLLNSSTAFRPLCTGDENINSVETPYMGYEHLRISYNVYLAVYSIAHALQDIYTCLPGRGLFTNGSCADIKKVEAWQVLKHLRHLNFTNNMGEQVTFDECGDLVGNYSIINWHLSPEDGSIVFKEVGYYNVYAKKGERLFINEGKILWSGFSREVPFSNCSRDCQAGTRKGIIEGEPTCCFECVECPDGEYSGETDASACDKCPDDFWSNENYTSCIAKEIEFLAWTEPFGIALTLFAVLGIFLTAFVLGVFIKFRNTPIVKATNRELSYLLLFSLLCCFSSSLFFIGEPQDWTCRLRQPAFGISFVLCISCILVKTNRVLLVFEAKIPTSFHRKWWGLNLQFLLVFLCTFMQIVICIIWLYTAPPSSYRNHELEDEIIFITCHEGSLMALGSLIGYTCLLAAICFFFAFKSRKLPENFNEAKFITFSMLIFFIVWISFIPAYASTYGKFVSAVEVIAILAASFGLLACIFFNKVYIILFKPSRNTIEEVRSSTAAHAFKVAARATLRRPNISRKRSSSLGGSTGSNPSSSISSKSNSEDRFPQPERQKQQQPLALTQQEQQQQPLTLQPQQQQQPQQPRCKQKVIFGSGTVTFSLSFDEPQKNAMAHRNSMRQNSLEAQKSNDTLNRHQALLPLQCAEADSEMTIQETGLQGPMVGDHQPEIESPDEMSPALVVSTSRSFVISGGGSSVTENILHS

SEQ ID NO: 314 - protein, 384 aa, Homo sapiens [sequence omitted]

SEQ ID NO: 315 - protein, 378 aa, Mus musculus
MPTVASPLPLTTVGSENSSSIYDYDYLDDMTILVCRKDEVLSFGRVFLPVVYSLIFVLGLAGNLLLLVVLLHSAPRRRTMELYLLNLAVSNLLFVVTMPFWAISVAWHWVFGSFLCKVISTLYSINFYCGIFFITCMSLDKYLEIVHAQPLHRPKAQFRNLLLIVMVWITSLAISVPEMVFVQIHQTLDGVWHCYADFGGHATIWKLYLRFQLNLLGFLLPLLAMIFFYSRIGCVLVRLRPPGQGRALRMAAALVIVFFMLWFPYYLTLFLHSLLDLHVFGNCEISHRLDYTLQVTESLAFSHCCFTPVLYAFCSHRFRRYLKAFLSVMLRWHQAPGTPSSNHSESSRVTAQEDVVSMNDLGERQSEDSLNKGEMGNT

SEQ ID NO: 316 - protein, 428 aa, Homo sapiens
MDVVDSLLVNGSNITPPCELGLENETLFCLDQPRPSKEWQPAVQILLYSLIFLLSVLGNTLVITVLIRNKRMRTVTNIFLLSLAVSDLMLCLFCMPFNLIPNLLKDFIFGSAVCKTTTYFMGTSVSVSTFNLVAISLERYGAICKPLQSRVWQTKSHALKVIAATWCLSFTIMTPYPIYSNLVPFTKNNNQTANMCRFLLPNDVMQQSWHTFLLLILFLIPGIVMMVAYGLISLELYQGIKFEASQKKSAKERKPSTTSSGKYEDSDGCYLQKTRPPRKLELRQLSTGSSSRANRIRSNSSAANLMAKKRVIRMLIVIVVLFFLCWMPIFSANAWRAYDTASAERRLSGTPISFILLLSYTSSCVNPIIYCFMNKRFRLGFMATFPCCPNPGPPGARGEVGEEEEGGTTGASLSRFSYSHMSASVPPQ

SEQ ID NO: 317 - protein, 436 aa, Mus musculus
MDVVDSLLMNGSNITPPCELGLENETLFCLDQPQPSKEWQSAVQILLYSFIFLLSVLGNTLVITVLIRNKRMRTVTNIFLLSLAVSDLMLCLFCMPFNLIPNLLKDFIFGSAVCKTTTYFMGTSVSVSTFNLVAISLERYGAICRPLQSRVWQTKSHALKVIAATWCLSFTIMTPYPIYSNLVPFTKNNNQTANMCRFLLPSDAMQQSWQTFLLLILFLIPGVVMVVAYGLISLELYQGIKFDASQKKSAKEKRLSSGGGGGGGSSSSRYEDSDGCYLQKSRPPRKLELQQLSTSSSGGRINRIRSSGSAANLIAKKRVIRMLIVIVVLFFLCWMPIFSANAWRAYDTVSAEKHLSGTPISFILLLSYTSSCVNPIIYCFMNKRFRLGFMATFPCCPNPGPTGVRGEVGEEEDGRTIRASLSRYSYSHMSTSAPPH

SEQ ID NO: 318 - protein, 447 aa, Homo sapiens
MELLKLNRSVQGTGPGPGASLCRPGAPLLNSSSVGNLSCEPPRIRGAGTRELELAIRITLYAVIFLMSVGGNMLIIVVLGLSRRLRTVTNAFLLSLAVSDLLLAVACMPFTLLPNLMGTFIFGTVICKAVSYLMGVSVSVSTLSLVAIALERYSAICRPLQARVWQTRSHAARVIVATWLLSGLLMVPYPVYTVVQPVGPRVLQCVHRWPSARVRQTWSVLLLLLLFFIPGVVMAVAYGLISRELYLGLRFDGDSDSDSQSRVRNQGGLPGAVHQNGRCRPETGAVGEDSDGCYVQLPRSRPALELTALTAPGPGSGSRPTQAKLLAKKRVVRMLLVIVVLFFLCWLPVYSANTWRAFDGPGAHRALSGAPISFIHLLSYASACVNPLVYCFMHRRFRQACLETCARCCPRPPRARPRALPDEDPPTPSIASLSRLSYTTISTLGPG

SEQ ID NO: 319 - protein, 453 aa, Mus musculus
MDLLKLNRSLQGPGPGSGSSLCRPGVSLLNSSSAGNLSCETPRIRGTGTRELELTIRITLYAVIFLMSVGGNVLIIVVLGLSRRLRTVTNAFLLSLAVSDLLLAVACMPFTLLPNLMGTFIFGTVICKAVSYLMGVSVSVSTLNLAAIALERYSAICRPLQARVWQTRSHAARVILATWLLSGLLMVPYPVYTVVQPVGPRILQCMHLWPSERVQQMWSVLLLILLFFIPGVVMAVAYGLISRELYLGLRFDGDNDSETQSRVRNQGGLPGGAAAPGPVHQNGGCRHVTSLTGEDSDGCYVQLPRSRLEMTTLTTPTTGPGPGPRPNQAKLLAKKRVVRMLLVIVLLFFVCWLPVYSANTWRAFDGPGARRALAGAPISFIHLLSYTSACANPLVYCFMHRRFRQACLDTCARCCPRPPRARPRPLPDEDPPTPSIASLSRLSYTTISTLGPG

SEQ ID NO: 320 - protein, 355 aa, Homo sapiens
METPNTTEDYDTTTEFDYGDATPCQKVNERAFGAQLLPPLYSLVFVIGLVGNILVVLVLVQYKRLKNMTSIYLLNLAISDLLFLFTLPFWIDYKLKDDWVFGDAMCKILSGFYYTGLYSEIFFIILLTIDRYLAIVHAVFALRARTVTFGVITSIIIWALAILASMPGLYFSKTQWEFTHHTCSLHFPHESLREWKLFQALKLNLFGLVLPLLVMIICYTGIIKILLRRPNEKKSKAVRLIFVIMIIFFLFWTPYNLTILISVFQDFLFTHECEQSRHLDLAVQVTEVIAYTHCCVNPVIYAFVGERFRKYLRQLFHRRVAVHLVKWLPFLSVDRLERVSSTSPSTGEHELSAGF

SEQ ID NO: 321 - protein, 355 aa, Mus musculus
MEISDFTEAYPTTTEFDYGDSTPCQKTAVRAFGAGLLPPLYSLVFIIGVVGNVLMILVLMQHRRLQSMTSIYLFNLAVSDLVFLFTLPFWIDYKLKDDWIFGDAMCKLLSGFYYLGLYSEIFFIILLTIDRYLAIVHAVFALRARTVTLGIITSIITWALAILASMPALYFFKAQWEFTHRTCSPHFPYKSLKQWKRFQALKLNLLGLILPLLVMIICYAGIIRILLRRPSEKKVKAVRLIFAITLLFFLLWTPYNLSVFVSAFQDVLFTNQCEQSKHLDLAMQVTEVIAYTHCCVNPIIYVFVGERFWKYLRQLFQRHVAIPLAKWLPFLSVDQLERTSSISPSTGEHELSAGF

SEQ ID NO: 322 - protein, 374 aa, Homo sapiens
MLSTSRSRFIRNTNESGEEVTTFFDYDYGAPCHKFDVKQIGAQLLPPLYSLVFIFGFVGNMLVVLILINCKKLKCLTDIYLLNLAISDLLFLITLPLWAHSAANEWVFGNAMCKLFTGLYHIGYFGGIFFIILLTIDRYLAIVHAVFALKARTVTFGVVTSVITWLVAVFASVPGIIFTKCQKEDSVYVCGPYFPRGWNNFHTIMRNILGLVLPLLIMVICYSGILKTLLRCRNEKKRHRAVRVIFTIMIVYFLFWTPYNIVILLNTFQEFFGLSNCESTSQLDQATQVTETLGMTHCCINPIIYAFVGEKFRSLFHIALGCRIAPLQKPVCGGPGVRPGKNVKVTTQGLLDGRGKGKSIGRAPEASLQDKEGA

SEQ ID NO: 323 - protein, 373 aa, Mus musculus
MEDNNMLPQFIHGILSTSHSLFTRSIQELDEGATTPYDYDDGEPCHKTSVKQIGAWILPPLYSLVFIFGFVGNMLVIIILIGCKKLKSMTDIYLLNLAISDLLFLLTLPFWAHYAANEWVFGNIMCKVFTGLYHIGYFGGIFFIILLTIDRYLAIVHAVFALKARTVTFGVITSVVTWVVAVFASLPGIIFTKSKQDDHHYTCGPYFTQLWKNFQTIMRNILSLILPLLVMVICYSGILHTLFRCRNEKKRHRAVRLIFAIMIVYFLFWTPYNIVLFLTTFQESLGMSNCVIDKHLDQAMQVTETLGMTHCCINPVIYAFVGEKFRRYLSIFFRKHIAKRLCKQCPVFYRETADRVSSTFTPSTGEQEVSVGL

SEQ ID NO: 324 - protein, 355 aa, Homo sapiens
MTTSLDTVETFGTTSYYDDVGLLCEKADTRALMAQFVPPLYSLVFTVGLLGNVVVVMILIKYRRLRIMTNIYLLNLAISDLLFLVTLPFWIHYVRGHNWVFGHGMCKLLSGFYHTGLYSEIFFIILLTIDRYLAIVHAVFALRARTVTFGVITSIVTWGLAVLAALPEFIFYETEELFEETLCSALYPEDTVYSWRHFHTLRMTIFCLVLPLLVMAICYTGIIKTLLRCPSKKKYKAIRLIFVIMAVFFIFWTPYNVAILLSSYQSILFGNDCERSKHLDLVMLVTEVIAYSHCCMNPVIYAFVGERFRKYLRHFFHRHLLMHLGRYIPFLPSEKLERTSSVSPSTAEPELSIVF

SEQ ID NO: 325 - protein, 359 aa, Mus musculus
MAFNTDEIKTVVESFETTPYEYEWAPPCEKVRIKELGSWLLPPLYSLVFIIGLLGNMMVVLILIKYRKLQIMTNIYLFNLAISDLLFLFTVPFWIHYVLWNEWGFGHYMCKMLSGFYYLALYSEIFFIILLTIDRYLAIVHAVFALRARTVTFATITSIITWGLAGLAALPEFIFHESQDSFGEFSCSPRYPEGEEDSWKRFHALRMNIFGLALPLLVMVICYSGIIKTLLRCPNKKKHKAIRLIFVVMIVFFIFWTPYNLVLLFSAFHRTFLETSCEQSKHLDLAMQVTEVIAYTHCCVNPVIYAFVGERFRKHLRLFFHRNVAVYLGKYIPFLPGEKMERTSSVSPSTGEQEISVVF

SEQ ID NO: 326 - protein, 360 aa, Homo sapiens
MNPTDIADTTLDESIYSNYYLYESIPKPCTKEGIKAFGELFLPPLYSLVFVFGLLGNSVVVLVLFKYKRLRSMTDVYLLNLAISDLLFVFSLPFWGYYAADQWVFGLGLCKMISWMYLVGFYSGIFFVMLMSIDRYLAIVHAVFSLRARTLTYGVITSLATWSVAVFASLPGFLFSTCYTERNHTYCKTKYSLNSTTWKVLSSLEINILGLVIPLGIMLFCYSMIIRTLQHCKNEKKNKAVKMIFAVVVLFLGFWTPYNIVLFLETLVELEVLQDCTFERYLDYAIQATETLAFVHCCLNPIIYFFLGEKFRKYILQLFKTCRGLFVLCQYCGLLQIYSADTPSSSYTQSTMDHDLHDAL

SEQ ID NO: 327 - protein, 360 aa, Mus musculus
MNATEVTDTTQDETVYNSYYFYESMPKPCTKEGIKAFGEVFLPPLYSLVFLLGLFGNSVVVLVLFKYKRLKSMTDVYLLNLAISDLLFVLSLPFWGYYAADQWVFGLGLCKIVSWMYLVGFYSGIFFIMLMSIDRYLAIVHAVFSLKARTLTYGVITSLITWSVAVFASLPGLLFSTCYTEHNHTYCKTQYSVNSTTWKVLSSLEINVLGLLIPLGIMLFWYSMIIRTLQHCKNEKKNRAVRMIFGVVVLFLGFWTPYNVVLFLETLVELEVLQDCTLERYLDYAIQATETLGFIHCCLNPVIYFFLGEKFRKYITQLFRTCRGPLVLCKHCDFLQVYSADMSSSSYTQSTVDHDFRDAL

SEQ ID NO: 328 - protein, 352 aa, Homo sapiens [sequence omitted]

SEQ ID NO: 329 - protein, 354 aa, Mus musculus
MDFQGSVPTYIYDIDYGMSAPCQKINVKQIAAQLLPPLYSLVFIFGFVGNMMVFLILISCKKLKSVTDIYLLNLAISDLLFLLTLPFWAHYAANEWIFGNIMCKVFTGVYHIGYFGGIFFIILLTIDRYLAIVHAVFALKVRTVNFGVITSVVTWVVAVFASLPEIIFTRSQKEGFHYTCSPHFPHTQYHFWKSFQTLKMVILSLILPLLVMIICYSGILHTLFRCRNEKKRHRAVRLIFAIMIVYFLFWTPYNIVLLLTTFQEFFGLNNCSSSNRLDQAMQATETLGMTHCCLNPVIYAFVGEKFRSYLSVFFRKHIVKRFCKRCSIFQQDNPDRVSSVYTRSTGEHEVSTGL

SEQ ID NO: 330 - protein, 374 aa, Homo sapiens
MSGESMNFSDVFDSSEDYFVSVNTSYYSVDSEMLLCSLQEVRQFSRLFVPIAYSLICVFGLLGNILVVITFAFYKKARSMTDVYLLNMAIADILFVLTLPFWAVSHATGAWVFSNATCKLLKGIYAINFNCGMLLLTCISMDRYIAIVQATKSFRLRSRTLPRSKIICLVVWGLSVIISSSTFVFNQKYNTQGSDVCEPKYQTVSEPIRWKLLMLGLELLFGFFIPLMFMIFCYTFIVKTLVQAQNSKRHKAIRVIIAVVLVFLACQIPHNMVLLVTAANLGKMNRSCQSEKLIGYTKTVTEVLAFLHCCLNPVLYAFIGQKFRNYFLKILKDLWCVRRKYKSSGFSCAGRYSENISRQTSETADNDNASSFTM

SEQ ID NO: 331 - protein, 367 aa, Mus musculus
MNSTESYFGTDDYDNTEYYSIPPDHGPCSLEEVRNFTKVFVPIAYSLICVFGLLGNIMVVMTFAFYKKARSMTDVYLLNMAITDILFVLTLPFWAVTHATNTWVFSDALCKLMKGTYAVNFNCGMLLLACISMDRYIAIVQATKSFRVRSRTLTHSKVICVAVWFISIIISSPTFIFNKKYELQDRDVCEPRYRSVSEPITWKLLGMGLELFFGFFTPLLFMVFCYLFIIKTLVQAQNSKRHRAIRVVIAVVLVFLACQIPHNMVLLVTAVNTGKVGRSCSTEKVLAYTRNVAEVLAFLHCCLNPVLYAFIGQKFRNYFMKIMKDVWCMRRKNKMPGFLCARVYSESYISRQTSETVENDNASSFTM

SEQ ID NO: 332 - protein, 378 aa, Homo sapiens
MDLGKPMKSVLVVALLVIFQVCLCQDEVTDDYIGDNTTVDYTLFESLCSKKDVRNFKAWFLPIMYSIICFVGLLGNGLVVLTYIYFKRLKTMTDTYLLNLAVADILFLLTLPFWAYSAAKSWVFGVHFCKLIFAIYKMSFFSGMLLLLCISIDRYVAIVQAVSAHRHRARVLLISKLSCVGIWILATVLSIPELLYSDLQRSSSEQAMRCSLITEHVEAFITIQVAQMVIGFLVPLLAMSFCYLVIIRTLLQARNFERNKAIKVIIAVVVVFIVFQLPYNGVVLAQTVANFNITSSTCELSKQLNIAYDVTYSLACVRCCVNPFLYAFIGVKFRNDLFKLFKDLGCLSQEQLRQWSSCRHIRRSSMSVEAETTTTFSP

SEQ ID NO: 333 - protein, 378 aa, Mus musculus
MDPGKPRKNVLVVALLVIFQVCFCQDEVTDDYIGENTTVDYTLYESVCFKKDVRNFKAWFLPLMYSVICFVGLLGNGLVILTYIYFKRLKTMTDTYLLNLAVADILFLLILPFWAYSEAKSWIFGVYLCKGIFGIYKLSFFSGMLLLLCISIDRYVAIVQAVSRHRHRARVLLISKLSCVGIWMLALFLSIPELLYSGLQKNSGEDTLRCSLVSAQVEALITIQVAQMVFGFLVPMLAMSFCYLIIIRTLLQARNFERNKAIKVIIAVVVVFIVFQLPYNGVVLAQTVANFNITNSSCETSKQLNIAYDVTYSLASVRCCVNPFLYAFIGVKFRSDLFKLFKDLGCLSQERLRHWSSCRHVRNASVSMEAETTTTFSP

SEQ ID NO: 334 - protein, 355 aa, Homo sapiens
MDYTLDLSVTTVTDYYYPDIFSSPCDAELIQTNGKLLLAVFYCLLFVFSLLGNSLVILVLVVCKKLRSITDVYLLNLALSDLLFVFSFPFQTYYLLDQWVFGTVMCKVVSGFYYIGFYSSMFFITLMSVDRYLAVVHAVYALKVRTIRMGTTLCLAVWLTAIMATIPLLVFYQVASEDGVLQCYSFYNQQTLKWKIFTNFKMNILGLLIPFTIFMFCYIKILHQLKRCQNHNKTKAIRLVLIVVIASLLFWVPFNVVLFLTSLHSMHILDGCSISQQLTYATHVTEIISFTHCCVNPVIYAFVGEKFKKHLSEIFQKSCSQIFNYLGRQMPRESCEKSSSCQQHSSRSSSVDYIL

SEQ ID NO: 335 - protein, 353 aa, Mus musculus
MDYTMEPNVTMTDYYPDFFTAPCDAEFLLRGSMLYLAILYCVLFVLGLLGNSLVILVLVGCKKLRSITDIYLLNLAASDLLFVLSIPFQTHNLLDQWVFGTAMCKVVSGLYYIGFFSSMFFITLMSVDRYLAIVHAVYAIKVRTASVGTALSLTVWLAAVTATIPLMVFYQVASEDGMLQCFQFYEEQSLRWKLFTHFEINALGLLLPFAILLFCYVRILQQLRGCLNHNRTRAIKLVLTVVIVSLLFWVPFNVALFLTSLHDLHILDGCATRQRLALAIHVTEVISFTHCCVNPVIYAFIGEKFKKHLMDVFQKSCSHIFLYLGRQMPVGALERQLSSNQRSSHSSTLDDIL

SEQ ID NO: 336 - protein, 357 aa, Homo sapiens
MADDYGSESTSSMEDYVNFNFTDFYCEKNNVRQFASHFLPPLYWLVFIVGALGNSLVILVYWYCTRVKTMTDMFLLNLAIADLLFLVTLPFWAIAAADQWKFQTFMCKVVNSMYKMNFYSCVLLIMCISVDRYIAIAQAMRAHTWREKRLLYSKMVCFTIWVLAAALCIPEILYSQIKEESGIAICTMVYPSDESTKLKSAVLTLKVILGFFLPFVVMACCYTIIIHTLIQAKKSSKHKALKVTITVLTVFVLSQFPYNCILLVQTIDAYAMFISNCAVSTNIDICFQVTQTIAFFHSCLNPVLYVFVGERFRRDLVKTLKNLGCISQAQWVSFTRREGSLKLSSMLLETTSGALSL

SEQ ID NO: 337 - protein, 369 aa, Mus musculus
MMPTELTSLIPGMFDDFSYDSTASTDDYMNLNFSSFFCKKNNVRQFASHFLPPLYWLVFIVGTLGNSLVILVYWYCTRVKTMTDMFLLNLAIADLLFLATLPFWAIAAAGQWMFQTFMCKVVNSMYKMNFYSCVLLIMCISVDRYIAIVQAMKAQVWRQKRLLYSKMVCITIWVMAAVLCTPEILYSQVSGESGIATCTMVYPKDKNAKLKSAVLILKVTLGFFLPFMVMAFCYTIIIHTLVQAKKSSKHKALKVTITVLTVFIMSQFPYNSILVVQAVDAYAMFISNCTISTNIDICFQVTQTIAFFHSCLNPVLYVFVGERFRRDLVKTLKNLGCISQAQWVSFTRREGSLKLSSMLLETTSGALSL

SEQ ID NO: 338 - protein, 350 aa, Homo sapiens
MALEQNQSTDYYYEENEMNGTYDYSQYELICIKEDVREFAKVFLPVFLTIVFVIGLAGNSMVVAIYAYYKKQRTKTDVYILNLAVADLLLLFTLPFWAVNAVHGWVLGKIMCKITSALYTLNFVSGMQFLACISIDRYVAVTKVPSQSGVGKPCWIICFCVWMAAILLSIPQLVFYTVNDNARCIPIFPRYLGTSMKALIQMLEICIGFVVPFLIMGVCYFITARTLMKMPNIKISRPLKVLLTVVIVFIVTQLPYNIVKFCRAIDIIYSLITSCNMSKRMDIAIQVTESIALFHSCLNPILYVFMGASFKNYVMKVAKKYGSWRRQRQSVEEFPFDSEGPTEPTSTFSI

SEQ ID NO: 339 - protein, 350 aa, Mus musculus
MALELNQSAEYYYEENEMNYTHDYSQYEVICIKEEVRQFAKVFLPAFFTVAFVTGLAGNSVVVAIYAYYKKQRTKTDVYILNLAVADLLLLITLPFWAVNAVHGWILGKMMCKVTSALYTVNFVSGMQFLACISIDRYWAITKAPSQSGAGRPCWIICCCVWMAAILLSIPQLVFYTVNQNARCTPIFPHHLGTSLKASIQMLEIGIGFVVPFLIMGVCYASTARALIKMPNIKKSRPLRVLLAVVVVFIVTQLPYNVVKFCQAIDAIYLLITSCDMSKRMDVAIQLTESIALFHSCLNPILYVFMGASFKNYIMKVAKKYGSWRRQRQNVEEIPFDSEGPTEPTSSFTI

SEQ ID NO: 340 - protein, 333 aa, Homo sapiens
MESSGNPESTTFFYYDLQSQPCENQAWVFATLATTVLYCLVFLLSLVGNSLVLWVLVKYESLESLTNIFILNLCLSDLVFACLLPVWISPYHWGWVLGDFLCKLLNMIFSISLYSSIFFLTIMTIHRYLSVVSPLSTLRVPTLRCRVLVTMAVWVASILSSILDTIFHKVLSSGCDYSELTWYLTSVYQHNLFFLLSLGIILFCYVEILRTLFRSRSKRRHRTVKLIFAIVVAYFLSWGPYNFTLFLQTLFRTQIIRSCEAKQQLEYALLICRNLAFSHCCFNPVLYVFVGVKFRTHLKHVLRQFWFCRLQAPSPASIPHSPGAFAYEGASFY

SEQ ID NO: 341 - protein, 322 aa, Mus musculus
MESSTAFYDYHDKLSLLCENNVIFFSTISTIVLYSLVFLLSLVGNSLVLWVLVKYENLESLTNIFILNLCLSDLMFSCLLPVLISAQWSWFLGDFFCKFFNMIFGISLYSSIFFLTIMTIHRYLSVVSPISTLGIHTLRCRVLVTSCVWAASILFSIPDAVFHKVISLNCKYSEHHGFLASVYQHNIFFLLSMGIILFCYVQILRTLFRTRSRQRHRTVRLIFTVVVAYFLSWAPYNLTLFLKTGIIQQSCESLQQLDIAMIICRHLAFSHCCFNPVLYVFVGIKFRRHLKHLFQQVWLCRKTSSTVPCSPGTFTYEGPSFY

SEQ ID NO: 342 - protein, 742 aa, Homo sapiens
MGGRVFLAFCVWLTLPGAETQDSRGCARWCPQNSSCVNATACRCNPGFSSFSEIITTPTETCDDINECATPSKVSCGKFSDCWNTEGSYDCVCSPGYEPVSGAKTFKNESENTCQDVDECSSGQHQCDSSTVCFNTVGSYSCRCRPGWKPRHGIPNNQKDTVCEDMTFSTWTPPPGVHSQTLSRFFDKVQDLGRDSKTSSAEVTIQNVIKLVDELMEAPGDVEALAPPVRHLIATQLLSNLEDIMRILAKSLPKGPFTYISPSNTELTLMIQERGDKNVTMGQSSARMKLNWAVAAGAEDPGPAVAGILSIQNMTTLLANASLNLHSKKQAELEEIYESSIRGVQLRRLSAVNSIFLSHNNTKELNSPILFAFSHLESSDGEAGRDPPAKDVMPGPRQELLCAFWKSDSDRGGHWATEGCQVLGSKNGSTTCQCSHLSSFAILMAHYDVEDWKLTLITRVGLALSLFCLLLCILTFLLVRPIQGSRTTIHLHLCICLFVGSTIFLAGIENEGGQVGLRCRLVAGLLHYCFLAAFCWMSLEGLELYFLVVRVFQGQGLSTRWLCLIGYGVPLLIVGVSAAIYSKGYGRPRYCWLDFEQGFLWSFLGPVTFIILCNAVIFVTTVWKLTQKFSEINPDMKKLKKARALTITAIAQLFLLGCTWVFGLFIFDDRSLVLTYVFTILNCLQGAFLYLLHCLLNKKVREEYRKWACLVAGGSKYSEFTSTTSGTGHNQTRALRASESGI

SEQ ID NO: 343 - protein, 818 aa, Mus musculus
MRSVRCPGLLVVCILLSLSGAGTQKAEIKNCAKWCPINSKCVSNRSCVCKPGFSSEKELITNPAESCEDINECLLPGFSCGDFAMCKNSEGSYTCVCNLGYKLLSGAESFVNESENTCQASVNTGTTPVPSRIHTVTTAPGNLPEQTTTVHQTQMGDSEERTPKDVNECISGQNHCHQSTHCINKLGGYSCICRQGWKPVPGSPNGPVSTVCEDVDECSSGQHQCHNSTVCKNTVGSYKCHCRPGWKPTSGSLRGPDTICQEPPFPTWTLLPTAHSQTLLRFSVEVQNLLRDFNPATVNYTIQKLIEAVDKLLEDPMETQTQQVAAQLLSNLEQSLRTLAQFLPKGPFTYTSPSNTELSLMVKEQDNKDVTTVHHGQTWMELDWAVTAGAKISENGSSVAGILSSPNMEKLLGNTPLNLEQRRASLEDFYGSPIPSVSLKLLSNINSVFLTNTNTEKLASNVTFKFDFTSVESIEPRHELICAFWKAHNGNGYWDTDGCSMNGTGFCHCNHLTSFAILMAQYHVQDPRLELITKVGLLLSLICLLLCILTFLLVKPIQSSRTMVHLHLCICLFLGSIIFLVGVENEGGEVGLRCRLVAMMLHFCFLAAFCWMALEGVELYFLVVRVFQGQGLSTWQRCLIGYGVPLLIVAISMAVVKMDGYGHATYCWLDFRKQGFLWSFSGPVAFIIFCNAAIFVITVWKLTKKFSEINPNMKKLRKARVLTITAIAQLLVLGCTWGFGLFLFNPHSTWLSYIFTLLNCLQGLFLYVMLCLLNKKVREEYWKWACMVTGSKYTEFNSSTTGTGTSQTRALRSSESGM

SEQ ID NO: 344 - protein, 3014 aa, Homo sapiens
MAPPPPPVLPVLLLLAAAAALPAMGLRAAAWEPRVPGGTRAFALRPGCTYAVGAACTPRAPRELLDVGRDGRLAGRRRVSGAGRPLPLQVRLVARSAPTALSRRLRARTHLPGCGARARLCGTGARLCGALCFPVPGGCAAAQHSALAAPTTLPACRCPPRPRPRCPGRPICLPPGGSVRLRLLCALRRAAGAVRVGLALEAATAGTPSASPSPSPPLPPNLPEARAGPARRARRGTSGRGSLKFPMPNYQVALFENEPAGTLILQLHAHYTIEGEEERVSYYMEGLFDERSRGYFRIDSATGAVSTDSVLDRETKETHVLRVKAVDYSTPPRSATTYITVLVKDTNDHSPVFEQSEYRERVRENLEVGYEVLTIRASDRDSPINANLRYRVLGGAWDVFQLNESSGVVSTRAVLDREEAAEYQLLVEANDQGRNPGPLSATATVYIEVEDENDNYPQFSEQNYVVQVPEDVGLNTAVLRVQATDRDQGQNAAIHYSILSGNVAGQFYLHSLSGILDVINPLDFEDVQKYSLSIKAQDGGRPPLINSSGVVSVQVLDVNDNEPIFVSSPFQATVLENVPLGYPVVHIQAVDADSGENARLHYRLVDTASTFLGGGSAGPKNPAPTPDFPFQIHNSSGWITVCAELDREEVEHYSFGVEAVDHGSPPMSSSTSVSITVLDVNDNDPVFTQPTYELRLNEDAAVGSSVLTLQARDRDANSVITYQLTGGNTRNRFALSSQRGGGLITLALPLDYKQEQQYVLAVTASDGTRSHTAHVLINVTDANTHRPVFQSSHYTVSVSEDRPVGTSIATLSANDEDTGENARITYVIQDPVPQFRIDPDSGTMYTMMELDYENQVAYTLTIMAQDNGIPQKSDTTTLEILILDANDNAPQFLWDFYQGSIFEDAPPSTSILQVSATDRDSGPNGRLLYTFQGGDDGDGDFYIEPTSGVIRTQRRLDRENVAVYNLWALAVDRGSPTPLSASVEIQVTILDINDNAPMFEKDELELFVEENNPVGSVVAKIRANDPDEGPNAQIMYQIVEGDMRHFFQLDLLNGDLRAMVELDFEVRREYVLVVQATSAPLVSRATVHILLVDQNDNPPVLPDFQILFNNYVTNKSNSFPTGVIGCIPAHDPDVSDSLNYTFVQGNELRLLLLDPATGELQLSRDLDNNRPLEALMEVSVSDGIHSVTAFCTLRVTIITDDMLTNSITVRLENMSQEKFLSPLLALFVEGVAAVLSTTKDDVFVFNVQNDTDVSSNILNVTFSALLPGGVRGQFFPSEDLQEQIYLNRTLLTTISTQRVLPFDDNICLREPCENYMKCVSVLRFDSSAPFLSSTTVLFRPIHPINGLRCRCPPGFTGDYCETEIDLCYSDPCGANGRCRSREGGYTCECFEDFTGEHCEVDARSGRCANGVCKNGGTCVNLLIGGFHCVCPPGEYERPYCEVTTRSFPPQSFVTFRGLRQRFHFTISLTFATQERNGLLLYNGRFNEKHDFIALEIVDEQVQLTFSAGETTTTVAPKVPSGVSDGRWHSVQVQYYNKPNIGHLGLPHGPSGEKMAVVTVDDCDTTMAVRFGKDIGNYSCAAQGTQTGSKKSLDLTGPLLLGGVPNLPEDFPVHNRQFVGCMRNLSVDGKNVDMAGFIANNGTREGCAARRNFCDGRRCQNGGTCVNRWNMYLCECPLRFGGKNCEQAMPHPQLFSGESVVSWSDLNIIISVPWYLGLMFRTRKEDSVLMEATSGGPTSFRLQILNNYLQFEVSHGPSDVESVMLSGLRVTDGEWHHLLIELKNVKEDSEMKHLVTMTLDYGMDQNKADIGGMLPGLTVRSVVVGGASEDKVSVRRGFRGCMQGVRMGGTPTNVATLNMNNALKVRVKDGCDVDDPCTSSPCPPNSRCHDAWEDYSCVCDKGYLGINCVDACHLNPCENMGACVRSPGSPQGYVCECGPSHYGPYCENKLDLPCPRGWWGNPVCGPCHCAVSKGFDPDCNKTNGQCQCKENYYKLLAQDTCLPCDCFPHGSHSRTCDMATGQCACKPGVIGRQCNRCDNPFAEVTTLGCEVIYNGCPKAFEAGIWWPQTKFGQPAAVPCPKGSVGNAVRHCSGEKGWLPPELFNCTTISFVDLRAMNEKLSRNETQVDGARALQLVRALRSATQHTGTLFGNDVRTAYQLLGHVLQHESWQQGFDLAATQDADFHEDVIHSGSALLAPATRAAWEQIQRSEGGTAQLLRRLEGYFSNVARNVRRTYLRPFVIVTANMILAVDIFDKFNFTGARVPRFDTIHEEFPRELESSVSFPADFFRPPEEKEGPLLRPAGRRTTPQTTRPGPGTEREAPISRRRRHPDDAGQFAVALVIIYRTLGQLLPERYDPDRRSLRLPHRPIINTPMVSTLVYSEGAPLPRPLERPVLVEFALLEVEERTKPVCVFWNHSLAVGGTGGWSARGCELLSRNRTHVACQCSHTASFAVLMDISRRENGEVLPLKIVTYAAVSLSLAALLVAFVLLSLVRMLRSNLHSIHKHLAVALFLSQLVFVIGINQTENPFLCTVVAILLHYIYMSTFAWTLVESLHVYRMLTEVRNIDTGPMRFYYVVGWGIPAIVTGLAVGLDPQGYGNPDFCWLSLQDTLIWSFAGPIGAVIIINTVTSVLSAKVSCQRKHHYYGKKGIVSLLRTAFLLLLLISATWLLGLLAVNRDALSFHYLFAIFSGLQGPFVLLFHCVLNQEVRKHLKGVLGGRKLHLEDSATTRATLLTRSLNCNTTFGDGPDMLRTDLGESTASLDSIVRDEGIQKLGVSSGLVRGSHGEPDASLMPRSCKDPPGHDSDSDSELSLDEQSSSYASSHSSDSEDDGVGAEEKWDPARGAVHSTPKGDAVANHVPAGWPDQSLAESDSEDPSGKPRLKVETKVSVELHREEQGSHRGEYPPDQESGGAARLASSQPPEQRKGILKNKVTYPPPLTLTEQTLKGRLREKLADCEQSPTSSRTSSLGSGGPDCAITVKSPGREPGRDHLNGVAMNVRTGSAQADGSDSEKP

SEQ ID NO: 345 - protein, 3034 aa, Mus musculus
MAPSSPRVLPALVLLAAAALPALELGAAAWELRVPGGARAFALGPGWSYRLDTTRTPRELLDVSREGPAAGRRLGLGAGTLGCARLAGRLLPLQVRLVARGAPTAPSLVLRARAYGARCGVRLLRRSARGAELRSPAVRSVPGLGDALCFPAAGGGAASLTSVLEAITNFPACSCPPVAGTGCRRGPICLRPGGSAELRLVCALGRAAGAVWVELVIQATSGTPSESPSVSPSLLNLSQPRAGVVRRSRRGTGSSTSPQFPLPSYQVSVPENEPAGTAVIELRAHDPDEGDAGRLSYQMEALFDERSNGYFLIDAATGAVTTARSLDRETKDTHVLKVSAVDHGSPRRSAATYLTVTVSDTNDHSPVFEQSEYRERIRENLEVGYEVLTIRATDGDAPSNANMRYRLLEGAGGVFEIDARSGVVRTRAVVDREEAAEYQLLVEANDQGRNPGPLSASATVHIVVEDENDNYPQFSEKRYVVQVPEDVAVNTAVLRVQATDRDQGQNAAIHYSIVSGNLKGQFYLHSLSGSLDVINPLDFEAIREYTLRIKAQDGGRPPLINSSGLVSVQVLDVNDNAPIFVSSPFQAAVLENVPLGHSVLHIQAVDADAGENARLQYRLVDTASTIVGGSSVDSENPASAPDFPFQIHNSSGWITVCAELDREEVEHYSFGVEAVDHGSPAMSSSASVSITVLDVNDNDPMFTQPVYELRLNEDAAVGSSVLTLRARDRDANSVITYQLTGGNTRNRFALSSQSGGGLITLALPLDYKQERQYVLAVTASDGTRSHTAQVFINVTDANTHRPVFQSSHYTVSVSEDRPVGTSIATISATDEDTGENARITYVLEDPVPQFRIDPDTGTIYTMTELDYEDQAAYTLAITAQDNGIPQKSDTTSLEILILDANDNAPRFLRDFYQGSVFEDAPPSTSVLQVSATDRDSGPNGRLLYTFQGGDDGDGDFYIEPTSGVIRTQRRLDRENVAVYNLWALAVDRGSPNPLSASVGIQVSVLDINDNPPVFEKDELELFVEENSPVGSVVARIRANDPDEGPNAQIIYQIVEGNVPEVFQLDLLSGDLRALVELDFEVRRDYMLVVQATSAPLVSRATVHIRLLDQNDNPPELPDFQILFNNYVTNKSNSFPSGVIGRIPAHDPDLSDSLNYTFLQGNELSLLLLDPATGELQLSRDLDNNRPLEALMEVSVSDGIHSVTALCTLRVTIITDDMLTNSITVRLENMSQEKFLSPLLSLFVEGVATVLSTTKDDIFVFNIQNDTDVSSNILNVTFSALLPGGTRGRFFPSEDLQEQIYLNRTLLTTISAQRVLPFDDNICLREPCENYMKCVSVLRFDSSAPFISSTTVLFRPIHPITGLRCRCPPGFTGDYCETEIDLCYSNPCGANGRCRSREGGYTCECFEDFTGEHCQVNVRSGRCASGVCKNGGTCVNLLIGGFHCVCPPGEYEHPYCEVSTRSFPPQSFVTFRGLRQRFHFTVSLAFATQDRNALLLYNGRFNEKHDFIALEIVEEQLQLTFSAGETTTTVTPQVPGGVSDGRWHSVLVQYYNKPNIGHLGLPHGPSGEKVAVVTVDDCDAAVAVHFGSYVGNYSCAAQGTQSGSKKSLDLTGPLLLGGVPNLPEDFPVHSRQFVGCMRNLSIDGRIVDMAAFIANNGTRAGCASQRNFCDGTSCQNGGTCVNRWNTYLCECPLRFGGKNCEQAMPHPQRFTGESVVLWSDLDITISVPWYLGLMFRTRKEDGVLMEATAGTSSRLHLQILNSYIRFEVSYGPSDVASMQLSKSRITDGGWHHLLIELRSAKEGKDIKYLAVMTLDYGMDQSTVQIGNQLPGLKMRTIVIGGVTEDKVSVRHGFRGCMQGVRMGETSTNIATLNMNDALKVRVKDGCDVEDPCASSPCPPHRPCRDTWDSYSCICDRGYFGKKCVDACLLNPCKHVAACVRSPNTPRGYSCECGPGHYGQYCENKVDLPCPKGWWGNPVCGPCHCAVSQGFDPDCNKTNGQCQCKENYYKPPAQDACLPCDCFPHGSHSRACDMDTGQCACKPGVIGRQCNRCDNPFAEVTSLGCEVIYNGCPRAFEAGIWWPQTKFGQPAAVPCPKGSVGNAVRHCSGEKGWLPPELFNCTSGSFVDLKALNEKLNRNETRMDGNRSLRLAKALRNATQGNSTLFGNDVRTAYQLLARILQHESRQQGFDLAATREANFHEDVVHTGSALLAPATEASWEQIQRSEAGAAQLLRHFEAYFSNVARNVKRTYLRPFVIVTANMILAVDIFDKLNFTGAQVPRFEDIQEELPRELESSVSFPADTFKPPEKKEGPVVRLTNRRTTPLTAQPEPRAERETSSSRRRRHPDEPGQFAVALVVIYRTLGQLLPEHYDPDHRSLRLPNRPVINTPVVSAMVYSEGTPLPSSLQRPILVEFSLLETEERSKPVCVFWNHSLDTGGTGGWSAKGCELLSRNRTHVTCQCSHSASCAVLMDISRREHGEVLPLKIITYAALSLSLVALLVAFVLLSLVRTLRSNLHSIHKNLIAALFFSQLIFMVGINQTENPFLCTVVAILLHYVSMGTFAWTLVENLHVYRMLTEVRNIDTGPMRFYHVVGWGIPAIVTGLAVGLDPQGYGNPDFCWLSLQDTLIWSFAGPVGTVIIINTVIFVLSAKVSCQRKHHYYERKGVVSMLRTAFLLLLLVTATWLLGLLAVNSDTLSFHYLFAAFSCLQGIFVLLFHCVAHREVRKHLRAVLAGKKLQLDDSATTRATLLTRSLNCNNTYSEGPDMLRTALGESTASLDSTTRDEGVQKLSVSSGPARGNHGEPDTSFIPRNSKKAHGPDSDSDSELSLDEHSSSYASSHTSDSEDDGGEAEDKWNPAGGPAHSTPKADALANHVPAGWPDESLAGSDSEELDTEPHLKVETKVSVELHRQAQGNHCGDRPSDPESGVLAKPVAVLSSQPQEQRKGILKNKVTYPPPLPEQPLKSRLREKLADCEQSPTSSRTSSLGSGDGVHATDCVITIKTPRREPGREHLNGVAMNVRTGSAQANGSDSEKP

SEQ ID NO: 346 - protein, 2923 aa, Homo sapiens
MRSPATGVPLPTPPPPLLLLLLLLLPPPLLGDQVGPCRSLGSRGRGSSGACAPMGWLCPSSASNLWLYTSRCRDAGTELTGHLVPHHDGLRVWCPESEAHIPLPPAPEGCPWSCRLLGIGGHLSPQGKLTLPEEHPCLKAPRLRCQSCKLAQAPGLRAGERSPEESLGGRRKRNVNTAPQFQPPSYQATVPENQPAGTPVASLRAIDPDEGEAGRLEYTMDALFDSRSNQFFSLDPVTGAVTTAEELDRETKSTHVFRVTAQDHGMPRRSALATLTILVTDTNDHDPVFEQQEYKESLRENLEVGYEVLTVRATDGDAPPNANILYRLLEGSGGSPSEVFEIDPRSGVIRTRGPVDREEVESYQLTVEASDQGRDPGPRSTTAAVFLSVEDDNDNAPQFSEKRYVVQVREDVTPGAPVLRVTASDRDKGSNAVVHYSIMSGNARGQFYLDAQTGALDVVSPLDYETTKEYTLRVRAQDGGRPPLSNVSGLVTVQVLDINDNAPIFVSTPFQATVLESVPLGYLVLHVQAIDADAGDNARLEYRLAGVGHDFPFTINNGTGWISVAAELDREEVDFYSFGVEARDHGTPALTASASVSVTVLDVNDNNPTFTQPEYTVRLNEDAAVGTSVVTVSAVDRDAHSVITYQITSGNTRNRFSITSQSGGGLVSLALPLDYKLERQYVLAVTASDGTRQDTAQIVVNVTDANTHRPVFQSSHYTVNVNEDRPAGTTVVLISATDEDTGENARITYFMEDSIPQFRIDADTGAVTTQAELDYEDQVSYTLAITARDNGIPQKSDTTYLEILVNDVNDNAPQFLRDSYQGSVYEDVPPFTSVLQISATDRDSGLNGRVFYTFQGGDDGDGDFIVESTSGIVRTLRRLDRENVAQYVLRAYAVDKGMPPARTPMEVTVTVLDVNDNPPVFEQDEFDVFVEENSPIGLAVARVTATDPDEGTNAQIMYQIVEGNIPEVFQLDIFSGELTALVDLDYEDRPEYVLVIQATSAPLVSRATVHVRLLDRNDNPPVLGNFEILFNNYVTNRSSSFPGGAIGRVPAHDPDISDSLTYSFERGNELSLVLLNASTGELKLSRALDNNRPLEAIMSVLVSDGVHSVTAQCALRVTIITDEMLTHSITLRLEDMSPERFLSPLLGLFIQAVAATLATPPDHVVVFNVQRDTDAPGGHILNVSLSVGQPPGPGGGPPFLPSEDLQERLYLNRSLLTAISAQRVLPFDDNICLREPCENYMRCVSVLRFDSSAPFIASSSVLFRPIHPVGGLRCRCPPGFTGDYCETEVDLCYSRPCGPHGRCRSREGGYTCLCRDGYTGEHCEVSARSGRCTPGVCKNGGTCVNLLVGGFKCDCPSGDFEKPYCQVTTRSFPAHSFITFRGLRQRFHFTLALSFATKERDGLLLYNGRFNEKHDFVALEVIQEQVQLTFSAGESTTTVSPFVPGGVSDGQWHTVQLKYYNKPLLGQTGLPQGPSEQKVAVVTVDGCDTGVALRFGSVLGNYSCAAQGTQGGSKKSLDLTGPLLLGGVPDLPESFPVRMRQFVGCMRNLQVDSRHIDMADFIANNGTVPGCPAKKNVCDSNTCHNGGTCVNQWDAFSCECPLGFGGKSCAQEMANPQHFLGSSLVAWHGLSLPISQPWYLSLMFRTRQADGVLLQAITRGRSTITLQLREGHVMLSVEGTGLQASSLRLEPGRANDGDWHHAQLALGASGGPGHAILSFDYGQQRAEGNLGPRLHGLHLSNITVGGIPGPAGGVARGFRGCLQGVRVSDTPEGVNSLDPSHGESINVEQGCSLPDPCDSNPCPANSYCSNDWDSYSCSCDPGYYGDNCTNVCDLNPCEHQSVCTRKPSAPHGYTCECPPNYLGPYCETRIDQPCPRGWWGHPTCGPCNCDVSKGFDPDCNKTSGECHCKENHYRPPGSPTCLLCDCYPTGSLSRVCDPEDGQCPCKPGVIGRQCDRCDNPFAEVTTNGCEVNYDSCPRAIEAGIWWPRTRFGLPAAAPCPKGSFGTAVRHCDEHRGWLPPNLFNCTSITFSELKGFAERLQRNESGLDSGRSQQLALLLRNATQHTAGYFGSDVKVAYQLATRLLAHESTQRGFGLSATQDVHFTENLLRVGSALLDTANKRHWELIQQTEGGTAWLLQHYEAYASALAQNMRHTYLSPFTIVTPNIVISVVRLDKGNFAGAKLPRYEALRGEQPPDLETTVILPESVFRETPPVVRPAGPGEAQEPEELARRQRRHPELSQGEAVASVIIYRTLAGLLPHNYDPDKRSLRVPKRPIINTPVVSISVHDDEELLPRALDKPVTVQFRLLETEERTKPICVFWNHSILVSGTGGWSARGCEVVFRNESHVSCQCNHMTSFAVLMDVSRRENGEILPLKTLTYVALGVTLAALLLTFFFLTLLRILRSNQHGIRRNLTAALGLAQLVFLLGINQADLPFACTVIAILLHFLYLCTFSWALLEALHLYRALTEVRDVNTGPMRFYYMLGWGVPAFITGLAVGLDPEGYGNPDFCWLSIYDTLIWSFAGPVAFAVSMSVFLYILAARASCAAQRQGFEKKGPVSGLQPSFAVLLLLSATWLLALLSVNSDTLLFHYLFATCNCIQGPFIFLSYVVLSKEVRKALKLACSRKPSPDPALTTKSTLTSSYNCPSPYADGRLYQPYGDSAGSLHSTSRSGKSQPSYIPFLLREESALNPGQGPPGLGDPGSLFLEGQDQQHDPDTDSDSDLSLEDDQSGSYASTHSSDSEEEEEEEEEEAAFPGEQGWDSLLGPGAERLPLHSTPKDGGPGPGKAPWPGDFGTTAKESSGNGAPEERLRENGDALSREGSLGPLPGSSAQPHKGILKKKCLPTISEKSSLLRLPLEQCTGSSRGSSASEGSRGGPPPRPPPRQSLQEQLNGVMPIAMSIKAGTVDEDSSGSEFLFFNFLH

SEQ ID NO: 347 - protein, 2920 aa, Mus musculus
MRTRAASAPLPTPLLPLLLLLLLLPPSPLLGDQVGPCRSLGSGGRSSSGACAPVGWLCPASASNLWLYTSRCRESGIELTGHLVPHHDGLRVWCPESGAHIPLPPSSEGCPWSCRLLGIGGHLSPQGTLTLPEEHPCLKAPRLRCQSCKLAQAPGLRAGEGSPEESLGGRRKRNVNTAPQFQPPSYQATVPENQPAGTSVASLRAIDPDEGEAGRLEYTMDALFDSRSNHFFSLDPITGVVTTAEELDRETKSTHVFRVTAQDHGMPRRSALATLTILVTDTNDHDPVFEQQEYKESLRENLEVGYEVLTVRATDGDAPPNANILYRLLEGAGDSPSDAFEIDPRSGVIRTRGPVDREEVESYKLTVEASDQGRDPGPRSSTAIVFLSVEDDNDNAPQFSEKRYVVQVREDVTPGAPVLRVTASDRDKGSNALVHYSIMSGNARGQFYLDAQTGALDVVSPLDYETTKEYTLRIRAQDGGRPPLSNVSGLVTVQVLDINDIRPPIFVSTPFQATVLESVPLGYLVLHVQAIDADAGDNARLEYSLAGVGHDFPFTINNGTGWISVAAELDREEVDFYSFGVEARDHGTPALTASASVSVTILDVNDNNPTFTQPEYTVRLNEDAAVGTSVVTVSAVDRHAHSVITYQITSGNTRNRFSITSQSGGGLVSLALPLDYKLERQYVLAVTASDGTRQDTAQIVVNVTDANTHRPVFQSSHYTVNGNEDRPAGTTVVLISATDEDTGENARITYFMEDSIPQFRIDGDTGAVTTQAELDYEDQVSYTLAITARDNGIPQKSDTTYLEILVNDVNDNAPQFLRDSYQGTVYEDVPPFTSVLQILATDRDSGLNGRVFYTFQGGDDGDGDFIVESTSGIVRTLRRLDRENVAQYVLRAYAVDKGMPPARTPMEVTVTVLDGNDNPPVFEQDEFDVFVEENSPIGLAVARVTATDPDEGTNAQIMYQIVEGNIPEVFQLDIFSGELTALVDLDYEDRPEYVLVIQATSAPLVSRATVHVRLLDRNDNPPVLGNFEILFNNYVTNRSSSFPGGAIGRVPAHDPDISDSLTYSFERGNELSLVLLNASTGELRLSRALDNNRPLEAIMSVLVSDGVHSVTAQCSLRVTIITDEMLTHSITLRLEDMSPERFLSPLLGLFIQAVAATLATPPDHVVVFNVQRDTDAPGGHILNVSLSVGQPPGPGGGPPFLPSEDLQERLYLNRSLLTAISAKRVLPFDRQHLLREPCENYMRCVSVLRFDSSAPFIASSSVLFRPIHLVGGLRCRCPPGLTGDYCETEVDLCYSRTCGPHGRCRSREGGYTCLCRGCYTGEHCEASTHSGRCTPGVCKNGGTCVNLLVGGIKCDCPSGHFEKPFCQVTTRSFPARPFITFRGLHQRFHFTLALSFATKERNGLLLYNGRFNEKHDFVALEVIQEQVQLTFSAGESTTTVSPFVPGGVSDGQWHTVQLKYYNKPLLGQTGLPQGPSEQKVAVVSVDGCDTGVALRFGAMLGNYSCAAQGTQGGSKKSLDLTGPLLLGGVPDLPESFPVRMRHFVGCMKDLQVDSRHIDMADFIANNGTVPGCPTKKIVCDSSICHNGGTCVNQWNTFSCECPLGFGGKSCAQEMANPQRFLGSSLVAWHGLYLPISQPWHLNLMFRTRQADGVLLQAVTRGRSTITLQLRAGHVRLSMEGTGLQASSLHLEPGRANDGDWHHAQLALGASRGPGHAILSFNYGQQTAEGNLGPRLHGLHLSNITVGGVPGPASGVARGFRGCLQGVRVSETPEGVHSLDPSRGESINVEPGCSLPDPCDSNPCPTNSYYSNDWNSYSCSCVLGYYGDNCTNVCDLNPCEHQSVCTRKPNTPHGYICECLPNYLGPYCETRIDQPCPRGWWGHPTCGPCNCDVSKGFDPDCNKTSGECHCKEKHYRPPGSPTCLLCDCYPTGSLSRVCDPEDGQCPCKPGVIGRQCDRCDNPFAEVTTNGCEVNYDSCPRAIEAGIWWPRTRFGLPAAAPCPKGSFGTAVRHCDEHRGWLPPNLFNCTSVTFSELKGFAERLQRNESGLDSGRSQRLALLLRNATQHTSGYFGSDVKVAYQLATRLLAHESAQRGFGLSATQDVHFTENLLRVGSALLDAANKRHWELIQQTEGGTAWLLQHYEAYASALAQNMRHTYLSPFTIVTPNIVISVVRLDKGNFAGTKLPRYEALRGERPPDVETTVILPESVFREMPSMVRSAGPGEAQETEELARRQRRHPELSQGEAVASVIIYHTLAGLLPHNYDPDKRSLRVPKRPVINTPAVSISVHDDEELLPRALDKPVTVQFRLLETEERTKPICVFWNHSILVSGTGGWSARGCEVVFRNESHVSCQCNHMTSFAVLMDMSRRENGEILPLKTLTYVALGVTLAALMLTFLFLTLLRALRSNQHGIRRNLTAALGLAQLVFLLGINQADLPFACTVIAILLHFLYLCTFSWALLEALHLYRALTEVRDVNASPMRFYYMLGWGVPAFITGLAVGLDPEGYGNPDFCWLSVYDTLIWSFAGPVAFAVSMRVFLYILSARASCAAQRQGFEKKGPVSGLRSSFTVLLLLSATWLLALLSVNSDTLLFHYLFAACNCVQGPFIFLSYVVLSKEVRKALKFACSRKPSPDPALTTKYTLTSSYNCPSPYADGRLYQPYGDSAGSLHSASRSGKSQPSYIPFLLREESTLNPGQVPPGLGDPSGLFLEGQAQQHDPDTDSDSDLSLEDDQSGSYASTHSSDSEEEEEEAAFPGEQGWDSCLGPGAERLPLHSTPKDGGPGSGKVPWLGDFGTTTKENSGSGALEERPRENGDALTREGSLGPLPGPSTQPHKGILKKKCLPTISEKSSLLRLPLEQGTGSSRGSSISEGSRHGPPPRPPPRQSLQEQLNGVMPVAMSINAGTVDEDSSGSEFLFFNFLH

SEQ ID NO: 348 - protein, 3312 aa, Homo sapiens
MMARRPPWRGLGERSTPILLLLLLSLFPLSQEELGGGGHQGWDPGLAATTGPRAHIGGGALALCPESSGVREDGGPGLGVREPIFVGLRGRRQSARNSRGPPEQPNEELGIEHGVQPLGSRERETGQGPGSVLYWRPEVSSCGRTGPLQRGSLSPGALSSGVPGSGNSSPLPSDFLIRHHGPKPVSSQRNAGTGSRKRVGTARCCGELWATGSKGQGERATTSGAERTAPRRNCLPGASGSGPELDSAPRTARTAPASGSAPRESRTAPEPAPKRMRSRGLFRCRFLPQRPGPRPPGLPARPEARKVTSANRARFRRAANRHPQFPQYNYQTLVPENEAAGTAVLRVVAQDPDAGEAGRLVYSLAALMNSRSLELFSIDPQSGLIRTAAALDRESMERHYLRVTAQDHGSPRLSATTMVAVTVADRNDHSPVFEQAQYRETLRENVEEGYPILQLRATDGDAPPNANLRYRFVGPPAARAAAAAAFEIDPRSGLISTSGRVDREHMESYELVVEASDQGQEPGPRSATVRVHITVLDENDNAPQFSEKRYVAQVREDVRPHTVVLRVTATDRDKDANGLVHYNIISGNSRGHFAIDSLTGEIQVVAPLDFEAEREYALRIRAQDAGRPPLSNNTGLASIQVVDINDHIPIFVSTPFQVSVLENAPLGHSVIHIQAVDADHGENARLEYSLTGVAPDTPFVINSATGWVSVSGPLDRESVEHYFFGVEARDHGSPPLSASASVTVTVLDVNDNRPEFTMKEYHLRLNEDAAVGTSVVSVTAVDRDANSAISYQITGGNTRNRFAISTQGGVGLVTLALPLDYKQERYFKLVLTASDRALHDHCYVHINITDANTHRPVFQSAHYSVSVNEDRPMGSTIVVISASDDDVGENARITYLLEDNLPQFRIDADSGAITLQAPLDYEDQVTYTLAITARDNGIPQKADTTYVEVMVNDVNDNAPQFVASHYTGLVSEDAPPFTSVLQISATDRDAHANGRVQYTFQNGEDGDGDFTIEPTSGIVRTVRRLDREAVSVYELTAYAVDRGVPPLRTPVSIQVMVQDVNDNAPVFPAEEFEVRVKENSIVGSVVAQITAVDPDEGPNAHIMYQIVEGNIPELFQMDIFSGELTALIDLDYEARQEYVIVVQATSAPLVSRATVHVRLVDQNDNSPVLNNFQILFNNYVSNRSDTFPSGIIGRIPAYDPDVSDHLFYSFERGNELQLLVVNQTSGELRLSRKLDNNRPLVASMLVTVTDGLHSVTAQCVLRVVIITEELLANSLTVRLENMWQERFLSPLLGRFLEGVAAVLATPAEDVFIFNIQNDTDVGGTVLNVSFSALAPRGAGAGAAGPWFSSEELQEQLYVRRAALAARSLLDVLPFDDNVCLREPCENYMKCVSVLRFDSSAPFLASASTLFRPIQPIAGLRCRCPPGFTGDFCETELDLCYSNPCRNGGACARREGGYTCVCRPRFTGEDCELDTEAGRCVPGVCRNGGTCTDAPNGGFRCQCPAGGAFEGPRCEVAARSFPPSSFVMFRGLRQRFHLTLSLSFATVQQSGLLFYNGRLNEKHDFLALELVAGQVRLTYSTGESNTVVSPTVPGGLSDGQWHTVHLRYYNKPRTDALGGAQGPSKDKVAVLSVDDCDVAVALQFGAEIGNYSCAAAGVQTSSKKSLDLTGPLLLGGVPNLPENFPVSHKDFIGCMRDLHIDGRRVDMAAFVANNGTMAGCQAKLHFCDSGPCKNSGFCSERWGSFSCDCPVGFGGKDCQLTMAHPHHFRGNGTLSWNFGSDMAVSVPWYLGLAFRTRATQGVLMQVQAGPHSTLLCQLDRGLLSVTVTRGSGRASHLLLDQVTVSDGRWHDLRLELQEEPGGRRGHHVLMVSLDFSLFQDTMAVGSELQGLKVKQLHVGGLPPGSAEEAPQGLVGCIQGVWLGSTPSGSPALLPPSHRVNAEPGCVVTNACASGPCPPHADCRDLWQTFSCTCQPGYYGPGCVDACLLNPCQNQGSCRHLPGAPHGYTCDCVGGYFGHHCEHRMDQQCPRGWWGSPTCGPCNCDVHKGFDPNCNKTNGQCHCKEFHYRPRGSDSCLPCDCYPVGSTSRSCAPHSGQCPCRPGALGRQCNSCDSPFAEVTASGCRVLYDACPKSLRSGVWWPQTKFGVLATVPCPRGALGAAVRLCDEAQGWLEPDLFNCTSPAFRELSLLLDGLELNKTALDTMEAKKLAQRLREVTGHTDHYFSQDVRVTARLLAHLLAFESHQQGFGLTATQDAHFNENLLWAGSALLAPETGDLWAALGQRAPGGSPGSAGLVRHLEEYAATLARNMELTYLNPMGLVTPNIMLSIDRMEHPSSPRGARRYPRYHSNLFRGQDAWDPHTHVLLPSQSPRPSPSEVLPTSSSIENSTTSSVVPPPAPPEPEPGISIIILLVYRTLGGLLPAQFQAERRGARLPQNPVMNSPVVSVAVFHGRNFLRGILESPISLEFRLLQTANRSKAICVQWDPPGLAEQHGVWTARDCELVHRNGSHARCRCSRTGTFGVLMDASPRERLEGDLELLAVFTHVVVAVSVAALVLTAAILLSLRSLKSNVRGIHANVAAALGVAELLFLLGIHRTHNQLVCTAVAILLHYFFLSTFAWLFVQGLHLYRMQVEPRNVDRGAMRFYHALGWGVPAVLLGLAVGLDPEGYGNPDFCWISVHEPLIWSFAGPVVLVIVMNGTMFLLAARTSCSTGQREAKKTSALTLRSSFLLLLLVSASWLFGLLAVNHSILAFHYLHAGLCGLQGLAVLLLFCVLNADARAAWMPACLGRKAAPEEARPAPGLGPGAYNNTALFEESGLIRITLGASTVSSVSSARSGRTQDQDSQRGRSYLRDNVLVRHGSAADHTDHSLQAHAGPTDLDVAMFHRDAGADSDSDSDLSLEEERSLSIPSSESEDNGRTRGRFQRPLCRAAQSERLLTHPKDVDGNDLLSYWPALGECEAAPCALQTWGSERRLGLDTSKDAANNNQPDPALTSGDETSLGRAQRQRKGILKNRLQYPLVPQTRGAPELSWCRAATLGHRAVPAASYGRIYAGGGTGSLSQPASRYSSREQLDLLLRRQLSRERLEEAPAPVLRPLSRPGSQECMDAAPGRLEPKDRGSTLPRRQPPRDYPGAMAGRFGSRDALDLGAPREWLSTLPPPRRTRDLDPQPPPLPLSPQRQLSRDPLLPSRPLDSLSRSSNSREQLDQVPSRHPSREALGPLPQLLRAREDSVSGPSHGPSTEQLDILSSILASFNSSALSSVQSSSTPLGPHTTATPSATASVLGPSTPRSATSHSISELSPDSEVPRSEGHS

SEQ ID NO: 349 - protein, 3301 aa, Mus musculus
MARRPLWWGLPGPSTPVLLLLLLSLFPFSREELGGGGDQDWDPGVATTTGPRAQIGSGAVALCPESPGVWEDGDPGLGVREPVFMRLRVGRQNARNGRGAPEQPNAEVVVQALGSREQEAGQGPGYLLCWHPEISSCGRTGPLRRGSLPLDALSPGDSDLRNSSPHPSELLAQPDGSRPVAFQRNARRSIRKRVETSRCCGKLWEPGHKGQGERSATSTVERGPFRRDCLPGSLGSGLGEDSAPRAVRTAPTPGSAPRESRTAPGRMRSRGLFRRRFLFERPGPRPPGFPTGPEAKQILSTNQARPRRAANRHPQFPQYNYQTLVPENEAAGTSVLRVVAQDPDPGEAGRLIYSLAALMNSRSLELFSIDPQSGLIRTAAALDRESMERHYLRVTAQDHGSPRLSATTMVAVTVADRNDHAPVFEQAQYRETLRENVEEGYPILQLRATDGDAPPNANLRYRFVGSPAVRTAAAAAFEIDPRSGLISTSGRVDREHMESYELVVEASDQGQEPGPRSATVRVHITVLDENDNAPQFGEKRYVAQVREDVRPHTVVLRVTATDKDKDANGLVHYNIISGNSRGHFAIDSLTGEIQVMAPLDFEAEREYALRIRAQDAGRPPLSNNTGLASIQVVDINDHAPIFVSTPFQVSVLENAPLGHSVIHIQAVDADHGENSRLEYSLTGVASDTPFVINSATGWVSVSGPLDRESVEHYFFGVEARDHGSPPLSASASVTVTVLDVNDNRPEFTMKEYHLRLNEDAAVGTSVVSVTAVDRDANSAISYQITGGNTRNRFAISTQGGVGLVTLALPLDYKQERYFKLVLTASDRALHDHCYVHINITDANTHRPVFQSAHYSVSMNEDRPVGSTVVVISASDDDVGENARITYLLEDNLPQFRIDADSGAITLQAPLDYEDQVTYTLAITARDNGIPQKADTTYVEVMVNDVNDNAPQFVASHYTGLVSEDAPPFTSVLQISATDRDAHANGRVQYTFQNGEDGDGDFTIEPTSGIVRTVRRLDREAVPVYELTAYAVDRGVPPLRTPVSIQVTVQDVNDNAPVFPAEEFEVRVKENSIVGSVVAQITAVDPDDGPNAHIMYQIVEGNIPELFQMDIFSGELTALIDLDYEARQEYVIVVQATSAPLVSRATVHVRLVDQNDNSPVLNNFQILFNNYVSNRSDTFPSGIIGRIPAYDPDVSDHLFYSFERGNELQLLVVNRTSGELRLSRKLDNNRPLVASMLVTVTDGLHSVTAQCVLRVVIITEELLANSLTVRLENMWQERFLSPLLGHFLEGVAAVLATPTEDVFIFNIQNDTDVGGTVLNVSFSALAPRGAGAGAAGPWFSSEELQEQLYVRRAALAARSLLDVLPFDDNVCLREPCENYMKCVSVLRFDSSAPFLASTSTLFRPIQPIAGLRCRCPPGFTGDFCETELDLCYSNPCRNGGACARREGGYTCVCRPRFTDCELDTEAGRCVPGVCRNGGTCTNAPNGGFRCQCPAGGAFEGPRCEVAARSFPPSSFVMFRGLRQRFHLTLSLSFATVQPSGLLFYNGRLNEKHDFLALELVAGQVRLTYSTGESNTVVSPTVPGGLSDGQWHTVHLRYYNKPRTDALGGAQGPSKDKVAVLSVDDCNVAVALQFGAEIGNYSCAAAGVQTSSKKSLDLTGPLLLGGVPNLPENFPVSHKDFIGCMRDLHIDGRRMDMAAFVANNGTMAGCQAKSHFCASGPCKNNGFCSERWGGFSCDCPVGFGGKDCRLTMAHPYHFQGNGTLSWDFGNDMAVSVPWYLGLSFRTRATKGILMQVQLGPHSVLLCKLDRGLLSVTLNRASGHTVHLLLDQMTVSDGRWHDLRLELQEEPGGRRGHHIFMVSLDFTLFQDTMAMGGELQGLKVKQLHVGGLPPSSKEEGHQGLVGCIQGVWIGFTPFGSSALLPPSHRVNVEPGCTVTNPCASGPCPPHADCKDLWQTFSCTCRPGYYGPGCVDACLLNPCQNQGSCRHLQGAPHGYTCDCVSGYFGQHCEHRVDQQCPRGWWGSPTCGPCNCDVHKGFDPNCNKTNGQCHCKEFHYRPRGSDSCLPCDCYPVGSTSRSCAPHSGQCPCRPGALGRQCNSCDSPFAEVTASGCRVLYDACPKSLRSGVWWPQTKFGVLATVPCPRGALGAAVRLCDEDQGWLEPDLFNCTSPAFRELSLLLDGLELNKTALDTVEAKKLAQRLREVTGQTDHYFSQDVRVTARLLAYLLAFESHQQGFGLTATQDAHFNENLLWAGSALLAPETGHLWAALGQRAPGGSPGSAGLVQHLEEYAATLARNMELTYLNPVGLVTPNIMLSIDRMEHPSSTQGARRYPRYHSNLFRGQDAWDPHTHVLLPSQASQPSPSEVLPTSSNAENATASSVVSPPAPLEPESEPGISIVILLVYRALGGLLPAQFQAERRGARLPQNPVMNSPVVSVAVFHGRNFLRGVLVSPINLEFRLLQTANRSKAICVQWDPPGPTDQHGMWTARDCELVHRNGSHARCRCSRTGTFGVLMDASPRERLEGDLELLAVFTHVVVAVSVTALVLTAAVLLSLRSLKSNVRGIHANVAAALGVAELLFLLGIHRTHNQLLCTAVAILLHYFFLSTFAWLLVQGLHLYRMQVEPRNVDRGAMRFYHALGWGVPAVLLGLAVGLDPEGYGNPDFCWISIHEPLIWSFAGPIVLVIVMNGTMFLLAARTSCSTGQREAKKTSVLTLRSSFLLLLLVSASWLFGLLAVNHSILAFHYLHAGLCGLQGLAVLLLFCVLNADARAAWTPACLGKKAAPEETRPAPGPGSGAYNNTALFEESGLIRITLGASTVSSVSSARSGRAQDQDSQRGRSYLRDNVLVRHGSTAEHTERSLQAHAGPTDLDVAMFHRDAGADSDSDSDLSLEEERSLSIPSSESEDNGRTRGRFQRPLRRAAQSERLLAHPKDVDGNDLLSYWPALGECEAAPCALQAWGSERRLGLDSNKDAANNNQPELALTSGDETSLGRAQRQRKGILKNRLQYPLVPQSRGTPELSWCRAATLGHRAVPAASYGRIYAGGGTGSLSQPASRYSSREQLDLLLRRQLSKERLEEVPVPAPVLHPLSRPGSQERLDTAPARLEARDRGSTLPRRQPPRDYPGTMAGRFGSRDALDLGAPREWLSTLPPPRRNRDLDPQHPPLPLSPQRQLSRDPLLPSRPLDSLSRISNSREGLDQVPSRHPSREALGPAPQLLRAREDPASGPSHGPSTEQLDILSSILASFNSSALSSVQSSSTPSGPHTTATASALGPSTPRSATSHSISELSPDSEVPRSEGHS

SEQ ID NO: 350 - protein, 460 aa, Homo sapiens
MNTSAPPAVSPNITVLAPGKGPWQVAFIGITTGLLSLATVTGNLLVLISFKVNTELKTVNNYFLLSLACADLIIGTFSMNLYTTYLLMGHWALGTLACDLWLALDYVASNASVMNLLLISFDRYFSVTRPLSYRAKRTPRRAALMIGLAWLVSFVLWAPAILFWQYLVGERTVLAGQCYIQFLSQPIITFGTAMAAFYLPVTVMCTLYWRIYRETENRARELAALQGSETPGKGGGSSSSSERSQPGAEGSPETPPGRCCRCCRAPRLLQAYSWKEEEEEDEGSMESLTSSEGEEPGSEVVIKMPMVDPEAQAPTKQPPRSSPNTVKRPTKKGRDRAGKGQKPRGKEQLAKRKTFSLVKEKKAARTLSAILLAFILTWTPYNIMVLVSTFCKDCVPETLWELGYWLCYVNSTINPMCYALCNKAFRDTFRLLLLCRWDKRRWRKIPKRPGSVHRTPSRQC

SEQ ID NO: 351 - protein, 460 aa, Mus musculus
MNTSVPPAVSPNITVLAPGKGPWQVAFIGSTTGLLSLATVTGNLLVLISIKVNTELKTVNNYFLLSLACADLIIGTFSMNLYTTYLLMGHWALGTLACDLWLALDYVASNASVMNLLLISFDRYFSVTRPLSYRAKRTPRRAALMIGLAWLVSFVLWAPAILFWQYLVGERTVLAGQCYIQFLSQPIITFGTAMAAFYLPVTVMCTLYWRIYRETENRARELAALQGSETPGKGGGSSSSSERSQPGAEGSPESPPGRCCRCCRAPRLLQAYSWKEEEEEDEGSMESLTSSEGEEPGSEVVIKMPMVDPEAQAPTKQPPKSSPNTVKRPTKKGRDRGGKGQKPRGKEQLAKRKTFSLVKEKKAARTLSAILLAFILTWTPYNIMVLVSTFCKDCVPETLWELGYWLCYVNSTVNPMCYASCNKAFRDHFRLLLLCRWDKRRWRKIPKRPGSVHRTPSRQC

SEQ ID NO: 352 - protein, 466 aa, Homo sapiens
MNNSTNSSNNSLALTSPYKTFEVVFIVLVAGSLSLVTIIGNILVMVSIKVNRHLQTVNNYFLFSLACADLIIGVFSMNLYTLYTVIGYWPLGPVVCDLWLALDYVVSNASVMNLLIISFDRYFCVTKPLTYPVKRTTKMAGMMIAAAWVLSFILWAPAILFWQFIVGVRTVEDGECYIQFFSNAAVTFGTAIAAFYLPVIIMTVLYWHISRASKSRIKKDKKEPVANQDPVSPSLVQGRIVKPNNNNMPSSDDGLEHNKIQNGKAPRDPVTENCVQGEEKESSNDSTSVSAVASNMRDDEITQDENTVSTSLGHSKDENSKQTCIRIGTKTPKSDSCTPTNTTVEVVGSSGQNGDEKQNIVARKIVKMTKQPAKKKPPPSREKKVTRTILAILLAFIITWAPYNVMVLINTFCAPCIPNTVWTIGYWLCYINSTINPACYALCNATFKKTFKHLLMCHYKNIGATR

SEQ ID NO: 353 - protein, 466 aa, Mus musculus
MNNSTNSSNNGLAITSPYKTFEVVFIVLVAGSLSLVTIIGNILVMVSIKVNRHLQTVNNYFLFSLACADLIIGVFSMNLYTLYTVIGYWPLGPVVCDLWLALDYVVSNASVMNLLIISFDRYFCVTKPLTYPVKRTTKMAGMMIAAAWVLSFILWAPAILFWQFIVGVRTVEDGECYIQFFSNAAVTFGTAIAAFYLPVIIMTVLYWHISRASKSRIKKEKKEPVANQDPVSPSLVQGRIVKPNNNNMPGGDGGLEHNKIQNGKALRDGGTENCVQGEEKESSNDSTSVSAVASNMRDDEITQDENTVSTSLGHSKDDNSRQTCIKIVTKTQKGDACTPTSTTVELVGSSGQNGDEKQNIVARKIVKMTKQPAKKKPPPSREKKVTRTILAILLAFIITWAPYNVMVLINTFCAPCIPNTVWTIGYWLCYINSTINPACYALCNATFKKTFKHLLMCHYKNIGATR

SEQ ID NO: 354 - protein, 590 aa, Homo sapiens
MTLHNNSTTSPLFPNISSSWIHSPSDAGLPPGTVTHFGSYNVSRAAGNFSSPDGTTDDPLGGHTVWQVVFIAFLTGILALVTIIGNILVIVSFKVNKQLKTVNNYFLLSLACADLIIGVISMNLFTTYIIMNRWALGNLACDLWLAIDYVASNASVMNLLVISFDRYFSITRPLTYRAKRTTKRAGVMIGLAWVISFVLWAPAILFWQYFVGKRTVPPGECFIQFLSEPTITFGTAIAAFYMPVTIMTILYWRIYKETEKRTKELAGLQASGTEAETENFVHPTGSSRSCSSYELQQQSMKRSNRRKYGRCHFWFTTKSWKPSSEQMDQDHSSSDSWNNNDAAASLENSASSDEEDIGSETRAIYSIVLKLPGHSTILNSTKLPSSDNLQVPEEELGMVDLERKADKLQAQKSVDDGGSFPKSFSKLPIQLESAVDTAKTSDVNSSVGKSTATLPLSFKEATLAKRFALKTRSQITKRKRMSLVKEKKAAQTLSAILLAFIITWTPYNIMVLVNTFCDSCIPKTFWNLGYWLCYINSTVNPVCYALCNKTFRTTFKMLLLCQCDKKKRRKQQYQQRQSVIFHKRAPEQAL

SEQ ID NO: 355 - protein, 589 aa, Mus musculus
MTLHSNSTTSPLFPNISSSWVHSPSEAGLPLGTVSQLDSYNISQTSGNFSSNDTSSDPLGGHTIWQVVFIAFLTGFLALVTIIGNILVIVAFKVNKQLKTVNNYFLLSLACADLIIGVISMNLFTTYIIMNRWALGNLACDLWLSIDYVASNASVMNLLVISFDRYFSITRPLTYRAKRTTKRAGVMIGLAWVISFVLWAPAILFWQYFVGKRTVPPGECFIQFLSEPTITFGTAIAAFYMPVTIMTILYWRIYKETEKRTKELAGLQASGTEAEAENFVHPTGSSRSCSSYELQQQGTKRSSRRKYGGCHFWFTTKSWKPSAEQMDQDHSSSDSWNNNDAAASLENSASSDEEDIGSETRAIYSIVLKLPGHSTILNSTKLPSSDNLQVPDKDLGTMDVERNAHKLQAQKSMDDRDNCQKDFSKLPIQLESAVDTAKTSDTNSSVDKTTAALPLSFKEATLAKRFALKTRSQITKRKRMSLIKEKKAAQTLSAILLAFIITWTPYNIMVLVNTFCDSCIPKTYWNLGYWLCYINSTVNPVCYALCNKTFRTTFKMLLLCQCDKRKRRKQQYQQRQSVIFHKRVPEQAL

SEQ ID NO: 356 - protein, 478 aa, Homo sapiens
MANFTPVNGSSGNQSVRLVTSSSHNRYETVEMVFIATVTGSLSLVTVVGNILVMLSIKVNRQLQTVNNYFLFSLACADLIIGAFSMNLYTVYIIKGYWPLGAVVCDLWLALDYVVSNASVMNLLIISFDRYFCVTKPLTYPARRTTKMAGLMIAAAWVLSFVLWAPAILFWQFVVGKRTVPDNHCFIQFLSNPAVTFGTAIAAFYLPVVIMTVLYIHISLASRSRVHKHRPEGPKEKKAKTLAFLKSPLMKQSVKKPRPGGRPGGLRNGKLEEAPPPALPPPPRPVADKDTSNESSSGSATQNTKERPATELSTTEATTPAMPAPPLQPRALNPASRWSKIQIVTKQTGNECVTAIEIVPATPAGMRPAANVARKFASIARNQVRKKRQMAARERKVTRTIFAILLAFILTWTPYNVMVLVNTFCQSCIPDTVWSIGYWLCYVNSTINPACYALCNATFKKTFRHLLLCQYRNIGTAR

SEQ ID NO: 357 - protein, 479 aa, Mus musculus
MANFTPVNGSSANQSVRLVTTAHNHLETVEMVFIATVTGSLSLVTVVGNILVMLSIKVNRQLQTVNNYFLFSLACADLIIGAFSMNLYTLYIIKGYWPLGAVVCDLWLALDYVVSNASVMNLLIISFDRYFCVTKPLTYPARRTTKMAGLMIAAAWVLSFVLWAPAILFWQFVVGKRTVPDNQCFIQFLSNPAVTFGTAIAAFYLPVVIMTVLYIHISLASRSRVHKHRPEGPKEKKAKTLAFLKSPLMKPSIKKPPPGGASREELRNGKLEEAPPPALPPPPRPVADKDTSNESSSGSATQNTKERPPTELSTTEAATTPALPAPTLQPRTLNPASKWSKIQIVTKQTGSECVTAIEIVPATPAGMRPAANVARKFASIARNQVRKKRQMAARERKVTRTIFAILLAFILTWTPYNVMVLVNTFCQSCIPERVWSIGYWLCYVNSTINPACYALCNATFKKTFRHLLLCQYRNIGTAR

SEQ ID NO: 358 - protein, 532 aa, Homo sapiens
MEGDSYHNATTVNGTPVNHQPLERHRLWEVITIAAVTAVVSLITIVGNVLVMISFKVNSQLKTVNNYYLLSLACADLIIGIFSMNLYTTYILMGRWALGSLACDLWLALDYVASNASVMNLLVISFDRYFSITRPLTYRAKRTPKRAGIMIGLAWLISFILWAPAILCWQYLVGKRTVPLDECQIQFLSEPTITFGTAIAAFYIPVSVMTILYCRIYRETEKRTKDLADLQGSDSVTKAEKRKPAHRALFRSCLRCPRPTLAQRERNQASWSSSRRSTSTTGKPSQATGPSANWAKAEQLTTCSSYPSSEDEDKPATDPVLQVVYKSQGKESPGEEFSAEETEETFVKAETEKSDYDTPNYLLSPAAAHRPKSQKCVAYKFRLVVKADGNQETNNGCHKVKIMPCPFPVAKEPSTKGLNPNPSHQMTKRKRVVLVKERKAAQTLSAILLAFIITWTPYNIMVLVSTFCDKCVPVTLWHLGYWLCYVNSTVNPICYALCNRTFRKTFKMLLLCRWKKKKVEEKLYWQGNSKLP

SEQ ID NO: 359 - protein, 532 aa, Mus musculus
MEGESYHNETTVNGTPVNHQALERHGLWEVITIAAVTAVVSLMTIVGNVLVMISFKVNSQLKTVNNYYLLSLACADLIIGIFSMNLYTTYILMGRWVLGSLACDLWLALDYVASNASVMNLLVISFDRYFSITRPLTYRAKRTPKRAGIMIGLAWLVSFILWAPAILCWQYLVGKRTVPPDECQIQFLSEPTITFGTAIAAFYIPVSVMTILYCRIYRETEKRTKDLADLQGSDSVAEVKKRKPAHRTLLRSFFSCPRPSLAQRERNQASWSSSRRSTSTTGKPTQATDLSADWEKAEQVTNCSSCPSSEDEAKATTDPVFQVVYKNEAKESPGKEFNTQETKETFVSPRTENNDYDTPKYFLSPGAAHRLKSQKCVAYKFRLVVKADGTQETNNGCRKVKIMPCSFPVSKDPSTKGLDPHLSHQMTKRKRMVLVKERKAAQTLSAILLAFIITWTPYNIMVLVSTFCDKCVPVTLWHLGYWLCYVNSTINPICYALCNRTFRKTFKLLLLCRWKKKKVEEKLYWQGNSKLP

SEQ ID NO: 360 - protein, 373 aa, Homo sapiens
MRMEDEDYNTSISYGDEYPDYLDSIVVLEDLSPLEARVTRIFLVVVYSIVCFLGILGNGLVIIIATFKMKKTVNMVWFLNLAVADFLFNVFLPIHITYAAMDYHWVFGTAMCKISNFLLIHNMFTSVFLLTIISSDRCISVLLPVWSQNHRSVRLAYMACMVIWVLAFFLSSPSLVFRDTANLHGKISCFNNFSLSTPGSSSWPTHSQMDPVGYSRHMVVTVTRFLCGFLVPVLIITACYLTIVCKLQRNRLAKTKKPFKIIVTIIITFFLCWCPYHTLNLLELHHTAMPGSVFSLGLPLATALAIANSCMNPILYVFMGQDFKKFKVALFSRLVNALSEDTGHSSYPSHRSFTKMSSMNERTSMNERETGML

SEQ ID NO: 361 - protein, 371 aa, Mus musculus
MEYDAYNDSGIYDDEYSDGFGYFVDLEEASPWEAKVAPVFLVVIYSLVCFLGLLGNGLVIVIATFKMKKTVNTVWFVNLAVADFLFNIFLPMHITYAAMDYHWVFGKAMCKISNFLLSHNMYTSVFLLTVISFDRCISVLLPVWSQNHRSIRLAYMTCSAVWVLAFFLSSPSLVFRDTANIHGKITCFNNFSLAAPESSPHPAHSQVVSTGYSRHVAVTVTRFLCGFLIPVFIITACYLTIVFKLQRNRLAKNKKPFKIIITIIITFFLCWCPYHTLYLLELHHTAVPSSVFSLGLPLATAVAIANSCMNPILYVFMGHDFRKFKVALFSRLANALSEDTGPSSYPSHRSFTKMSSLNEKASVNEKETSTL

SEQ ID NO: 362 - protein, 472 aa, Homo sapiens
MKSILDGLADTTFRTITTDLLYVGSNDIQYEDIKGDMASKLGYFPQKFPLTSFRGSPFQEKMTAGDNPQLVPADQVNITEFYNKSLSSFKENEENIQCGENFMDIECFMVLNPSQQLAIAVLSLTLGTFTVLENLLVLCVILHSRSLRCRPSYHFIGSLAVADLLGSVIFVYSFIDFHVFHRKDSRNVFLFKLGGVTASFTASVGSLFLTAIDRYISIHRPLAYKRIVTRPKAVVAFCLMWTIAIVIAVLPLLGWNCEKLQSVCSDIFPHIDETYLMFWIGVTSVLLLFIVYAYMYILWKAHSHAVRMIQRGTQKSIIIHTSEDGKVQVTRPDQARMDIRLAKTLVLILVVLIICWGPLLAIMVYDVFGKMNKLIKTVFAFCSMLCLLNSTVNPIIYALRSKDLRHAFRSMFPSCEGTAQPLDNSMGDSDCLHKHANNAASVHRAAESCIKSTVKIAKVTMSVSTDTSAEAL

SEQ ID NO: 363 - protein, 473 aa, Mus musculus
MKSILDGLADTTFRTITTDLLYVGSNDIQYEDIKGDMASKLGYFPQKFPLTSFRGSPFQEKMTAGDNSPLVPAGDTTNITEFYNKSLSSFKENEDNIQCGENFMDMECFMILNPSQQLAIAVLSLTLGTFTVLENLLVLCVILHSRSLRCRPSYHFIGSLAVADLLGSVIFVYSFVDFHVFHRKDSPNVFLFKLGGVTASFTASVGSLFLTAIDRYISIHRPLAYKRIVTRPKAVVAFCLMWTIAIVIAVLPLLGWNCKKLQSVCSDIFPLIDETYLMFWIGVTSVLLLFIVYAYMYILWKAHSHAVRMIQRGTQKSIIIHTSEDGKVQVTRPDQARMDIRLAKTLVLILVVLIICWGPLLAIMVYDVFGKMNKLIKTVFAFCSMLCLLNSTVNPIIYALRSKDLRHAFRSMFPSCEGTAQPLDNSMGDSDCLHKHANNTASMHRAAESCIKSTVKIAKVTMSVSTDTSAEAL

SEQ ID NO: 364 - protein, 360 aa, Homo sapiens
MEECWVTEIANGSKDGLDSNPMKDYMILSGPQKTAVAVLCTLLGLLSALENVAVLYLILSSHQLRRKPSYLFIGSLAGADFLASVVFACSFVNFHVFHGVDSKAVFLLKIGSVTMTFTASVGSLLLTAIDRYLCLRYPPSYKALLTRGRALVTLGIMWVLSALVSYLPLMGWTCCPRPCSELFPLIPNDYLLSWLLFIAFLFSGIIYTYGHVLWKAHQHVASLSGHQDRQVPGMARMRLDVRLAKTLGLVLAVLLICWFPVLALMAHSLATTLSDQVKKAFAFCSMLCLINSMVNPVIYALRSGEIRSSAHHCLAHWKKCVRGLGSEAKEEAPRSSVTETEADGKITPWPDSRDLDLSDC

SEQ ID NO: 365 - protein, 347 aa, Mus musculus
MEGCRETEVTNGSNGGLEFNPMKEYMILSSGQQIAVAVLCTLMGLLSALENMAVLYIILSSRRLRRKPSYLFISSLAGADFLASVIFACNFVIFHVFHGVDSNAIFLLKIGSVTMTFTASVGSLLLTAVDRYLCLCYPPTYKALVTRGRALVALCVMWVLSALISYLPLMGWTCCPSPCSELFPLIPNDYLLGWLLFIAILFSGIIYTYGYVLWKAHRHVATLAEHQDRQVPGIARMRLDVRLAKTLGLVLAVLLICWFPALALMGHSLVTTLSDQVKEAFAFCSMLCLVNSMVNPIIYALRSGEIRSAAQHCLIGWKKYLQGLGPEGKEEGPRSSVTETEADVKTT

SEQ ID NO: 366 - protein, 415 aa, Homo sapiens
MGGHPQLRLVKALLLLGLNPVSASLQDQHCESLSLASNISGLQCNASVDLIGTCWPRSPAGQLVVRPCPAFFYGVRYNTTNNGYRECLANGSWAARVNYSECQEILNEEKKSKVHYHVAVIINYLGHCISLVALLVAFVLFLRLRSIRCLRNIIHWNLISAFILRNATWFVVQLTMSPEVHQSNVGWCRLVTAAYNYFHVTNFFWMFGEGCYLHTAIVLTYSTDRLRKWMFICIGWGVPFPIIVAWAIGKLYYDNEKCWFGKRPGVYTDYIYQGPMILVLLINFIFLFNIVRILMTKLRASTTSETIQYRKAVKATLVLLPLLGITYMLFFVNPGEDEVSRVVFIYFNSFLESFQGFFVSVFYCFLNSEVRSAIRKRWHRWQDKHSIRARVARAMSIPTSPTRVSFHSIKQSTAV

SEQ ID NO: 367 - protein, 415 aa, Mus musculus
MGQRPQLRLVKALLLLGLNPVSTSLQDQQCESLSLASNVSGLQCNASVDLIGTCWPRSPAGQLVVRPCPAFFYGVRYNTTNNGYRECLANGSWAARVNYSECQEILNEEKKSKVHYHIAVIINYLGHCISLVALLVAFVLFLRLRSIRCLRNIIHWNLISAFILRNATWFVVQLTVSPEVHQSNVAWCRLVTAAYNYFHVTNFFWMFGEGCYLHTAIVLTYSTDRLRKWMFVCIGWGVPFPIIVAWAIGKLYYDNEKCWFGKRPGVYTDYIYQGPMILVLLINFIFLFNIVRILMTKLRASTTSETIQYRKAVKATLVLLPLLGITYMLFFVNPGEDEVSRVVFIYFNSFLESFQGFFVSVFYCFLNSEVRSAIRKRWRRWQDKHSIRARVARAMSIPTSPTRVSFHSIKQSTAV

SEQ ID NO: 368 - protein, 411 aa, Homo sapiens
MDAALLHSLLEANCSLALAEELLLDGWGPPLDPEGPYSYCNTTLDQIGTCWPRSAAGALVERPCPEYFNGVKYNTTRNAYRECLENGTWASKINYSQCEPILDDKQRKYDLHYRIALVVNYLGHCVSVAALVAAFLLFLALRSIRCLRNVIHWNLITTFILRNVMWFLLQLVDHEVHESNEVWCRCITTIFNYFVVTNFFWMFVEGCYLHTAIVMTYSTERLRKCLFLFIGWCIPFPIIVAWAIGKLYYENEQCWFGKEPGDLVDYIYQGPIILVLLINFVFLFNIVRILMTKLRASTTSETIQYRKAVKATLVLLPLLGITYMLFFVNPGEDDLSQIMFIYFNSFLQSFQGFFVSVFYCFFNGEVRSAVRKRWHRWQDHHSLRVPMARAMSIPTSPTRISFHSIKQTAAV

SEQ ID NO: 369 - protein, 431 aa, Mus musculus
MGTPGSLPSAQLLLCLFSLLPVLQVAQPGQAPQDQPLWTLLEQYCHRTTIGNFSGPYTYCNTTLDQIGTCWPQSAPGALVERPCPEYFNGIKYNTTRNAYRECLENGTWASRVNYSHCEPILDDKQRKYDLHYRIALIVNYLGHCVSVVALVAAFLLFLVLRSIRCLRNVIHWNLITTFILRNIAWFLLQLIDHEVHEGNEVWCRCITTIFNYFVVTNFFWMFVEGCYLHTAIVMTYSTEHLRKWLFLFIGWCIPCPIIIAWAVGKLYYENEQCWFGKEAGDLVDYIYQGPVMLVLLINFVFLFNIVRILMTKLRASTTSETIQYRKAVKATLVLLPLLGITYMLFFVNPGEDDLSQIVFIYFNSFLQSFQGFFVSVFYCFFNGEVRAALRKRWHRWQDHHALRVPVARAMSIPTSPTRISFHSIKQTAAV

SEQ ID NO: 370 - protein, 355 aa, Homo sapiens
MDQFPESVTENFEYDDLAEACYIGDIVVFGTVFLSIFYSVIFAIGLVGNLLVVFALTNSKKPKSVTDIYLLNLALSDLLFVATLPFWTHYLINEKGLHNAMCKFTTAFFFIGFFGSIFFITVISIDRYLAIVLAANSMNNRTVQHGVTISLGVWAAAILVAAPQFMFTKQKENECLGDYPEVLQEIWPVLRNVETNFLGFLLPLLIMSYCYFRIIQTLFSCKNHKKAKAIKLILLVVIVFFLFWTPYNVMIFLETLKLYDFFPSCDMRKDLRLALSVTETVAFSHCCLNPLIYAFAGEKFRRYLYHLYGKCLAVLCGRSVHVDFSSSESQRSRHGSVLSSNFTYHTSDGDALLLL

SEQ ID NO: 371 - protein, 354 aa, Mus musculus
MSTSFPELDLENFEYDDSAEACYLGDIVAFGTIFLSVFYALVFTFGLVGNLLVVLALTNSRKPKSITDIYLLNLALSDLLFVATLPFWTHYLISHEGLHNAMCKLTTAFFFIGFFGGIFFITVISIDRYLAIVLAANSMNNRTVQHGVTISLGVWAAAILVASPQFMFTKRKDNECLGDYPEVLQEMWPVLRNSEVNILGFALPLLIMSFCYFRIIQTLFSCKNRKKARAVRLILLVVFAFFLFWTPYNIMIFLETLKFYNFFPSCDMKRDLRLALSVTETVAFSHCCLNPFIYAFAGEKFRRYLGHLYRKCLAVLCGHPVHTGFSPESQRSRQDSILSSFTHYTSEGDGSLLL

SEQ ID NO: 372 - protein, 352 aa, Homo sapiens
MEGISIYTSDNYTEEMGSGDYDSMKEPCFREENANFNKIFLPTIYSIIFLTGIVGNGLVILVMGYQKKLRSMTDKYRLHLSVADLLFVITLPFWAVDAVANWYFGNFLCKAVHVIYTVNLYSSVLILAFISLDRYLAIVHATNSQRPRKLLAEKVVYVGVWIPALLLTIPDFIFANVSEADDRYICDRFYPNDLWVVVFQFQHIMVGLILPGIVILSCYCIIISKLSHSKGHQKRKALKTTVILILAFFACWLPYYIGISIDSFILLEIIKQGCEFENTVHKWISITEALAFFHCCLNPILYAFLGAKFKTSAQHALTSVSRGSSLKILSKGKRGGHSSVSTESESSSFHSS

SEQ ID NO: 373 - protein, 359 aa, Mus musculus
MEPISVSIYTSDNYSEEVGSGDYDSNKEPCFRDENVHFNRIFLPTIYFIIFLTGIVGNGLVILVMGYQKKLRSMTDKYRLHLSVADLLFVITLPFWAVDAMADWYFGKFLCKAVHIIYTVNLYSSVLILAFISLDRYLAIVHATNSQRPRKLLAEKAVYVGVWIPALLLTIPDFIFADVSQGDISQGDDRYICDRLYPDSLWMVVFQFQHIMVGLILPGIVILSCYCIIISKLSHSKGHQKRKALKTTVILILAFFACWLPYYVGISIDSFILLGVIKQGCDFESIVHKWISITEALAFFHCCLNPILYAFLGAKFKSSAQHALNSMSRGSSLKILSKGKRGGHSSVSTESESSSFHSS

SEQ ID NO: 374 - protein, 342 aa, Homo sapiens
MAEHDYHEDYGFSSFNDSSQEEHQDFLQFSKVFLPCMYLVVFVCGLVGNSLVLVISIFYHKLQSLTDVFLVNLPLADLVFVCTLPFWAYAGIHEWVFGQVMCKSLLGIYTINFYTSMLILTCITVDRFIVVVKATKAYNQQAKRMTWGKVTSLLIWVISLLVSLPQIIYGNVFNLDKLICGYHDEAISTVVLATQMTLGFFLPLLTMIVCYSVIIKTLLHAGGFQKHRSLKIIFLVMAVFLLTQMPFNLMKFIRSTHWEYYAMTSFHYTIMVTEAIAYLRACLNPVLYAFVSLKFRKNFWKLVKDIGCLPYLGVSHQWKSSEDNSKTFSASHNVEATSMFQL

SEQ ID NO: 375 - protein, 351 aa, Mus musculus
MDDGHQESALYDGHYEGDFWLFNNSSDNSQENKRFLKFKEVFLPCVYLVVFVFGLLGNSLVLIIYIFYQKLRTLTDVFLLNLPLADLVFVCTLPFWAYAGTYEWVFGTVMCKTLRGMYTMNFYVSMLTLTCITVDRFIVVVQATKAFNRQAKWKIWGQVICLLIWVVSLLVSLPQIIYGHVQDIDKLICQYHSEEISTMVLVIQMTLGFFLPLLTMILCYSGIIKTLLHARNFQKHKSLKIIFLVVAVFLLTQTPFNLAMLIQSTSWEYYTITSFKYAIVVTEAIAYFRACLNPVLYAFVGLKFRKNVWKLMKDIGCLSHLGVSSQWKSSEDSSKTCSASHNVETTSMFQL

SEQ ID NO: 376 - protein, 337 aa, Homo sapiens
MDETGNLTVSSATCHDTIDDFRNQVYSTLYSMISVVGFFGNGFVLYVLIKTYHKKSAFQVYMINLAVADLLCVCTLPLRVVYYVHKGIWLFGDFLCRLSTYALYVNLYCSIFFMTAMSFFRCIAIVFPVQNINLVTQKKARFVCVGIWIFVILTSSPFLMAKPQKDEKNNTKCFEPPQDNQTKNHVLVLHYVSLFVGFIIPFVIIIVCYTMIILTLLKKSMKKNLSSHKKAIGMIMVVTAAFLVSFMPYHIQRTIHLHFLHNETKPCDSVLRMQKSVVITLSLAASNCCFDPLLYFFSGGNFRKRLSTFRKHSLSSVTYVPRKKASLPEKGEEICKV

SEQ ID NO: 377 - protein, 352 aa, Mus musculus
MYLQGTKQTFLENMNGTENLTTSLINNTCHDTIDEFRNQVYSTMYSVISVVGFFGNSFVLYVLIKTYHEKSAFQVYMINLAIADLLCVCTLPLRVVYYVHKGKWLFGDFLCRLTTYALYVNLYCSIFFMTAMSFFRCVAIVFPVQNINLVTQKKARFVCIGIWIFVILTSSPFLMYKSYQDEKNNTKCFEPPQNNQAKKYVLILHYVSLFFGFIIPFVTIIVCYTMIILTLLKNTMKKNMPSRRKAIGMIIVVTAAFLVSFMPYHIQRTIHLHLLHSETRPCDSVLRMQKSVVITLSLAASNCCFDPLLYFFSGGNFRRRLSTFRKHSLSSMTYVPKKKASLPEKGEEICNE

SEQ ID NO: 378 - protein, 346 aa, Homo sapiens
MERKFMSLQPSISVSEMEPNGTFSNNNSRNCTIENFKREFFPIVYLIIFFWGVLGNGLSIYVFLQPYKKSTSVNVFMLNLAISDLLFISTLPFRADYYLRGSNWIFGDLACRIMSYSLYVNMYSSIYFLTVLSVVRFLAMVHPFRLLHVTSIRSAWILCGIIWILIMASSIMLLDSGSEQNGSVTSCLELNLYKIAKLQTMNYIALVVGCLLPFFTLSICYLLIIRVLLKVEVPESGLRVSHRKALTTIIITLIIFFLCFLPYHTLRTVHLTTWKVGLCKDRLHKALVITLALAAANACFNPLLYYFAGENFKDRLKSALRKGHPQKAKTKCVFPVSVWLRKETRV

SEQ ID NO: 379 - protein, 309 aa, Mus musculus
MEVTGTPSSYSNRNCTIENFKKEFYPIIYLIIFFWGALGNGFSIYVFLQTCKKSTSVNVFMLNLATSDFLFISTLPFRADYYFRGSNWIFGDLACRVMSYSLYVNMYTSIYFLTVLSVVRFQATVHPFRMFHVTSVRSAWILCGIIWVFIMASSALLLVNGQEEKDNIISCLELSPQKFKSLLIMNHIAVAVGFLLPFLTLTVCYLLIIRILLKAEIPESGPRAAHRKALTTIVIAMITFLLCFLPYHALRTLHLVTWDKDSCGDVLHKATVITLTMAAANSCFNPFLYYFAGENFKARLRAIFSKVHL

SEQ ID NO: 380 - protein, 443 aa, Homo sapiens
MDPLNLSWYDDDLERQNWSRPFNGSDGKADRPHYNYYATLLTLLIAVIVFGNVLVCMAVSREKALQTTTNYLIVSLAVADLLVATLVMPWVVYLEVVGEWKFSRIHCDIFVTLDVMMCTASILNLCAISIDRYTAVAMPMLYNTRYSSKRRVTVMISIVWVLSFTISCPLLFGLNNADQNECIIANPAFVVYSSIVSFYVPFIVTLLVYIKIYIVLRRRRKRVNTKRSSRAFRAHLRAPLKGNCTHPEDMKLCTVIMKSNGSFPVNRRRVEAARRAQELEMEMLSSTSPPERTRYSPIPPSHHQLTLPDPSHHGLHSTPDSPAKPEKNGHAKDHPKIAKIFEIQTMPNGKTRTSLKTMSRRKLSQQKEKKATQMLAIVLGVFIICWLPFFITHILNIHCDCNIPPVLYSAFTWLGYVNSAVNPIIYTTFNIEFRKAFLKILHC

SEQ ID NO: 381 - protein, 444 aa, Mus musculus
MDPLNLSWYDDDLERQNWSRPFNGSEGKADRPHYNYYAMLLTLLIFIIVFGNVLVCMAVSREKALQTTTNYLIVSLAVADLLVATLVMPWVVYLEVVGEWKFSRIHCDIFVTLDVMMCTASILNLCAISIDRYTAVAMPMLYNTRYSSKRRVTVMIAIVWVLSFTISCPLLFGLNNTDQNECIIANPAFVVYSSIVSFYVPFIVTLLVYIKIYIVLRKRRKRVNTKRSSRAFRANLKTPLKGNCTHPEDMKLCTVIMKSNGSFPVNRRRMDAARRAQELEMEMLSSTSPPERTRYSPIPPSHHQLTLPDPSHHGLHSNPDSPAKPEKNGHAKIVNPRIAKFFEIQTMPNGKTRTSLKTMSRRKLSQQKEKKATQMLAIVLGVFIICWLPFFITHILNIHCDCNIPPVLYSAFTWLGYVNSAVNPIIYTTFNIEFRKAFMKILHC

SEQ ID NO: 382 - protein, 400 aa, Homo sapiens
MASLSQLSSHLNYTCGAENSTGASQARPHAYYALSYCALILAIVFGNGLVCMAVLKERALQTTTNYLVVSLAVADLLVATLVMPWVVYLEVTGGVWNFSRICCDVFVTLDVMMCTASILNLCAISIDRYTAVVMPVHYQHGTGQSSCRRVALMITAVWVLAFAVSCPLLFGFNTTGDPTVCSISNPDFVIYSSVVSFYLPFGVTVLVYARIYVVLKQRRRKRILTRQNSQCNSVRPGFPQQTLSPDPAHLELKRYYSICQDTALGGPGFQERGGELKREEKTRNSLSPTIAPKLSLEVRKLSNGRLSTSLKLGPLQPRGVPLREKKATQMVAIVLGAFIVCWLPFFLTHVLNTHCQTCHVSPELYSATTWLGYVNSALNPVIYTTFNIEFRKAFLKILSC

SEQ ID NO: 383 - protein, 446 aa, Mus musculus
MAPLSQISSHINSTCGAENSTGVNRARPHAYYALSYCALILAIIFGNGLVCAAVLRERALQTTTNYLVVSLAVADLLVATLVMPWVVYLEVTGGVWNFSRICCDVFVTLDVMMCTASILNLCAISIDRYTAVVMPVHYQHGTGQSSCRRVALMITAVWVLAFAVSCPLLFGFNTTGDPSICSISNPDFVIYSSVVSFYVPFGVTVLVYARIYMVLRQRRRKRILTRQNSQCISIRPGFPQQSSCLRLHPIRQFSIRARFLSDATGQMEHIEDKPYPQKCQDPLLSHLQPLSPGQTHGELKRYYSICQDTALRHPNFEGGGGMSQVERTRNSLSPTMAPKLSLEVRKLSNGRLSTSLKLGPLQPRGVPLREKKATQMVVIVLGAFIVCWLPFFLTHVLNTHCQACHVSPELYRATTWLGYVNSALNPVIYTTFNIEFRKAFLKILSC

SEQ ID NO: 384 - protein, 467 aa, Homo sapiens
MGNRSTADADGLLAGRGPAAGASAGASAGLAGQGAAALVGGVLLIGAVLAGNSLVCVSVATERALQTPTNSFIVSLAAADLLLALLVLPLFVYSEVQGGAWLLSPRLCDALMAMDVMLCTASIFNLCAISVDRFVAVAVPLRYNRQGGSRRQLLLIGATWLLSAAVAAPVLCGLNDVRGRDPAVCRLEDRDYVVYSSVCSFFLPCPLMLLLYWATFRGLQRWEVARRAKLHGRAPRRPSGPGPPSPTPPAPRLPQDPCGPDCAPPAPGLPRGPCGPDCAPAAPGLPPDPCGPDCAPPAPGLPQDPCGPDCAPPAPGLPRGPCGPDCAPPAPGLPQDPCGPDCAPPAPGLPPDPCGSNCAPPDAVRAAALPPQTPPQTRRRRRAKITGRERKAMRVLPVVVGAFLLCWTPFFVVHITQALCPACSVPPRLVSAVTWLGYVNSALNPVIYTVFNAEFRNVFRKALRACC

SEQ ID NO: 385 - protein, 387 aa, Mus musculus
MGNSSATEDGGLLAGRGPESLGTGAGLGGAGAAALVGGVLLIGLVLAGNSLVCVSVASERTLQTPTNYFIVSLAAADLLLAVLVLPLFVYSEVQGGVWLLSPRLCDTLMAMDVMLCTASIFNLCAISVDRFVAVTVPLRYNQQGQCQLLLIAATWLLSAAVASPVVCGLNDVPGRDPAVCCLENRDYVVYSSVCSFFLPCPLMLLLYWATFRGLRRWEAARHTKLHSRAPRRPSGPGPPVSDPTQGPFFPDCPPPLPSLRTSPSDSSRPESELSQRPCSPGCLLADAALPQPPEPSSRRRRGAKITGRERKAMRVLPVVVGAFLVCWTPFFVVHITRALCPACFVSPRLVSAVTWLGYVNSALNPIIYTIFNAEFRSVFRKTLRLRC

SEQ ID NO: 386 - protein, 381 aa, Homo sapiens
MGPTSVPLVKAHRSSVSDYVNYDIIVRHYNYTGKLNISADKENSIKLTSVVFILICCFIILENIFVLLTIWKTKKFHRPMYYFIGNLALSDLLAGVAYTANLLLSGATTYKLTPAQWFLREGSMFVALSASVFSLLAIAIERYITMLKMKLHNGSNNFRLFLLISACWVISLILGGLPIMGWNCISALSSCSTVLPLYHKHYILFCTTVFTLLLLSIVILYCRIYSLVRTRSRRLTFRKNISKASRSSENVALLKTVIIVLSVFIACWAPLFILLLLDVGCKVKTCDILFRAEYFLVLAVLNSGTNPIIYTLTNKEMRRAFIRIMSCCKCPSGDSAGKFKRPIIAGMEFSRSKSDNSSHPQKDEGDNPETIMSSGNVNSSS

SEQ ID NO: 387 - protein, 382 aa, Mus musculus
MVSTSIPEVKALRSSVSDYGNYDIIVRHYNYTGKLNIGAEKDHGIKLTSVVFILICCFIILENIFVLLTIWKTKKFHRPMYYFIGNLALSDLLAGVAYTANLLLSGATTYKLTPAQWFLREGSMFVALSASVFSLLAIAIERYITMLKMKLHNGSNSSRSFLLISACWVISLILGGLPIMGWNCISSLSSCSTVLPLYHKHYILFCTTVFTLLLLSIVILYCRIYSLVRTRSRRLTFRKNISKASRSSEKSLALLKTVIIVLSVFIACWAPLFILLLLDVGCKAKTCDILYKAEYFLVLAVLNSGTNPIIYTLTNKEMRRAFIRIVSCCKCPNGDSAGKFKRPIIPGMEFSRSKSDNSSHPQKDDGDNPETIMSSGNVNSSS

SEQ ID NO: 388 - protein, 364 aa, Homo sapiens [sequence omitted]

SEQ ID NO: 389 - protein, 364 aa, Mus musculus
MAAASTSSPVISQPQFTAMNEQQCFYNESIAFFYNRSGKYLATEWNTVSKLVMGLGITVCVFIMLANLLVMVAIYVNRRFHFPIYYLMANLAAADFFAGLAYFYLMFNTGPNTRRLTVNTWLLRQGLIDTSLTASVANLLAIAIERHITVFRMQLHTRMSNRRVVVVIVVIWTMAIVMGAMPTVGWNCICDIDHCSNMAPLYSDSYLVFWAIFNLVTFVVMVVLYAHIFGYVRQRTMRMSRHSSGPRRNRDTMMSLLKTVVIVLGAFIVCWTPGLVLLLLDVCCPQCDVLAYEKFFLLLAEFNSAMNPIIYSYRDKEMSATFRQILCCQRNENPNGPTEGSDRSASSLNHTILAGVHSNDHSVV

SEQ ID NO: 390 - protein, 378 aa, Homo sapiens
MATALPPRLQPVRGNETLREHYQYVGKLAGRLKEASEGSTLTTVLFLVICSFIVLENLMVLIAIWKNNKFHNRMYFFIGNLALCDLLAGIAYKVNILMSGKKTFSLSPTVWFLREGSMFVALGASTCSLLAIAIERHLTMIKMRPYDANKRHRVFLLIGMCWLIAFTLGALPILGWNCLHNLPDCSTILPLYSKKYIAFCISIFTAILVTIVILYARIYFLVKSSSRKVANHNNSERSMALLRTVVIVVSVFIACWSPLFILFLIDVACRVQACPILFKAQWFIVLAVLNSAMNPVIYTLASKEMRRAFFRLVCNCLVRGRGARASPIQPALDPSRSKSSSSNNSSHSPKVKEDLPHTDPSSCIMDKNAALQNGIFCN

SEQ ID NO: 391 - protein, 378 aa, Mus musculus
MATTHAQGHQPVLGNDTLREHYDYVGKLAGRLRDPPEGGTLITTILFLVTCSFIVLENLMVLIAIWKNNKFHNRMYFFIGNLALCDLLAGIAYKVNILMSGRKTFSLSPTVWFLREGSMFVALGASTCSLLAIAIERHLTMIKMRPYDANKKHRVFLLIGMCWLIAFSLGALPILGWNCLENFPDCSTILPLYSKKYIAFLISIFTAILVTIVILYARIYCLVKSSSRRVANHNSERSMALLRTVVIVVSVFIACWSPLFILFLIDVACRAKECSILFKSQWFIMLAVLNSAMNPVIYTLASKEMRRAFFRLVCGCLVKGKGTQASPMQPALDPSRSKSSSSNNSSHSPKVKEDLPRVATSSCIIDKNRSFQNGVLCK

SEQ ID NO: 392 - protein, 382 aa, Homo sapiens
MVIMGQCYYNETIGFFYNNSGKELSSHWRPKDVVVVALGLTVSVLVLLTNLLVIAAIASNRRFHQPIYYLLGNLAAADLFAGVAYLFLMFHTGPRTARLSLEGWFLRQGLLDTSLTASVATLLAIAVERHRSVMAVQLHSRLPRGRVVMLIVGVWVAALGLGLLPAHSWHCLCALDRCSRMAPLLSRSYLAVWALSSLLVFLLMVAVYTRIFFYVRRRVQRMAEHVSCHPRYRETTLSLVKTVVIILGAFVVCWTPGQVVLLLDGLGCESCNVLAVEKYFLLLAEANSLVNAAVYSCRDAEMRRTFRRLLCCACLRQSTRESVHYTSSAQGGASTRIMLPENGHPLMTPPFSYLELQRYAASNKSTAPDDLWVLLAQPNQQD

SEQ ID NO: 393 - protein, 348 aa, Mus musculus
MGQCYYNETIGFFYNNSGKELSLHWRPKDVVVVALGLTVSVLVLLTNLLVIAAIASNRRFHQPIYYLLGNLAAADLFAGMAYLFLMFHTGPPHCQALHQRLVPATGPAGHQPHGVSGHTAGIAVERHRSVMAVQLHSRLPRGRVVTLIVGVWAAALGLGLLPAHFWHCLCDLDSCSRMVPLFSRSYLAAWALSSLLVFLLMVAVYTRIFFYVRRRVERMAEHVSCHPRYRETTLSLVKTVVIILGAFVVCWTPGQVVLLLDGLDCKTCNVLAVEKYFLLLAEANSLVNAVVYSCRDAEMRRTFRRLLCCMCLRWSSHKSARYSASAQTGASTRIMLPENGRPLMDSTL

SEQ ID NO: 394 - protein, 353 aa, Homo sapiens
MGSLYSEYLNPNKVQEHYNYTKETLETQETTSRQVASAFIVILCCAIVVENLLVLIAVARNSKFHSAMYLFLGNLAASDLLAGVAFVANTLLSGSVTLRLTPVQWFAREGSASITLSASVFSLLAIAIERHVAIAKVKLYGSDKSCRMLLLIGASWLISLVLGGLPILGWNCLGHLEACSTVLPLYAKHYVLCVVTIFSIILLAIVALYVRIYCVVRSSHADMAAPQTLALLKTVTIVLGVFIVCWLPAFSILLLDYACPVHSCPILYKAHYFFAVSTLNSLLNPVIYTWRSRDLRREVLRPLQCWRPGVGVQGRRRVGTPGHHLLPLRSSSSLERGMHMPTSPTFLEGNTVV

SEQ ID NO: 395 - protein, 352 aa, Mus musculus
MGGLYSEYLNPEKVLEHYNYTKETLDMQETTSRKVASAFIIILCCAIVVENLLVLIAVARNSKFHSAMYLFLGNLAASDLLAGVAFVANTLLSGHVTLSLTPVQWFAREVSAFITLSASVFSLLAIAIERQVALAKVKLYGSDKSCRMLMLIGASWLISLILGGLPILGWNCLNQLEACSTVLPLYAKHYVLCVVTIFSVILLAIVALYVRIYFVVRSSHADVAGPQTLALLKTVTIVLGVFIICWLPAFSILLLDSTCPVRACPVLYKAHYFFAFATLNSLLNPVIYTWRSRDLRREVLRPLQCWRRGKGVTGRRGGNPGHRLLPLRSSSSLERGMHMPTSPTFLEGNTVV

SEQ ID NO: 396 - protein, 384 aa, Homo sapiens
MNATGTPVAPESCQQLAAGGHSRLIVLHYNHSGRLAGRGGPEDGGLGALRGLSVAASCLVVLENLLVLAAITSHMRSRRWVYYCLVNITLSDLLTGAAYLANVLLSGARTFRLAPAQWFLREGLLFTALAASTFSLLFTAGERFATMVRPVAESGATKTSRVYGFIGLCWLLAALLGMLPLLGWNCLCAFDRCSSLLPLYSKRYILFCLVIFAGVLATIMGLYGAIFRLVQASGQKAPRPAARRKARRLLKTVLMILLAFLVCWGPLFGLLLADVFGSNLWAQEYLRGMDWILALAVLNSAVNPIIYSFRSREVCRAVLSFLCCGCLRLGMRGPGDCLARAVEAHSGASTTDSSLRPRDSFRGSRSLSFRMREPLSSISSVRSI

SEQ ID NO: 397 - protein, 386 aa, Mus musculus
MNISTWSTLVTPESCHRLAASGHSLLIVLHYNHSGRLASRGGSEDGGGLGMLRGPSVAAGCLVVLENAMVLAAIAIYMRSRRWVYYCLLNITLSDLLTGLAYVVNVLLSGTRTFQLSPVHWFLREGLLFMALAASTFSLLFTAGERFATMVRVAESGATKTSRVYGCIGLCWLLAAILGLLPLLGWNCVCAFPRCSSLLPLYSKGYVLFCVVVFALILVAILSLYGAIFRVVRANGQKSPRPPARRKSRRLLNTVLMILVAFVVCWGPLFGLLLADIFGSNVWAQEYLRGMDWILALAVFNSAINPLIYSFRSREVQRAVLAFLCCGCLWLGLRGPGDCLTRITEAHSGASTTDSSLRPRDSFRTSRSLSFRMREPLSSISSVRST

SEQ ID NO: 398 - protein, 353 aa, Homo sapiens
MNECHYDKHMDFFYNRSNTDTVDDWTGTKLVIVLCVGTFFCLFIFFSNSLVIAAVIKNRKFHFPFYYLLANLAAADFFAGIAYVFLMFNTGPVSKTLTVNRWFLRQGLLDSSLTASLTNLLVIAVERHMSIMRMRVHSNLTKKRVTLLILLVWAIAIFMGAVPTLGWNCLCNISACSSLAPIYSRSYLVFWTVSNLMAFLIMVVVYLRIYVYVKRKTNVLSPHTSGSISRRRTPMKLMKTVMTVLGAFVVCWTPGLVVLLLDGLNCRQCGVQHVKRWFLLLALLNSVVNPIIYSYKDEDMYGTMKKMICCFSQENPERRPSRIPSTVLSRSDTGSQYIEDSISQGAVCNKSTS

SEQ ID NO: 399 - protein, 354 aa, Mus musculus
MNECHYDKRMDFFYNRSNTDTADEWTGTKLVIVLCVGTFFCLFIFFSNSLVIAAVITNRKFHFPFYYLLANLAAADFFAGIAYVFLMFNTGPVSKTLTVNRWFLRQGLLDTSLTASLANLLVIAVERHMSIMRMRVHSNLTKKRVTLLILLVWAIAIFMGAVPTLGWNCLCNISACSSLAPIYSRSYLIFWTVSNLLAFFIMVAVYVRIYMYVKRKTNVLSPHTSGSISRRRAPMKLMKTVMTVLGAFVVCWTPGLVVLLLDGLNCKQCNVQHVKRWFLLLALLNSVMNPIIYSYKDEDMYNTMRKMICCALQDSNTERRPSRNPSTIHSRSETGSQYLEDSISQGPVCNKNGS

SEQ ID NO: 400 - protein, 398 aa, Homo sapiens
MESGLLRPAPVSEVIVLHYNYTGKLRGARYQPGAGLRADAVVCLAVCAFIVLENLAVLLVLGRHPRFHAPMFLLLGSLTLSDLLAGAAYAANILLSGPLTLKLSPALWFAREGGVFVALTASVLSLLAIALERSLTMARRGPAPVSSRGRTLAMAAAAWGVSLLLGLLPALGWNCLGRLDACSTVLPLYAKAYVLFCVLAFVGILAAICALYARIYCQVRANARRLPARPGTAGTTSTRARRKPRSLALLRTLSVVLLAFVACWGPLFLLLLLDVACPARTCPVLLQADPFLGLAMANSLLNPIIYTLTNRDLRHALLRLVCCGRHSCGRDPSGSQQSASAAEASGGLRRCLPPGLDGSFSGSERSSPQRDGLDTSGSTGSPGAPTAARTLVSEPAAD

SEQ ID NO: 401 - protein, 400 aa, Mus musculus
MEPGLLRPAPVSEVIVLHYNYTGKLRGARYQPGAGLRADAAVCLAVCAFIVLENLAVLLVLVRHPRFHAPMFLLLGSLTLSDLLAGAAYATNILLSGPLTLRLSPALWFAREGGVFVALAASVLSLLAIALERHLTMARRGPAPAASRARTLAMAVAAWGASLLLGLLPALGWNCLGRLETCSTVLPLYAKAYVLFCVLAFLGILAAICALYARIYCQVRANARRLRAGPGSRRATSSSRSRHTPRSLALLRTLSVVLLAFVACWGPLFLLLLLDVACPARACPVLLQADPFLGLAMANSLLNPIIYTFTNRDLRHALLRLLCCGRGPCNQDSSNSLQRSPSAAGPSGGGLRRCLPPTLDRSSSPSEHLSPQQDGVDTSCSTGSPGVATANRSLVPTATD

SEQ ID NO: 402 - protein, 427 aa, Homo sapiens
METLCLRASFWLALVGCVISDNPERYSTNLSNHVDDFTTFRGTELSFLVTTHQPTNLVLPSNGSMHNYCPQQTKITSAFKYINTVISCTIFIVGMVGNATLLRIIYQNKCMRNGPNALIASLALGDLIYVVIDLPINVFKLLAGRWPFDHNDFGVFLCKLFPFLQKSSVGITVLNLCALSVDRYRAVASWSRVQGIGIPLVTAIEIVSIWILSFILAIPEAIGFVMVPFEYRGEQHKTCMLNATSKFMEFYQDVKDWWLFGFYFCMPLVCTAIFYTLMTCEMLNRRNGSLRIALSEHLKQRREVAKTVFCLVVIFALCWFPLHLSRILKKTVYNEMDKNRCELLSFLLLMDYIGINLATMNSCINPIALYFVSKKFKNCFQSCLCCCCYQSKSLMTSVPMNGTSIQWKNHDQNNHNTDRSSHKDSMN

SEQ ID NO: 403 - protein, 427 aa, Mus musculus
MSIFCLAAYFWLTMVGGVMADNPERYSANLSSHMEDFTPFPGTEINFLGTTHRPPNLALPSNGSMHGYCPQQTKITTAFKYINTVISCTIFIVGMVGNATLLRIIYQNKCMRNGPNALIASLALGDLIYVVIDLPINVFKLLAGRWPFDHNDFGVFLCKLFPFLQKSSVGITVLNLCALSVDRYRAVASWSRVQGIGIPLITAIEIVSIWILSFILAIPEAIGFVMVPFEYKGELHRTCMLNATSKFMEFYQDVKDWWLFGFYFCMPLVCTAIFYTLMTCEMLNRRNGSLRIALSEHLKQRREVAKTVFCLVVIFALCWFPLHLSRILKKTVYDEMDKNRCELLSFLLLMDYIGINLATMNSCINPIALYFVSKKFKNCFQSCLCCCCHQSKSLMTSVPMNGTSIQWKNQEQNNHNTERSSHKDSMN

SEQ ID NO: 404 - protein, 442 aa, Homo sapiens
MQPPPSLCGRALVALVLACGLSRIWGEERGFPPDRATPLLQTAEIMTPPTKTLWPKGSNASLARSLAPAEVPKGDRTAGSPPRTISPPPCQGPIEIKETFKYINTVVSCLVFVLGIIGNSTLLRIIYKNKCMRNGPNILIASLALGDLLHIVIDIPINVYKLLAEDWPFGAEMCKLVPFIQKASVGITVLSLCALSIDRYRAVASWSRIKGIGVPKWTAVEIVLIWVVSVVLAVPEAIGFDIITMDYKGSYLRICLLHPVQKTAFMQFYKTAKDWWLFSFYFCLPLAITAFFYTLMTCEMLRKKSGMQIALNDHLKQRREVAKTVFCLVLVFALCWLPLHLSRILKLTLYNQNDPNRCELLSFLLVLDYIGINMASLNSCINPIALYLVSKRFKNCFKSCLCCWCQSFEEKQSLEEKQSCLKFKANDHGYDNFRSSNKYSSS

SEQ ID NO: 405 - protein, 442 aa, Mus musculus
MQSPASRCGRALVALLLACGFLGVWGEKRGFPPAQATLSLLGTKEVMTPPTKTSWTRGSNSSLMRSSAPAEVTKGGRGAGVPPRSFPPPCQRNIEISKTFKYINTIVSCLVFVLGIIGNSTLLRIIYKNKCMRNGPNILIASLALGDLLHIIIDIPINTYKLLAEDWPFGAEMCKLVPFIQKASVGITVLSLCALSIDRYRAVASWSRIKGIGVPKWTAVEIVLIWVVSVVLAVPEAIGFDMITSDYKGKPLRVCMLNPFQKTAFMQFYKTAKDWWLFSFYFCLPLAITAVFYTLMTCEMLRKKSGMQIALNDHLKQRREVAKTVFCLVLVFALCWLPLHLSRILKLTLYDQSNPHRCELLSFLLVLDYIGINMASLNSCINPIALYLVSKRFKNCFKSCLCCWCQTFEEKQSLEEKQSCLKFKANDHGYDNFRSSNKYSSS

SEQ ID NO: 406 - protein, 886 aa, Homo sapiens
MRGFNLLLFWGCCVMHSWEGHIRPTRKPNTKGNNCRDSTLCPAYATCTNTVDSYYCTCKQGFLSSNGQNHFKDPGVRCKDIDECSQSPQPCGPNSSCKNLSGRYKCSCLDGFSSPTGNDWVPGKPGNFSCTDINECLTSRVCPEHSDCVNSMGSYSCSCQVGFISRNSTCEDVNECADPRACPEHATCNNTVGNYSCFCNPGFESSSGHLSCQGLKASCEDIDECTEMCPINSTCTNTPGSYFCTCHPGFAPSSGQLNFTDQGVECRDIDECRQDPSTCGPNSICTNALGSYSCGCIVGFHPNPEGSQKDGNFSCQRVLFKCKEDVIPDNKQIQQCQEGTAVKPAYVSFCAQINNIFSVLDKVCENKTTVVSLKNTTESFVPVLKQISMWTKFTKEETSSLATVFLESVESMTLASFWKPSANVTPAVRAEYLDIESKVINKECSEENVTLDLVAKGDKMKIGCSTIEESESTETTGVAFVSFVGMESVLNERFFQDHQAPLTTSEIKLKMNSRVVGGIMTGEKKDGFSDPIIYTLENVQPKQKFERPICVSWSTDVKGGRWTSFGCVILEASETYTICSCNQMANLAVIMASGELTMDFSLYIISHVGIIISLVCLVLAIATFLLCRSIRNHNTYLHLHLCVCLLLAKTLFLAGIHKTDNKTGCAIIAGFLHYLFLACFFWMLVEAVILFLMVRNLKVVNYFSSRNIKMLHICAFGYGLPMLVVVISASVQPQGYGMHNRCWLNTETGFIWSFLGPVCTVIVINSLLLTWTLWILRQRLSSVNAEVSTLKDTRLLTFKAFAQLFILGCSWVLGIFQIGPVAGVMAYLFTIINSLQGAFIFLIHCLLNGQVREEYKRWITGKTKPSSQSQTSRILLSSMPSASKTG

SEQ ID NO: 407 - protein, 931 aa, Mus musculus
MWGFWLLLFWGFSGMYRWGMTTLPTLGQTLGGVNECQDTTTCPAYATCTDTTDSYYCTCKRGFLSSNGQTNFQGPGVECQDVNECLQSDSPCGPNSVCTNILGRAKCSCLRGFSSSTGKDWILGSLDNFLCADVDECLTIGICPKYSNCSNSVGSYSCTCQPGFVLNGSICEDEDECVTRDVCPEHATCHNTLGSYYCTCNSGLESSGGGPMFQGLDESCEDVDECSRNSTLCGPTFICINTLGSYSCSCPAGFSLPTFQILGHPADGNCTDIDECDDTCPLNSSCTNTIGSYFCTCHPGFASSNGQLNFKDLEVTCEDIDECTQDPLQCGLNSVCTNVPGSYICGCLPDFQMDPEGSQGYGNFNCKRILFKCKEDLILQSEQIQQCQAVQGRDLGYASFCTLVNATFTILDNTCENKSAPVSLQSAATSVSLVLEQATTWFELSKEETSTLGTILLETVESTMLAALLIPSGNASQMIQTEYLDIESKVINEECKENESINLAARGDKMNVGCFIIKESVSTGAPGVAFVSFAHMESVLNERFFEDGQSFRKLRMNSRVVGGTVTGEKKEDFSKPIIYTLQHIQPKQKSERPICVSWNTDVEDGRWTPSGCEIVEASETHTVCSCNRMANLAIIMASGELTMEFSLYIISHVGTVISLVCLALAIATFLLCRAVQNHNTYMHLHLCVCLFLAKILFLTGIDKTDNQTACAIIAGFLHYLFLACFFWMLVEAVMLFLMVRNLKVVNYFSSRNIKMLHLCAFGYGLPVLVVIISASVQPRGYGMHNRCWLNTETGFIWSFLGPVCMIITINSVLLAWTLWVLRQKLCSVSSEVSKLKDTRLLTFKAIAQIFILGCSWVLGIFQIGPLASIMAYLFTIINSLQGAFIFLIHCLLNRQVRDEYKKLLTRKTDLSSHSQTSGILLSSMPSTSKMG

SEQ ID NO: 408 - protein, 606 aa, Homo sapiens
MCVPGFRSSSNQDRFITNDGTVCIENVNANCHLDNVCIAANINKTLTKIRSIKEPVALLQEVYRNSVTDLSPTDIITYIEILAESSSLLGYKNNTISAKDTLSNSTLTEFVKTVNNFVQRDTFVVWDKLSVNHRRTHLTKLMHTVEQATLRISQSFQKTTEFDTNSTDIALKVFFFDSYNMKHIHPHMNMDGDYINIFPKRKAAYDSNGNVAVAFLYYKSIGPLLSSSDNFLLKPQNYDNSEEEERVISSVISVSMSSNPPTLYELEKITFTLSHRKVTDRYRSLCAFWNYSPDTMNGSWSSEGCELTYSNETHTSCRCNHLTHFAILMSSGPSIGIKDYNILTRITQLGIIISLICLAICIFTFWFFSEIQSTRTTIHKNLCCSLFLAELVFLVGINTNTNKLFCSIIAGLLHYFFLAAFAWMCIEGIHLYLIVVGVIYNKGFLHKNFYIFGYLSPAVVVGFSAALGYRYYGTTKVCWLSTENNFIWSFIGPACLIILVNLLAFGVIIYKVFRHTAGLKPEVSCFENIRSCARGALALLFLLGTTWIFGVLHVVHASVVTAYLFTVSNAFQGMFIFLFLCVLSRKIQEEYYRLFKNVPCCFGCLR

SEQ ID NO: 409 - protein, 739 aa, Mus musculus
  misc_feature (432)..(432): Xaa can be any naturally occurring amino acid
MRLLPLLVGFSTLLNCSYTQNCSKTTCLPNAKCEVHNGVEACFCSQGYSGNGVTICEDIDECSESSVCGDHAVCENVNGGFSCFCREGYQTATGKSQFTPNDGSYCQDIDECSESSVCGDHAVCENVNGGFSCFCREGYQTATGKSQFTPNDGSYCQESMNSNCHLEHACIAANINKTLKRIGPITEQTTLLQEIYRNSEAELSLMDIVTYIEILTESSSLLGHPNSTTSYKDAHFNSTLTEFGETINNFVERSTHKMWDQLPTNHRRLHLTKLMHTAELVTLQIAQNIQKNSQFDMNSTDLALKVFAFDSTHMKHAHPHMNVDGGYVKISPRRKAAHGTTGNVVVAFLCYKSIGPLLSSSDNFLLDTQNDNSEGKEKVISSVISASISSNPPTLYELEKITFTLSHVKLSDKHRTQCAFWNYSVDAMNNGXWSTEGCELTHSNDTHTSCRCSHLTHFAILMSSTSSIGIKDYNILTRITQLGIIISLICLAICIFTFWFFSEIQSTRTTIHKNLCCSLFLAELVFLIGININTNKLVCSIIAGLLHYFFLAAFAWMCIEGIHLYLIVVGVIYNKGFLHKNFYIFGYLSPAVVVGFSASLGYRYYGTTKVCWLSTENNFIWSFIGPACLIILVNLLAFGVIIYKVFRHTAGLKPEVSCYENIRSCARGALALLFLLGTTWIFGVLHVVHASVVTAYLFTVSNAFQGMFIFLFLCVLSRKIQEEYYRLFKNVPCCFGCLR

SEQ ID NO: 410 - protein, 425 aa, Homo sapiens
MGPRRLLLVAACFSLCGPLLSARTRARRPESKATNATLDPRSFLLRNPNDKYEPFWEDEEKNESGLTEYRLVSINKSSPLQKQLPAFISEDASGYLTSSWLTLFVPSVYTGVFVVSLPLNIMAIVVFILKMKVKKPAVVYMLHLATADVLFVSVLPFKISYYFSGSDWQFGSELCRFVTAAFYCNMYASILLMTVISIDRFLAVVYPMQSLSWRTLGRASFTCLAIWALAIAGVVPLVLKEQTIQVPGLNITTCHDVLNETLLEGYYAYYFSAFSAVFFFVPLIISTVCYVSIIRCLSSSAVANRSKKSRALFLSAAVFCIFIICFGPTNVLLIAHYSFLSHTSTTEAAYFAYLLCVCVSSISSCIDPLIYYYASSECQRYVYSILCCKESSDPSSYNSSGQLMASKMDTCSSNLNNSIYKKLLT

SEQ ID NO: 411 - protein, 430 aa, Mus musculus
MGPRRLLIVALGLSLCGPLLSSRVPMSQPESERTDATVNPRSFFLRNPSENTFELVPLGDEEEEEKNESVLLEGRAVYLNISLPPHTPPPPFISEDASGYLTSPWLTLFMPSVYTIVFIVSLPLNVLAIAVFVLRMKVKKPAVVYMLHLAMADVLFVSVLPFKISYYFSGTDWQFGSGMCRFATAAFYGNMYASIMLMTVISIDRFLAVVYPIQSLSWRTLGRANFTCVVIWVMAIMGVVPLLLKEQTTRVPGLNITTCHDVLSENLMQGFYSYYFSAFSAIFFLVPLIVSTVCYTSIIRCLSSSAVANRSKKSRALFLSAAVFCIFIVCFGPTNVLLIVHYLFLSDSPGTEAAYFAYLLCVCVSSVSCCIDPLIYYYASSECQRHLYSILCCKESSDPNSCNSTGQLMPSKMDTCSSHLNNSIYKKLLA

SEQ ID NO: 412 - protein, 397 aa, Homo sapiens
MRSPSAAWLLGAAILLAASLSCSGTIQGTNRSSKGRSLIGKVDGTSHVTGKGVTVETVFSVDEFSASVLTGKLTTVFLPIVYTIVFVVGLPSNGMALWVFLFRTKKKHPAVIYMANLALADLLSVIWFPLKIAYHIHGNNWIYGEALCNVLIGFFYGNMYCSILFMTCLSVQRYWVIVNPMGHSRKKANIAIGISLAIWLLILLVTIPLYVVKQTIFIPALNITTCHDVLPEQLLVGDMFNYFLSLAIGVFLFPAFLTASAYVLMIRMLRSSAMDENSEKKRKRAIKLIVTVLAMYLICFTPSNLLLVVHYFLIKSQGQSHVYALYIVALCLSTLNSCIDPFVYYFVSHDFRDHAKNALLCRSVRTVKQMQVSLTSKKHSRKSSSYSSSSTTVKTSY

SEQ ID NO: 413 - protein, 399 aa, Mus musculus
MRSLSLAWLLGGITLLAASVSCSRTENLAPGRNNSKGRSLIGRLETQPPITGKGVPVEPGFSIDEFSASILTGKLTTVFLPVVYIIVFVIGLPSNGMALWIFLFRTKKKHPAVIYMANLALADLLSVIWFPLKISYHLHGNNWVYGEALCKVLIGFFYGNMYCSILFMTCLSVQRYWVIVNPMGHPRKKANIAVGVSLAIWLLIFLVTIPLYVMKQTIYIPALNITTCHDVLPEEVLVGDMFNYFLSLAIGVFLFPALLTASAYVLMIKTLRSSAMDEHSEKKRQRAIRLIITVLAMYFICFAPSNLLLVVHYFLIKTQRQSHVYALYLVALCLSTLNSCIDPFVYYFVSKDFRDHARNALLCRSVRTVNRMQISLSSNKFSRKSGSYSSSSTSVKTSY

SEQ ID NO: 414 - protein, 374 aa, Homo sapiens
MKALIFAAAGLLLLLPTFCQSGMENDTNNLAKPTLPIKTFRGAPPNSFEEFPFSALEGWTGATITVKIKCPEESASHLHVKNATMGYLTSSLSTKLIPAIYLLVFVVGVPANAVTLWMLFFRTRSICTTVFYTNLAIADFLFCVTLPFKIAYHLNGNNWVFGEVLCRATTVIFYGNMYCSILLLACISINRYLAIVHPFTYRGLPKHTYALVTCGLVWATVFLYMLPFFILKQEYYLVQPDITTCHDVHNTCESSSPFQLYYFISLAFFGFLIPFVLIIYCYAAIIRTLNAYDHRWLWYVKASLLILVIFTICFAPSNIILIIHHANYYYNNTDGLYFIYLIALCLGSLNSCLDPFLYFLMSKTRNHSTAYLTK

SEQ ID NO: 415 - protein, 369 aa, Mus musculus
MKILILVAAGLLFLPVTVCQSGINVSDNSAKPTLTIKSFNGGPQNTFEEFPLSDIEGWTGATTTIKAECPEDSISTLHVNNATIGYLRSSLSTQVIPAIYILLFVVGVPSNIVTLWKLSLRTKSISLVIFHTNLAIADLLFCVTLPFKIAYHLNGNNWVFGEVMCRITTVVFYGNMYCAILILTCMGINRYLATAHPFTYQKLPKRSFSLLMCGIVWVMVFLYMLPFVILKQEYHLVHSEITTCHDVVDACESPSSFRFYYFVSLAFFGFLIPFVIIIFCYTTLIHKLKSKDRIWLGYIKAVLLILVIFTICFAPTNIILVIHHANYYYHNTDSLYFMYLIALCLGSLNSCLDPFLYFVMSKVVDQLNP

SEQ ID NO: 416 - protein, 385 aa, Homo sapiens
MWGRLLLWPLVLGFSLSGGTQTPSVYDESGSTGGGDDSTPSILPAPRGYPGQVCANDSDTLELPDSSRALLLGWVPTRLVPALYGLVLVVGLPANGLALWVLATQAPRLPSTMLLMNLATADLLLALALPPRIAYHLRGQRWPFGEAACRLATAALYGHMYGSVLLLAAVSLDRYLALVHPLRARALRGRRLALGLCMAAWLMAAALALPLTLQRQTFRLARSDRVLCHDALPLDAQASHWQPAFTCLALLGCFLPLLAMLLCYGATLHTLAASGRRYGHALRLTAVVLASAVAFFVPSNLLLLLHYSDPSPSAWGNLYGAYVPSLALSTLNSCVDPFIYYYVSAEFRDKVRAGLFQRSPGDTVASKASAEGGSRGMGTHSSLLQ

SEQ ID NO: 417 - protein, 396 aa, Mus musculus
MCWPLLYPLVLGLSISLAEGIQTPSIYDDVESTRGSHEGPLGPTVELKEPKSSDKPNPRGYPGKFCANDSDTLELPASSQALLLGWVSTRLVPALYGLVVAVGLPANGLALWVLATRVPRLPSTILLTNLAVADSLLALVPPPRLAYHLRGQRWPFGEAACRVATAALYGHMYGSVLLLAAVSLDRYLALVHPLRARALRGQRLTTGLCLVAWLSAATLALPLTLHRQTFRLAGSDRMLCHDALPLTEQTSHWRPAFICLAVLGCFVPLLAMGLCYGATLRALAANGQRYSHALRLTALVLFSAVASFTPSNVLLVLHYSNPSPEAWGNLYGAYVPSLALSTLNSCVDPFIYYYVSHEFREKVRAMLCRQPEASSSSQASREAGSRGTAICSSTLL

SEQ ID NO: 418 - protein, 333 aa, Homo sapiens
MPANYTCTRPDGDNTDFRYFIYAVTYTVILVPGLIGNILALWVFYGYMKETKRAVIFMINLAIADLLQVLSLPLRIFYYLNHDWPFGPGLCMFCFYLKYVNMYASIYFLVCISVRRFWFLMYPFRFHDCKQKYDLYISIAGWLIICLACVLFPLLRTSDDTSGNRTKCFVDLPTRNVNLAQSVVMMTIGELIGFVTPLLIVLYCTWKTVLSLQDKYPMAQDLGEKQKALKMILTCAGVFLICFAPYHFSFPLDFLVKSNEIKSCLARRVILIFHSVALCLASLNSCLDPVIYYFSTNEFRRRLSRQDLHDSIQLHAKSFVSNHTASTMTPELC

SEQ ID NO: 419 - protein, 335 aa, Mus musculus
MTDNFTCNKTDGDNTDFRYFIYAVTYTVILVPGLIGNILALWVFYGYMKETKRAVVFMINLAIADLLQILSLPLRIFYYLNHDWPFGPGLCMFCFYLKYVNMYASIYFLVCISVRRFWFLMYPFRFNDCKQKYDLYISIIGWLIICLACLLFPLLRTNDDTPGNRTKCFVDLPIRNVNLAQSVAMITIGEVVGFVTPLMIVLYCTWKTALSLQNKYPISQHLGEKKKALKMILTCAGVFLVCFVPYHFSFPLDFLVKSNEIKSCFARRVILIFHSVALCLASLNSCLDPVIYYFTTNEFRRRLSRQDLPDNIQLHTKSYKIASNHATSTVAAELC

SEQ ID NO: 420 - protein, 350 aa, Homo sapiens [sequence omitted]

SEQ ID NO: 421 - protein, 364 aa, Mus musculus
MDTNMSLLMNKSAVNLMNVSGSTQSVSAGYIVLDVFSYLIFAVTFVLGVLGNGLVIWVAGFRMKHTVTTISYLNLAIADFCFTSTLPFYIASMVMGGHWPFGWFMCKFIYTVIDINLFGSVFLIALIALDRCICVLHPVWAQNHRTVSLAKKVIIVPWICAFLLTLPVIIRLTTVPNSRLGPGKTACTFDFSPWTKDPVEKRKVAVTMLTVRGIIRFIIGFSTPMSIVAICYGLITTKIHRQGLIKSSRPLRVLSFVVAAFFLCWCPFQVVALISTIQVRERLKNMTPGIVTALKITSPLAFFNSCLNPMLYVFMGQDFRERLIHSLPASLERALTEDSAQTSDTGTNLGTNSTSLSENTLNAM

SEQ ID NO: 422 - protein, 695 aa, Homo sapiens [sequence omitted]

SEQ ID NO: 423 - protein, 692 aa, Mus musculus
MALLLVSLLAFLGSGSGCHHWLCHCSNRVFLCQDSKVTEIPPDLPRNAIELRFVLTKLRVIPKGSFSGFGDLEKIEISQNDVLEVIEADVFSNLPNLHEIRIEKANNLLYINPEAFQNLPSLRYLLISNTGIKHLPAFHKIQSLQKVLLDIQDNINIHIIARNSFMGLSFESVILWLNKNGIQEIHNCAFNGTQLDELNLSDNNNLEELPDDVFQGASGPVVLDISRTKVYSLPNHGLENLKKLRARSTYRLKKLPSLDKFVMLIEASLTYPSHCCAFANWRRQTSELHPICNKSISRQDIDDMTQPGDQRVSLVDDEPSYGKGSDMLYSEFDYDLCNEFVDVTCSPKPDAFNPCEDIMGYNILRVLIWFISILAITGNTTVLVVLTTSQYKLTVPRFLMCNLAFADLCIGIYLLLIASVDIHTKSQYHNYAIDWQTGAGCDAAGFFTVFASELSVYTLAAITLERWHTITHAMQLECKVQLCHAASIMVLGWAFAFAAALFPIFGISSYMKVSICLPMDIDSPLSQLYVMALLVLNALAFVVICGCYTHIYLTVRNPNIVSSSRDTKIAKRMATLIFTDFLCMAPILFFAISASLKVPLITVSKAKILLVLFYPINSCANPFLYAIFTKNFRRDFFVLMSKFGCYEVQAQIYKTETSSITHNFHSRKNPCSSAPRVTNSYVLVPLNHSVQN

SEQ ID NO: 424 - protein, 338 aa, Homo sapiens
MASSGYVLQAELSPSTENSSQLDFEDVWNSSYGVNDSFPDGDYDANLEAAAPCHSCNLLDDSALPFFILTSVLGILASSTVLFMLFRPLFRWQLCPGWPVLAQLAVGSALFSIVVPVLAPGLGSTRSSALCSLGYCVWYGSAFAQALLLGCHASLGHRLGAGQVPGLTLGLTVGIWGVAALLTLPVTLASGASGGLCTLIYSTELKALQATHTVACLAIFVLLPLGLFGAKGLKKALGMGPGPWMNILWAWFIFWWPHGVVLGLDFLVRSKLLLLSTCLAQQALDLLLNLAEALAILHCVATPLLLALFCHQATRTLLPSLPLPEGWSSHLDTLGSKS

SEQ ID NO: 425 - protein, 334 aa, Mus musculus
MGNCLYPVETLSLDKNGTQFTFDSWNYSFEDNYSYELSSDYSLTPAAPCYSCNLLDRSSLPFFMLTSVLGMLASGSILFAILRPFFHWQICPSWPILAELAVGSALFSIAVPILAPGLHSAHSTALCNLGYWVWYTSAFAQALLIGCYACLNPRLNIGQLRGFTLGLSVGLWGAAALSGLPVALASDVYNGFCTFPSSRDMEALKYTHYAICFTIFTVLPLTLLAAKGLKIALSKGPGPWVSVLWIWFIFWWPHGMVLIFDALVRSKTVLLYTCQSQKILDAMLNVTEALSMLHCVATPLLLALFCHQTTRRSLSSLSLPTRQASQMDALAGKS

SEQ ID NO: 426 - protein, 581 aa, Homo sapiens
MQRPGPRLWLVLQVMGSCAAISSMDMERPGDGKCQPIEIPMCKDIGYNMTRMPNLMGHENQREAAIQLHEFAPLVEYGCHGHLRFFLCSLYAPMCTEQVSTPIPACRVMCEQARLKCSPIMEQFNFKWPDSLDCRKLPNKNDPNYLCMEAPNNGSDEPTRGSGLFPPLFRPQRPHSAQEHPLKDGGPGRGGCDNPGKFHHVEKSASCAPLCTPGVDVYWSREDKRFAVVWLAIWAVLCFFSSAFTVLTFLIDPARFRYPERPIIFLSMCYCVYSVGYLIRLFAGAESIACDRDSGQLYVIQEGLESTGCTLVFLVLYYFGMASSLWWVVLTLTWFLAAGKKWGHEAIEANSSYFHLAAWAIPAVKTILILVMRRVAGDELTGVCYVGSMDVNALTGFVLIPLACYLVIGTSFILSGFVALFHIRRVMKTGGENTDKLEKLMVRIGLFSVLYTVPATCVIACYFYERLNMDYWKILAAQHKCKMNNQTKTLDCLMAASIPAVEIFMVKIFMLLVVGITSGMWIWTSKTLQSWQQVCSRRLKKKSRRKPASVITSGGIYKKAQHPQKTHHGKYEIPAQSPTCV

SEQ ID NO: 427 - protein, 452 aa, Mus musculus
MQHPGPRLWLVLQVMIGSCTAISSMDLERPGDGKCQPVEIPMCKDIGYNTTRMPNLMGHENQREAAIQLHEFAPLVEYGCHSHLRFFLCSLYAPMCTEQVSTPIPACRVMCEQARLKCSPIMEQFKFRYPERPIIFLSMCYCVYSVGYIIRLFAGAESIACDRDSGQLYVIQEGLESTGCTLVFLVLYYFGMASSLWWVVLTLTWFLAAGKKWGHEAIEANSSYFHLAAWAIPAVKTILILVMRRVAGDELTGVCYVGSMDVNALTGFVLVPLACYLVIGTSFILSGFVALFHIRRVMKTGGENTDKLEKLMVRIGVFSLLYTVPATCVIACYFYERLNMDYWKMLATQHKCKMNNQTKTPDCLMTTSIPAVEVFMVKVSMLLVVGITSGVWVWTSKTLQSWQHVCSRGLKRKSRRKPASVVTSAGIYKKAQHPQKPHLGKYELPAQPSACV

SEQ ID NO: 428 - protein, 565 aa, Homo sapiens
MRPRSALPRLLLPLLLLPAAGPAQFHGEKGISIPDHGFCQPISIPLCTDIAYNQTIMPNLLGHTNQEDAGLEVHQFYPLVKVQCSPELRFFLCSMYAPVCTVLEQAIPPCRSICERARQGCEALMNKFGFQWPERLRCEHFPRHGAEQICVGQNHSEDGAPALLTTAPPPGLQPGAGGTPGGPGGGGAPPRYATLEHPFHCPRVLKVPSYLSYKFLGERDCAAPCEPARPDGSMFFSQEETRFARLWILTWSVLCCASTFFTVTTYLVDMQRFRYPERPIIFLSGCYTMVSVAYIAGFVLQERVVCNERFSEDGYRTVVQGTKKEGCTILFMMLYFFSMASSIWWVILSLTWFLAAGMKWGHEAIEANSQYFHLAAWAVPAVKTITILAMGQIDGDLLSGVCFVGLNSLDPLRGFVLAPLFVYLFIGTSFLLAGFVSLFRIRTIMKHDGTKTEKLERLMVRIGVFSVLYTVPATIVIACYFYEQAFREHWERSWVSQHCKSLAIPCPAHYTPRMSPDFTVYMIKYLMTLIVGITSGFWIWSGKTLHSWRKFYTRLTNSRHGETTV

SEQ ID NO: 429 - protein, 570 aa, Mus musculus
MRARSALPRSALPRLLLPLLLLPAAGPAQFHGEKGISIPDHGFCQPISIPLCTDIAYNQTIMPNLLGHTNQEDAGLEVHQFYPLVKVQCSPELRFFLCSMYAPVCTVLEQAIPPCRSICERARQGCEALMNKFGFQWPERLRCEHFPRHGAEQICVGQNHSEDGAPALLTTAPPSGLQPGAGGTPGGPGGGGSPPRYATLEHPFHCPRVLKVPSYLSYKFLGERDCAAPCEPARPDGSMFFSQEETRFARLWILTWSVLCCASTFFTVTTYLVDMQRFRYPERPIIFLSGCYTMVSVAYIAGFVLQERVVCNERFSEDGYRTVVQGTKKEGCTILFMMLYFFSMASSIWWVILSLTWFLAAGMKWGHEAIEANSQYFHLAAWAVPAVKTITILAMGQIDGDLLSGVCFVGLNSLDPLRGFVLAPLFVYLFIGTSFLLAGFVSLFRIRTIMKHDGTKTEKLERLMVRIGVFSVLYTVPATIVIACYFYEQAFREHWERSWVSQHCKSLAIPCPAHYTPRMSPDFTVYMIKYLMTLIVGITSGFWIWSGKTLHSWRKFYTRLTNSRHGETTV

SEQ ID NO: 430 - protein, 666 aa, Homo sapiens
MAMTWIVFSLWPLTVFMGHIGGHSLFSCEPITLRMCQDLPYNTTFMPNLLNHYDQQTAALAMEPFHPMVNLDCSRDFRPFLCALYAPICMEYGRVTLPCRRLCQRAYSECSKLMEMFGVPWPEDMECSRFPDCDEPYPRLVDLNLAGEPTEGAPVAVQRDYGFWCPRELKIDPDLGYSFLHVRDCSPPCPNMYFRREELSFARYFIGLISIICLSATLFTFLTFLIDVTRFRYPERPIIFYAVCYMMVSLIFFIGFLLEDRVACNASIPAQYKASTVTQGSHNKACTMLFMILYFFTMAGSVWWVILTITWFLAAVPKWGSEAIEKKALLFHASAWGIPGTLTIILLAMNKIEGDNISGVCFVGLYDVDALRYFVLAPLCLYVVVGVSLLLAGIISLNRVRIEIPLEKENQDKLVKFMIRIGVFSILYLVPLLVVIGCYFYEQAYRGIWETTWIQERCREYHIPCPYQVTQMSRPDLILFLMKYLMALIVGIPSVFWVGSKKTCFEWASFFHGRRKKEIVNESRQVLQEPDFAQSLLRDPNTPIIRKSRGTSTQGTSTHASSTQLAMVDDQRSKAGSIHSKVSSYHGSLHRSRDGRYTPCSYRGMEERLPHGSMSRLTDHSRHSSSHRLNEQSRHSSIRDLSNNPMTHITHGTSMNRVIEEDGTSA

SEQ ID NO: 431 - protein, 666 aa, Mus musculus
MAVSWIVFDLWLLTVFLGQIGGHSLFSCEPITLRMCQDLPYNTTFMPNLLNHYDQQTAALAMEPFHPMVNLDCSRDFRPFLCALYAPICMEYGRVTLPCRRLCQRAYSECSKLMEMFGVPWPEDMECSRFPDCDEPYPRLVDLNLVGDPTEGAPVAVQRDYGFWCPRELKIDPDLGYSFLHVRDCSPPCPNMYFRREELSFARYFIGLISIICLSATLFTFLTFLIDVTRFRYPERPIIFYAVCYMMVSLIFFIGFLLEDRVACNASSPAQYKASTVTQGSHNKACTMLFMVLYFFTMAGSVWWVILTITWFLAAVPKWGSEAIEKKALLFHASAWGIPGTLTIILLAMNKIEGDNISGVCFVGLYDVDALRYFVLAPLCLYVVVGVSLLLAGIISLNRVRIEIPLEKENQDKLVKFMIRIGVFSILYLVPLLVVIGCYFYEQAYRGIWETTWIQERCREYHIPCPYQVTQMSRPDLILFLMKYLMALIVGIPSIFWVGSKKTCFEWASFFHGRRKKEIVNESRQVLQEPDFAQSLLRDPNTPIIRKSRGTSTQGTSTHASSTQLAMVDDQRSKAGSVHSKVSSYHGSLHRSRDGRYTPCSYRGMEERLPHGSMSRLTDHSRHSSSHRLNEQSRHSSIRDLSNNPMTHITHGTSMNRVIEEDGTSA

SEQ ID NO: 432 - protein, 537 aa, Homo sapiens [sequence omitted]

SEQ ID NO: 433 - protein, 537 aa, Mus musculus
MAWPGTGPSSRGAPGGVGLRLGLLLQFLLLLRPTLGFGDEEERRCDPIRIAMCQNLGYNVTKMPNLVGHELQTDAELQLTTFTPLIQYGCSSQLQFFLCSVYVPMCTEKINIPIGPCGGMCLSVKRRCEPVLREFGFAWPDTLNCSKFPPQNDHNHMCMEGPGDEEVPLPHKTPIQPGEECHSVGSNSDQYIWVKRSLNCVLKCGYDAGLYSRSAKEFTDIWMAVWASLCFISTTFTVLTFLIDSSRFSYPERPIIFLSMCYNIYSIAYIVRLTVGRERISCDFEEAAEPVLIQEGLKNTGCAIIFLLMYFFGMASSIWWVILTLTWFLAAGLKWGHEAIEMHSSYFHIAAWAIPAVKTIVILIMRLVDADELTGLCYVGNQNLDALTGFVVAPLFTYLVIGTLFIAAGLVALFKIRSNLQKDGTKTDKLERLMVKIGVFSVLYTVPATCVIACYFYEISNWALFRYSADDSNMAVEMLKIFMSLLVGITSGMWIWSAKTLHTWQKCSNRLVNSGKVKREKRGNGWVKPGKGNETVV

SEQ ID NO: 434 - protein, 585 aa, Homo sapiens
MARPDPSAPPSLLLLLLAQLVGRAAAASKAPVCQEITVPMCRGIGYNLTHMPNQFNHDTQDEAGLEVHQFWPLVEIQCSPDLRFFLCTMYTPICLPDYHKPLPPCRSVCERAKAGCSPLMRQYGFAWPERMSCDRLPVLGRDAEVLCMDYNRSEATTAPPRPFPAKPTLPGPPGAPASGGECPAGGPFVCKCREPFVPILKESHPLYNKVRTGQVPNCAVPCYQPSFSADERTFATFWIGLWSVLCFISTSTTVATFLIDMDTFRYPERPIIFLSACYLCVSLGFLVRLVVGHASVACSREHNHIHYETTGPALCTIVFLLVYFFGMASSIWWVILSLTWFLAAAMKWGNEAIAGYGQYFHLAAWLIPSVKSITALALSSVDGDPVAGICYVGNQNLNSLRRFVLGPLVLYLLVGTLFLLAGFVSLFRIRSVIKQGGTKTDKLEKLMIRIGIFTLLYTVPASIVVACYLYEQHYRESWEAALTCACPGHDTGQPRAKPEYWVLMLKYFMCLVVGITSGVWIWSGKTVESWRRFTSRCCCRPRRGHKSGGAMAAGDYPEASAALTGRTGPPGPAATYHKQVSLSHV

SEQ ID NO: 435 - protein, 577 aa, Mus musculus
MARPDPSAPPSLLLLLLAQLVGRAAAASKAPVCQEITVPMCRGIGYNLTHMPNQFNHDTQDEAGLEVHQFWPLVEIHCSPDLRFFLCSMYTPICLPDYHKPLPPCRSVCERAKAGCSPLMRQYGFAWPERMSCDRLPVLGGDAEVLCMDYNRSETTASPKSFPAKPTLPGPQGRHLPGGECSGGHRVQSEPFVPILKESHPLYNKVRTGQVPNCAVPCYQPSFSPDERTFATFWIGLWSVLCFISTSTTVATFLIDMERFRYPERPIIFLSACYLCVSLGFLVRLVVGHASVACSREHSHIHYETTGPALCTVVFLLVYFFGMASSIWWVILSLTWFLAAGMKWGNEAIAGYAQYFHLAAWLIPSVKSITALALSSVDGDPVAGICYVGNQNLNSLRSFVLGPLVLYLLVGTLFLLAGFVSLFRIRSVIKQGGTKTDKLEKLMIRIGIFTLLYTVPASIVVACYLYEQHYRETWEAPLTCACPGTDAGQPRQTEYWVLMLNTSCSWWWASLGIWTGPARSGVLAAVHSRCCCSSRRGHKAVALWPQETMRRPAPRSPAGPGRLAPPPHTTSMSLSHV

SEQ ID NO: 436 - protein, 706 aa, Homo sapiens
MEMFTFLLTCIFLPLLRGHSLFTCEPITVPRCMKMAYNMTFFPNLMGHYDQSIAAVEMEHFLPLANLECSPNIETFLCKAFVPTCIEQIHVVPPCRKLCEKVYSDCKKLIDTFGIRWPEELECDRLQYCDETVPVTFDPHTEFLGPQKKTEQVQRDIGFWCPRHLKTSGGQGYKFLGIDQCAPPCPNMYFKSDELEFAKSFIGTVSIFCLCATLFTFLTFLIDVRRFRYPERPIIYYSVCYSIVSLMYFIGFLLGDSTACNKADEKLELGDTVVLGSQNKACTVLFMLLYFFTMAGTVWWVILTITWFLAAGRKWSCEAIEQKAVWFHAVAWGTPGFLTVMLLALNKVEGDNISGVCFVGLYDLDASRYFVLLPLCLCVFVGLSLLLAGIISLNHVRQVIQHDGRNQEKLKKFMIRIGVFSGLYLVPLVTLLGCYVYEQVNRITWEITWVSDHCRQYHIPCPYQAKAKARPELALFMIKYLMTLIVGISAVFWVGSKKTCTEWAGFFKRNRKRDPISESRRVLQESCEFFLKHNSKVKHKKKHYKPSSHKLKVISKSMGTSTGATANHGTSAVAITSHDYLGQETLTEIQTSPETSMREVKADGASTPRLREQDCGEPASPAASISRLSGEQVDGKGQAGSVSESARSEGRISPKSDITDTGLAQSNNLQVPSSSEPSSLKGSTSLLVHPVSGVRKEQGGGCHSDT

SEQ ID NO: 437 - protein, 709 aa, Mus musculus
MERSPFLLACILLPLVRGHSLFTCEPITVPRCMKMTYNMTFFPNLMGHYDQGIAAVEMGHFLHLANLECSPNIEMFLCQAFIPTCTEQIHVVLPCRKLCEKIVSDCKKLMDTFGIRWPEELECNRLPHCDDTVPVTSHPHTELSGPQKKSDQVPRDIGFWCPKHLRTSGDQGYRFLGIEQCAPPCPNMYFKSDELDFAKSFIGIVSIFCLCATLFTFLTFLIDVRRFRYPERPIIYYSVCYSIVSLMYFVGFLLGNSTACNKADEKLELGDTVVLGSKNKACSVVFMFLYFFTMAGTVWWVILTITWFLAAGRKWSCEAIEQKAVWFHAVAWGAPGFLTVMLLAMNKVEGDNISGVCFVGLYDLDASRYFVLLPLCLCVFVGLSLLLAGIISLNHVRQVIQHDGRNQEKLKKFMIRIGVFSGLYLVPLVTLLGCYVYELVNRITWEMTWFSDHCHQYRIPCPYQANPKARPELALFMIKYLMTLIVGISAVFWVGSKKTCTEWAGFFKRNRKRDPISESRRVLQESCEFFLKHNSKVKHKKKHGAPGPHRLKVISKSMGTSTGATTNHGTSAMAIADHDYLGQETSTEVHTSPEASVKEGRADRANTPSAKDRDCGESAGPSSKLSGNRNGRESRAGGLKERSNGSEGAPSEGRVSPKSSVPETGLIDCSTSQAASSPEPTSLKGSTSLPVHSASRARKEQGAGSHSDA

SEQ ID NO: 438 - protein, 574 aa, Homo sapiens
MRDPGAAAPLSSLGLCALVLALLGALSAGAGAQPYHGEKGISVPDHGFCQPISIPLCTDIAYNQTILPNLLGHTNQEDAGLEVHQFYPLVKVQCSPELRFFLCSMYAPVCTVLDQAIPPCRSLCERARQGCEALMNKFGFQWPERLRCENFPVHGAGEICVGQNTSDGSGGPGGGPTAYPTAPYLPDLPFTALPPGASDGRGRPAFPFSCPRQLKVPPYLGYRFLGERDCGAPCEPGRANGLMYFKEEERRFARLWVGVWSVLCCASTLFTVLTYLVDMRRFSYPERPIIFLSGCYFMVAVAHVAGFLLEDRAVCVERFSDDGYRTVAQGTKKEGCTILFMVLYFFGMASSIWWVILSLTWFLAAGMKWGHEAIEANSQYFHLAAWAVPAVKTITILAMGQVDGDLLSGVCYVGLSSVDALRGFVLAPLFVYLFIGTSFLLAGFVSLFRIRTIMKHDGTKTEKLEKLMVRIGVFSVLYTVPATIVLACYFYEQAFREHWERTWLLQTCKSYAVPCPPGHFPPMSPDFTVFMIKYLMTMIVGITTGFWIWSGKTLQSWRRFYHRLSHSSKGETAV

SEQ ID NO: 439 - protein, 572 aa, Mus musculus
MRGPGTAASHSPLGLCALVLALLGALPTDTRAQPYHGEKGISVPDHGFCQPISIPLCTDIAYNQTILPNLLGHTNQEDAGLEVHQFYPLVKVQCSPELRFFLCSMYAPVCTVLDQAIPPCRSLCERARQGCEALMNKFGFQWPERLRCENFPVHGAGEICVGQNTSDGSGGAGGSPTAYPTAPYLPDPPFTAMSPSDGRGRLSFPFSCPRQLKVPPYLGYRFLGERDCGAPCEPGRANGLMYFKEEERRFARLWVGVWSVLSCASTLFTVLTYLVDMRRFSYPERPIIFLSGCYFMVAVAHVAGFLLEDRAVCVERFSDDGYRTVAQGTKKEGCTILFMVLYFFGMASSIWWVILSLTWFLAAGMKWGHEAIEANSQYFHLAAWAVPAVKTITILAMGQVDGDLLSGVCYVGLSSVDALRGFVLAPLFVYLFIGTSFLLAGFVSLFRIRTIMKHDGTKTEKLEKLMVRIGVFSVLYTVPATIVLACYFYEQAFREHWERTWLLQTCKSYAVPCPPRHFSPMSPDFTVFMIKYLMTMIVGITTGFWIWSGKTLQSWRRFYHRLSHSSKGETAV

SEQ ID NO: 440 - protein, 694 aa, Homo sapiens
MEWGYLLEVTSLLAALALLQRSSGAAAASAKELACQEITVPLCKGIGYNYTYMPNQFNHDTQDEAGLEVHQFWPLVEIQCSPDLKFFLCSMYTPICLEDYKKPLPPCRSVCERAKAGCAPLMRQYGFAWPDRMRCDRLPEQGNPDTLCMDYNRTDLTTAAPSPPRRLPPPPPGEQPPSGSGHGRPPGARPPHRGGGRGGGGGDAAAPPARGGGGGGKARPPGGGAAPCEPGCQCRAPMVSVSSERHPLYNRVKTGQIANCALPCHNPFFSQDERAFTVFWIGLWSVLCFVSTFATVSTFLIDMERFKYPERPIIFLSACYLFVSVGYLVRLVAGHEKVACSGGAPGAGGAGGAGGAAAGAGAAGAGAGGPGGRGEYEELGAVEQHVRYETTGPALCTVVFLLVYFFGMASSIWWVILSLTWFLAAGMKWGNEAIAGYSQYFHLAAWLVPSVKSIAVLALSSVDGDPVAGICYVGNQSLDNLRGFVLAPLVIYLFIGTMFLLAGFVSLFRIRSVIKQQDGPTKTHKLEKLMIRLGLFTVLYTVPAAVVVACLFYEQHNRPRWEATHNCPCLRDLQPDQARRPDYAVFMLKYFMCLVVGITSGVWVWSGKTLESWRSLCTRCCWASKGAAVGGGAGATAAGGGGGPGGGGGGGPGGGGGPGGGGGSLYSDVSTGLTWRSGTASSVSYPKQMPLSQV

SEQ ID NO: 441 - protein, 685 aa, Mus musculus
MEWGYLLEVTSLLAALAVLQRSSGAAAASAKELACQEITVPLCKGIGYNYTYMPNQFNHDTQDEAGLEVHQFWPLVEIQCSPDLKFFLCSMYTPICLEDYKKPLPPCRSVCERAKAGCAPLMRQYGFAWPDRMRCDRLPEQGNPDTLCMDYNRTDLTTAAPSPPRRLPPPPPPGEQPPSGSGHSRPPGARPPHRGGSSRGSGDAAAAPPSRGGKARPPGGGAAPCEPGCQCRAPMVSVSSERHPLYNRVKTGQIANCALPCHNPFFSQDERAFTVFWIGLWSVLCFVSTFATVSTFLIDMERFKYPERPIIFLSACYLFVSVGYLVRLVAGHEKVACSGGAPGAGGRGGAGGAAAAGAGAAGRGASSPGARGEYEELGAVEQHVRYETTGPALCTVVFLLVYFFGMASSIWWVILSLTWFLAAGMKWGNEAIAGYSQYFHLAAWLVPSVKSIAVLALSSVDGDPVAGICYVGNQSLDNLRGFVLAPLVIYLFIGTMFLLAGFVSLFRIRSVIKQQGGPTKTHKLEKLMIRLGLFTVLYTVPAAVVVACLFYEQHNRPRWEATHNCPCLRDLQPDQARRPDYAVFMLKYFMCLVVGITSGVWVWSGKTLESWRALCTRCCWASKGAAVGAGAGGSGPGGSGPGPGGGGGHGGGGGSLYSDVSTGLTWRSGTASSVSYPKQMPLSQV

SEQ ID NO: 442 - protein, 591 aa, Homo sapiens
MAVAPLRGALLLWQLLAAGGAALEIGRFDPERGRGAAPCQAVEIPMCRGIGYNLTRMPNLLGHTSQGEAAAELAEFAPLVQYGCHSHLRFFLCSLYAPMCTDQVSTPIPACRPMCEQARLRCAPIMEQFNFGWPDSLDCARLPTRNDPHALCMEAPENATAGPAEPHKGLGMLPVAPRPARPPGDLGPGAGGSGTCENPEKFQYVEKSRSCAPRCGPGVEVFWSRRDKDFALVWMAVWSALCFFSTAFTVLTFLLEPHRFQYPERPIIFLSMCYNVYSLAFLIRAVAGAQSVACDQEAGALYVIQEGLENTGCTLVFLLLYYFGMASSLWWVVLTLTWFLAAGKKWGHEAIEAHGSYFHMAAWGLPALKTIVILTLRKVAGDELTGLCYVASTDAAALTGFVLVPLSGYLVLGSSFLLTGFVALFHIRKIMKTGGTNTEKLEKLMVKIGVFSILYTVPATCVIVCYVYERLNMDFWRLRATEQPCAAAAGPGGRRDCSLPGGSVPTVAVFMLKIFMSLVVGITSGVWVWSSKTFQTWQSLCYRKIAAGRARAKACRAPGSYGRGTHCHYKAPTVVLHMTKTDPSLENPTHL

SEQ ID NO: 443 - protein, 592 aa, Mus musculus
MAVPPLLRGALLLWQLLATGGAALEIGRFDPERGRGPAPCQAMEIPMCRGIGYNLTRMPNLLGHTSQGEAAAQLAEFSPLVQYGCHSHLRFFLCSLYAPMCTDQVSTPIPACRPMCEQARLRCAPIMEQFNFGWPDSLDCARLPTRNDPHALCMEAPENATAGPTEPHKGLGMLPVAPRPARPPGDSAPGPGSGGTCDNPEKFQYVEKSRSCAPRCGPGVEVFWSRRDKDFALVWMAVWSALCFFSTAFTVFTFLLEPHRFQYPERPIIFLSMCYNVYSLAFLIRAVAGAQSVACDQEAGALYVIQEGLENTGCTLVFLLLYYFGMASSLWWVVLTLTWFLAAGKKWGHEAIEAHGSYFHMAAWGLPALKTIVVLTLRKVAGDELTGLCYVASMDPAALTGFVLVPLSCYLVLGTSFLLTGFVALFHIRKIMKTGGTNTEKLEKLMVKIGVFSILYTVPATCVIVCYVYERLNMDFWRLRATEQPCTAATVPGGRRDCSLPGGSVPTVAVFMLKIFMSLVVGITSGVWVWSSKTFQTWQSLCYRKMAAGRARAKACRTPGGYGRGTHCHYKAPTVVLHMTKTDPSLENPTHL

SEQ ID NO: 444 - protein, 380 aa, Homo sapiens
MCPMLLKNGYNGNATPVTTTAPWASLGLSAKTCNNVSFEESRIVLVVVYSAVCTLGVPANCLTAWLALLQVLQGNVLAVYLLCLALCELLYTGTLPLWVIYIRNQHRWTLGLLACKVTAYIFFCNIYVSILFLCCISCDRFVAVVYALESRGRRRRRTAILISACIFILVGIVHYPVFQTEDKETCFDMLQMDSRIAGYYYARFTVGFAIPLSIIAFTNHRIFRSIKQSMGLSAAQKAKVKHSAIAVVVIFLVCFAPYHLVLLVKAAAFSYYRGDRNAMCGLEERLYTASVVFLCLSTVNGVADPIIYVLATDHSRQEVSRIHKGWKEWSMKTDVTRLTHSRDTEELQSPVALADHYTFSRPVHPPGSPCPAKRLIEESC

SEQ ID NO: 445 - protein, 382 aa, Mus musculus
MRSEPTNAAGNTTLGVTSVLQSTSVPSSETCHVSYEESRVVLVVVYSAVCLLGLPANCLTAWLTLLQVLQRNVLAVYLFCLSLCELLYISTVPLWIIYIQNQHKWNLGPQACKVTAYIFFCNIYISILLLCCISCDRYMAVVYALESRGHRHQRTAVTISACVILLVGLVNYPVFDMKVEKSFCFEPLRMNSKIAGYHYLRFTFGFAIPLGILAFTNHQIFRSIKLSDSLSAAQKNKVKRSAIAVVTIFLVCFAPYHVVLLVKAASFSFYQGDMDAVCAFESRLYTVSMVFLCLSTVNSVADPIIYVLGTDHSRQEVSRIHTGWKKWSTKTYVTCSKDSEETHLPTELSNTYTFPNPAHPPGSQPAKLGLLCSPERLPEELC

SEQ ID NO: 446 - protein, 961 aa, Homo sapiens
MLLLLLLAPLFLRPPGAGGAQTPNATSEGCQIIHPPWEGGIRYRGLTRDQVKAINFLPVDYEIEYVCRGEREVVGPKVRKCLANGSWTDMDTPSRCVRICSKSYLTLENGKVFLTGGDLPALDGARVDFRCDPDFHLVGSSRSICSQGQWSTPKPHCQVNRTPHSERRAVYIGALFPMSGGWPGGQACQPAVEMALEDVNSRRDILPDYELKLIHHDSKCDPGQATKYLYELLYNDPIKIILMPGCSSVSTLVAEAARMWNLIVLSYGSSSPALSNRQRFPTFFRTHPSATLHNPTRVKLFEKWGWKKIATIQQTTEVFTSTLDDLEERVKEAGIEITFRQSFFSDPAVPVKNLKRQDARIIVGLFYETEARKVFCEVYKERLFGKKYVWFLIGWYADNWFKIYDPSINCTVDEMTEAVEGHITTEIVMLNPANTRSISNMTSQEFVEKLTKRLKRHPEETGGFQEAPLAYDAIWALALALNKTSGGGGRSGVRLEDFNYNNQTITDQIYRAMNSSSFEGVSGHVVFDASGSRMAWTLIEQLQGGSYKKIGYYDSTKDDLSWSKTDKWIGGSPPADQTLVIKTFRFLSQKLFISVSVLSSLGIVLAVVCLSFNIYNSHVRYIQNSQPNLNNLTAVGCSLALAAVFPLGLDGYHIGRNQFPFVCQARLWLLGLGFSLGYGSMFTKIWWVHTVFTKKEEKKEWRKTLEPWKLYATVGLLVGMDVLTLAIWQIVDPLHRTIETFAKEEPKEDIDVSILPQLEHCSSRKMNTWLGIFYGYKGLLLLLGIFLAYETKSVSTEKINDHRAVGMAIYNVAVLCLITAPVTMILSSQQDAAFAFASLAIVFSSYITLVVLFVPKMRRLITRGEWQSEAQDTMKTGSSTNNNEEEKSRLLEKENRELEKIIAEKEERVSELRHQLQSRQQLRSRRHPPTPPEPSGGLPRGPPEPPDRLSCDGSRVHLLYK

SEQ ID NO: 447 - protein, 960 aa, Mus musculus
MLLLLLVPLFLRPLGAGGAQTPNVTSEGCQIIHPPWEGGIRYRGLTRDQVKAINFLPVDYEIEYVCRGEREVVGPKVRKCLANGSWTDMDTPSRCVRICSKSYLTLENGKVFLTGGDLPALDGARVDFRCDPDFHLVGSSRSICSQGQWSTPKPHCQVNRTPHSERRAVYIGALFPMSGGWPGGQACQPAVEMALEDVNSRRDILPDYELKLIHHDSKCDPGQATKYLYELLYNDPIKIILMPGCSSVSTLVAEAARMWNLIVLSYGSSSPALSNRQRFPTFFRTHPSATLHNPTRVKLFEKWGWKKIATIQQTTEVFTSTLDDLEERVKEAGIEITFRQSFFSDPAVPVKNLKRQDARIIVGLFYETEARKVFCEVYKERLFGKKYVWFLIGWYADNWFKTYDPSINCTVEEMTEAVEGHITTEIVMLNPANTRSISNMTSQEFVEKLTKRLKRHPEETGGFQEAPLAYDAIWALALALNKTSGGGGRSGVRLEDFNYNNQTITDQIYRAMNSSSFEGVSGHVVFDASGSRMAWTLIEQLQGGSYKKIGYYDSTKDDLSWSKTDKWIGGSPPADQTLVIKTFRFLSQKLFISVSVLSSLGIVLAVVCLSFNIYNSHVRYIQNSQPNLNNLTAVGCSLALAAVFPLGLDGYHIGRSQFPFVCQARLWLLGLGFSLGYGSMFTKIWWVHTVFTKKEEKKEWRKTLEPWKLYATVGLLVGMDILTLAIWQIVDPLHRTIETFAKEEPKEDIDVSILPQLEHCSSKKMNTWLGIFYGYKGLLLLLGIFLAYETKSVSTEKINDHRAVGMAIYNVAVLCLITAPVTMILSSQQDAAFAFASLAIVFSSYITLVVLFVPKMRRLITRGEWQSEAQDTMKTGSSTNNNEEEKSRLLEKENRELEKIIAEKEERVSELRHQLQSRQQIRSRRHPPTPPDPSGGLPRGPSEPPDRLSCDGSRVHLLYK

SEQ ID NO: 448 - protein, 349 aa, Homo sapiens [sequence omitted]

SEQ ID NO: 449 - protein, 348 aa, Mus musculus
MELAMVNLSEGNGSDPEPPAPESRPLFGIGVENFITLVVFGLIFAMGVLGNSLVITVLARSKPGKPRSTTNLFILNLSIADLAYLLFCIPFQATVYALPTWVLGAFICKFIHYFFTVSMLVSIFTLAAMSVDRYVAIVHSRRSSSLRVSRNALLGVGFIWALSIAMASPVAYHQRLFHRDSNQTFCWEQWPNKLHKKAYVVCTFVFGYLLPLLLICFCYAKVLNHLHKKLKNMSKKSEASKKKTAQTVLVVVVVFGISWLPHHVVHLWAEFGAFPLTPASFFFRITAHCLAYSNSSVNPIIYAFLSENFRKAYKQVFKCHVCDESPRSETKENKSRMDTPPSTNCTHV

SEQ ID NO: 450 - protein, 387 aa, Homo sapiens
MNVSGCPGAGNASQAGGGGGWHPEAVIVPLLFALIFLVGTVGNTLVLAVLLRGGQAVSTTNLFILNLGVADLCFILCCVPFQATIYTLDGWVFGSLLCKAVHFLIFLTMHASSFTLAAVSLDRYLAIRYPLHSRELRTPRNALAAIGLIWGLSLLFSGPYLSYYRQSQLANLTVCHPAWSAPRRRAMDICTFVFSYLLPVLVLGLTYARTLRYLWRAVDPVAAGSGARRAKRKVTRMILIVAALFCLCWMPHHALILCVWFGQFPLTRATYALRILSHLVSYANSCVNPIVYALVSKHFRKGFRTICAGLLGRAPGRASGRVCAAARGTHSGSVLERESSDLLHMSEAAGALRPCPGASQPCILEPCPGPSWQGPKAGDSILTVDVA

SEQ ID NO: 451 - protein, 371 aa, Mus musculus
MNGSDSQGAEDSSQEGGGGWQPEAVLVPLFFALIFLVGAVGNALVLAVLLRGGQAVSTTNLFILNLGVADLCFILCCVPFQATIYTLDDWVFGSLLCKAVHFLIFLTMHASSFTLAAVSLDRYLAIRYPMHSRELRTPRNALAAIGLIWGLALLFSGPYLSYYSQSQLANLTVCHPAWSAPRRRAMDLCTFVFSYLLPVLVLSLTYARTLHYLWRTVDPVAAGSGSQRAKRKVTRMIVIVAVLFCLCWMPHHALILCVWFGRFPLTRATYALRILSHLVSYANSCVNPIVYALVSKHFRKGFRKICAGLLRRAPRRASGRVCILAPGNHSGGMLEPESTDLTQVSEAAGPLVPAPALPNCTTLSRTLDPAC

SEQ ID NO: 452 - protein, 368 aa, Homo sapiens
MADAQNISLDSPGSVGAVAVPVVFALIFLLGTVGNGLVLAVLLQPGPSAWQEPGSTTDLFILNLAVADLCFILCCVPFQATIYTLDAWLFGALVCKAVHLLIYLTMYASSFTLAAVSVDRYLAVRHPLRSRALRTPRNARAAVGLVWLLAALFSAPYLSYYGTVRYGALELCVPAWEDARRRALDVATFAAGYLLPVAVVSLAYGRTLRFLWAAVGPAGAAAAEARRRATGRAGRAMLAVAALYALCWGPHHALILCFWYGRFAFSPATYACRLASHCLAYANSCLNPLVYALASRHFRARFRRLWPCGRRRRHRARRALRRVRPASSGPPGCPGDARPSGRLLAGGGQGPEPREGPVHGGEAARGPE

SEQ ID NO: 453 - protein, 370 aa, Mus musculus
MADIQNISLDSPGSVGAVAVPVVFALIFLLGMVGNGLVLAVLLQPGPSAWQEPGSTTDLFILNLAVADLCFILCCVPFQAAIYTLDAWLFGAFVCKTVHLLIYLTMYASSFTLAAVSVDRYLAVRHPLRSRALRTPRNARAAVGLVWLLAALFSAPYLSYYGTVRYGALELCVPAWEDARRRALDVATFAAGYLLPVTVVSLAYGRTLCFLWAAVGPAGAAAAEARRRATGRAGRAMLAVAALYALCWGPHHALILCFWYGRFAFSPATYACRLASHCLAYANSCLNPLVYSLASRHFRARFRRLWPCGHRRHRHHHHRLHRALRRVQPASSGPAGYPGDARPRGWSMEPRGDALRGGETRLTLSARGPQ

SEQ ID NO: 454 - protein, 477 aa, Homo sapiens
MPPCQPQRPLLLLLLLLACQPQVPSAQVMDFLFEKWKLYGDQCHHNLSLLPPPTELVCNRTFDKYSCWPDTPANTTANISCPWYLPWHHKVQHRFVFKRCGPDGQWVRGPRGQPWRDASQCQMDGEEIEVQKEVAKMYSSFQVMYTVGYSLSLGALLLALAILGGLSKLHCTRNAIHANLFASFVLKASSVLVIDGLLRTRYSQKIGDDLSVSTWLSDGAVAGCRVAAVFMQYGIVANYCWLLVEGLYLHNLLGLATLPERSFFSLYLGIGWGAPMLFVVPWAVVKCLFENVQCWTSNDNMGFWWILRFPVFLAILINFFIFVRIVQLLVAKLRARQMHHTDYKFRLAKSTLTLIPLLGVHEVVFAFVTDEHAQGTLRSAKLFFDLFLSSFQGLLVAVLYCFLNKEVQSELRRRWHRWRLGKVLWEERNTSNHRASSSPGHGPPSKELQFGRGGGSQDSSAETPLAGGLPRLAESPF

SEQ ID NO: 455 - protein, 485 aa, Mus musculus
MPLTQLHCPHLLLLLLVLSCLPEAPSAQVMDFLFEKWKLYSDQCHHNLSLLPPPTELVCNRTFDNYSCWPDTPPNTTANISCPWYLPWCHKVQHRLVFKRCGPDGQWVRGPRGQPWRNASQCQLDDEEIEVQKGVAKMYSSQQVMYTVGYSLSLGALLLALVILLGLRKLHCTRNYIHGNLFASFVLKAGSVLVIDWLLKTRYSQKIGDDLSVSVWLSDGAMAGCRVATVIMQYGIIPNYCWLLVEGVYLYSLLSLATFSERSFFSLYLGIGWGAPLLFVIPWVVVKCLFENVQCWTSNDNMGFWWILRIPVFLALLINFFIFVHIIQLLVAKLRAHQMHYADYKFRLARSTLTLIPLLGVHEVVFAFVTDEHAQGTLRSTKLFFDLFLSSFQGLLVAVLYCFLNKEVQAELMRRWRQWQEGKALQEERLASSHGSHMAPAGPCHGDPCEKLQLMSAGSSSGTGCVPSMETSLASSLPRLADSPT

SEQ ID NO: 456 - protein, 423 aa, Homo sapiens
MDRRMWGAHVFCVLSPLPTVLGHMHPECDFITQLREDESACLQAAEEMPNTTLGCPATWDGLLCWPTAGSGEWVTLPCPDFFSHFSSESGAVKRDCTITGWSEPFPPYPVACPVPLELLAEEESYFSTVKIIYTVGHSISIVALFVAITILVALRRLHCPRNYVHTQLFTTFILKAGAVFLKDAALFHSDDTDHCSFSTVLCKVSVAASHFATMTNFSWLLAEAVYLNCLLASTSPSSRRAFWWLVLAGWGLPVLFTGTWVSCKLAFEDIACWDLDDTSPYWWIIKGPIVLSVGVNFGLFLNIIRILVRKLEPAQGSLHTQSQYWRLSKSTLFLIPLFGIHYIIFNFLPDNAGLGIRLPLELGLGSFQGFIVAILYCFLNQEVRTEISRKWHGHDPELLPAWRTRAKWTTPSRSAAKVLTSMC

SEQ ID NO: 457 - protein, 423 aa, Mus musculus
MDGLMWATRILCLLSLCGVTLGHLHLECDFITQLRDDELACLQAAEGTNNTSLGCPGTWDGLLCWPPTGSGQWVSLPCPEFFSHFGSDTGFVKRDCTITGWSNPFPPYPVACPVPLELLTKEKSYFSTVKIIYTTGHSISIVALCVAIAILVALRRLHCPRNYIHTQLFATFILKASAVFLKDAAIFQGDSTDHCSMSTVLCKVSVAISHLATMTNFSWLLAEAVYLSCLLASTSPRSKPAFWWLVLAGWGLPVLCTGTWVGCKHSFEDTECWDLDNSSPCWWIIKGPIVLSVGVNFGLFLNIICILLRKLEPAQGGLHTRAQYWRLSKSTLLLIPLFGIHYIIFNFLPDSAGLDIRVPLELGLGSFQGFIVAVLYCFLNQEVRTEISRKWYGHDPELLPARRTCTEWTTPPRSRLKVLTSEC

SEQ ID NO: 458 - protein, 463 aa, Homo sapiens [sequence omitted]

SEQ ID NO: 459 - protein, 489 aa, Mus musculus
MASTPSLLRLALLLLGAVGRAGPRPQGTTVSLSETVQKWREYRRQCQHFLTEAPLLATGLFCNRTFDDYACWPDGPPGSFVNVSCPWYLPWASSVLQGHVYRFCTAEGLWLHKDNSSLPWRDLSECEESKRGERNFPEEQLLSLYIIYTVGYALSFSALVIASAILVGFRHLHCTRNYIHLNLFASFILRALSVFIKDAALKWMYSTAAQQHQWDGLLSYQDSLGCRLVFLLMQYCVAANYYWLLVEGVYLYTLLAFSVFSEQRIFKLYLSIGWGVPLLFVIPWGIVKYLYEDEGCWTRNSNMNYWLIIRLPILFAIGVNFLIFIRVICIVVSKLKANLMCKTDIKCRLAKSTLTLIPLLGTHEVIFAFVMDEHARGTLRFIKLFTELSFTSFQGLMVAILYCFVNNEVQMEFRKCWERWRLEHLNIQRDCSMKPLKCPTSSVSSGATVAAACMQPPARVPTAEPAVPVLPVGPSFWLGGHPRWERSWG

SEQ ID NO: 460 - protein, 328 aa, Homo sapiens
MANSASPEQNQNHCSAINNSIPLMQGNLPTLTLSGKIRVTVTFFLFLLSATFNASFLLKLQKWTQKKEKGKKLSRMKLLLKHLTLANLLETLIVMPLDGMWNITVQWYAGELLCKVLSYLKLFSMYAPAFMMVVISLDRSLAITRPLALKSNSKVGQSMVGLAWILSSVFAGPQLYIFRMIHLADSSGQTKVFSQCVTHCSFSQWWHQAFYNFFTFSCLFIIPLFIMLICNAKIIFTLTRVLHQDPHELQLNQSKNNIPRARLKTLKMTVAFATSFTVCWTPYYVLGIWYWFDPEMLNRLSDPVNHFFFLFAFLNPCFDPLIYGYFSL

SEQ ID NO: 461 - protein, 327 aa, Mus musculus
MANNASLEQDPNHCSAINNSIPLIQGKLPTLTVSGKIRVTVTFFLFLLSTAFNASFLLKLQKWTQKRKKGKKLSRMKVLLKHLTLANLLETLIVMPLDGMWNITVQWYAGEFLCKVLSYLKLFSMYAPAFMMVVISLDRSLAITQPLAVQSNSKLEQSMISLAWILSIVFAGPQLYIFRMIYLADGSGPTVFSQCVTHCSFPQWWHQAFYNFFTFGCLFIIPLLIMLICNAKIIFALTRVLHQDPRKLQLNQSKNNIPRARLRTLKMTVAFATSFVVCWTPYYVLGIWYWFDPEMLNRVSEPVNHFFFLFAFLNPCFDPLIYGYFSL

SEQ ID NO: 462 - protein, 338 aa, Homo sapiens
MTALSSENCSFQYQLRQTNQPLDVNYLLFLIILGKILLNILTLGMRRKNTCQNFMEYFCISLAFVDLLLLVNISIILYFRDFVLLSIRFTKYHICLFTQIISFTYGFLHYPVFLTACIDYCLNFSKTTKLSFKCQKLFYFFTVILIWISVLAYVLGDPAIYQSLKAQNAYSRHCPFYVSIQSYWLSFFMVMILFVAFITCWEEVTTLVQAIRITSYMNETILYFPFSSHSSYTVRSKKIFLSKLIVCFLSTWLPFVLLQVIIVLLKVQIPAYIEMNIPWLYFVNSFLIATVYWFNCHKLNLKDIGLPLDPFVNWKCCFIPLTIPNLEQIEKPISIMIC

SEQ ID NO: 463 - protein, 336 aa, Mus musculus
MTALSSKNCSLQYQLHQSPQLLEASCLLFLIILGKVLLNILLLRVRRGDARWTLMEYFCFSLALVDLLLLVNISILTYFRDFVVLGIRFTRYHICLLTQIISFTYGFLHYPVCSLACIDYWCNLSRASKQSSRWQKLLYFLTVILTWISVLAYVLVDPAISVSLKAHRGYVYQCPAYVSTQSHWLSLSMLMVLFVAFLISWQEVVALLQAMRIASYKSKAALYFPFPLHCGYALSCREALLPRLIVCFLGTWFPFVALQVLILSLRVQIPAYIEMNVPWLYFVNSFLIAAVYWFNCHKLDLRDSSLPVDPFINWKCCFVPVHRLKQVERPMSIVIC

SEQ ID NO: 464 - protein, 355 aa, Homo sapiens
MEDLEETLFEEFENYSYDLDYYSLESDLEEKVQLGVVHWVSLVLYCLAFVLGIPGNAIVIWFTGLKWKKTVTTLWFLNLAIADFIFLLFLPLYISYVAMNFHWPFGIWLCKANSFTAQLNMFASVFFLTVISLDHYIHLIHPVLSHRHRTLKNSLIVIIFIWLLASLIGGPALYFRDTVEFNNHTLCYNNFQKHDPDLTLIRHHVLTWVKFIIGYLFPLLTMSICYLCLIFKVKKRTVLISSRHFWTILVVVVAFVVCWTPYHLFSIWELTIHHNSYSHHVMQAGIPLSTGLAFLNSCLNPILYVLISKKFQARFRSSVAEILKYTLWEVSCSGTVSEQLRNSETKNLCLLETAQ

SEQ ID NO: 465 - protein, 353 aa, Mus musculus
MEVSKEMLFEELDNYSYALDYYSQESDPEEKVYLGLVHWISLFLYALAFVLGIPGNAIVIWLMGFKWKKTVTTLWFLNLAIADFIFVLFLPLYISYVALSFHWPFGLWLCKVNSFIAQLNMFSSVFFLTVISLDRYIHLLHPGLSHRHRTLKSSLVVVILVWLLASLLGGPTLYFRDTMEVNNHIICYNNFQEHELTLMRHHVLTWVKFLFGYLFPLLTMSSCYLCLIFKMKKRNILISRKHLWMILSVVIAFLVCWTPYHLFSIWELSIHHNSSFQNVLQGGIPLSTGLAFLNSCLNPILYVLISKTFQARFRASVAEVLKRSLWEASCSGTVSEQLRSAETKSLSLLETAQ

SEQ ID NO: 466 - protein, 370 aa, Homo sapiens
MASSTTRGPRVSDLFSGLPPAVTTPANQSAEASAGNGSVAGADAPAVTPFQSLQLVHQLKGLIVLLYSVVVVVGLVGNCLLVLVIARVRRLHNVTNFLIGNLALSDVLMCTACVPLTLAYAFEPRGWVFGGGLCHLVFFLQPVTVYVSVFTLTTIAVDRYVVLVHPLRRRISLRLSAYAVLAIWALSAVLALPAAVHTYHVELKPHDVRLCEEFWGSQERQRQLYAWGLLLVTYLLPLLVILLSYVRVSVKLRNRVVPGCVTQSQADWDRARRRRTFCLLVVVVVVFAVCWLPLHVFNLLRDLDPHAIDPYAFGLVQLLCHWLAMSSACYNPFIYAWLHDSFREELRKLLVAWPRKIAPHGQNMTVSVVI

SEQ ID NO: 467 - protein, 370 aa, Mus musculus
MTSLSTETTGDPDLSSGLLPASSTPANQSAEASEGNLSATVPRAAAVTPFQSLQLVHQLKGLIVMLYSIVVVVGLVGNCLLVLVIARVRRLHNVTNFLIGNLALSDVLMCAACVPLTLAYAFEPRGWVFGGGLCHLVFFLQPVTVYVSVFTLTTIALDRYVVLVHPLRRRISLRLSAYAVLGIWALSAVLALPAAVHTYHVELKPHDVSLCEEFWGSQERQRQIYAWGLLLGTYLLPLLAILLSYVRVSVKLRNRVVPGSVTQSQADWDRARRRRTFCLLVVVVVVFAVCWLPLHIFNLLRDLDPRAIDPYAFGLVQLLCHWLAMSSACYNPFIYAWLHDSFREELRKMLLSWPRKIVPHGQNMTVSVVI

SEQ ID NO: 468 - protein, 342 aa, Homo sapiens
MTSNFSQPVVQLCYEDVNGSCIETPYSPGSRVILYTAFSFGSLLAVFGNLLVMTSVLHFKQLHSPTNFLIASLACADFLVGVTVMLFSMVRTVESCWYFGAKFCTLHSCCDVAFCYSSVLHLCFICIDRYIVVTDPLVYATKFTVSVSGICISVSWILPLTYSGAVFYTGVNDDGLEELVSALNCVGGCQIIVSQGWVLIDFLLFFIPTLVMIILYSKIFLIAKQQAIKIETTSSKVESSSESYKIRVAKRERKAAKTLGVTVLAFVISWLPYTVDILIDAFMGFLTPAYIYEICCWSAYYNSAMNPLIYALFYPWFRKAIKLILSGDVLKASSSTISLFLE

SEQ ID NO: 469 - skipped

SEQ ID NO: 470 - protein, 338 aa, Homo sapiens
MINSTSTQPPDESCSQNLLITQQIIPVLYCMVFIAGILLNGVSGWIFFYVPSSKSFIIYLKNIVIADFVMSLTFPFKILGDSGLGPWQLNVFVCRVSAVLFYVNMYVSIVFFGLISFDRYYKIVKPLWTSFIQSVSYSKLLSVIVWMLMLLLAVPNIILTNQSVREVTQIKCIELKSELGRKWHKASNYIFVAIFWIVFLLLIVFYTAITKKIFKSHLKSSRNSTSVKKKSSRNIFSIVFVFFVCFVPYHIARIPYTKSQTEAHYSCQSKEILRYMKEFTLLLSAANVCLDPIIYFFLCQPFREILCKKLHIPLKAQNDLDISRIKRGNTTLESTDTL

SEQ ID NO: 471 - protein, 338 aa, Mus musculus
MNNSTTTDPPNQPCSWNTLITKQIIPVLYGMVFITGLLLNGISGWIFFYVPSSKSFIIYLKNIVVADFLMGLTFPFKVLGDSGLGPWQVNVFVCRVSAVIFYVNMYVSIVFFGLISFDRYYKIVKPLLTSIVQSVNYSKLLSVLVWMLMLLLAVPNIILTNQGVKEVTKIQCMELKNELGRKWHKASNYIFVSIFWVVFLLLIVFYTAITRKIFKSHLKSRKNSTSVKRKSSRNIFSIVLVFVVCFVPYHIARIPYTKSQTEGHYSCRTKETLLYAKEFTLLLSAANVCLDPIIYFFLCQPFREVLNKKLHMSLKVQNDLEVSKTKRENAIHESTDTL

SEQ ID NO: 472 - protein, 334 aa, Homo sapiens
MNEDLKVNLSGLPRDYLDAAAAENISAAVSSRVPAVEPEPELVVNPWDIVLCTSGTLISCENAIVVLIIFHNPSLRAPMFLLIGSLALADLLAGIGLITNFVFAYLLQSEATKLVTIGLIVASFSASVCSLLAITVDRYLSLYYALTYHSERTVTFTYVMLVMLWGTSICLGLLPVMGWNCLRDESTCSVVRPLTKNNAAILSVSFLFMFALMLQLYIQICKIVMRHAHQIALQHHFLATSHYVTTRKGVSTLAIILGTFAACWMPFTLYSLIADYTYPSIYTYATLLPATYNSIINPVIYAFRNQEIQKALCLICCGCIPSSLAQRARSPSDV

SEQ ID NO: 473 - protein, 334 aa, Mus musculus
MNEDPKVNLSGLPRDCIDAGAPENISAAVPSQGSVAESEPELVVNPWDIVLCSSGTLICCENAVVVLIIFHSPSLRAPMFLLIGSLALADLLAGLGLIINFVFAYLLQSEATKLVTIGLIVASFSASVCSLLAITVDRYLSLYYALTYHSERTVTFTYVMLVMLWGTSICLGLLPVMGWNCLRDESTCSVVRPLTKNNAAILSISFLFMFALMLQLYIQICKIVMRHAHQIALQHHFLATSHYVTTRKGVSTLALILGTFAACWMPFTLYSLIADYTYPSIYTYATLLPATYNSIINPVIYAFRNQEIQKALCLICCGCIPSSLSQRARSPSDV

SEQ ID NO: 474 - protein, 389 aa, Homo sapiens
MALTPESPSSFPGLAATGSSVPEPPGGPNATLNSSWASPTEPSSLEDLVATGTIGTLLSAMGVVGVVGNAYTLVVTCRSLRAVASMYVYVVNLALADLLYLLSIPFIVATYVTKEWHFGDVGCRVLFGLDFLTMHASIFTLTVMSSERYAAVLRPLDTVQRPKGYRKLLALGTWLLALLLTLPVMLAMRLVRRGPKSLCLPAWGPRAHRAYLTLLFATSIAGPGLLIGLLYARLARAYRRSQRASFKRARRPGARALRLVLGIVLLFWACFLPFWLWQLLAQYHQAPLAPRTARIVNYLTTCLTYGNSCANPFLYTLLTRNYRDHLRGRVRGPGSGGGRGPVPSLQPRARFQRCSGRSLSSCSPQPTDSLVLAPAAPARPAPEGPRAPA

SEQ ID NO: 475 - protein, 385 aa, Mus musculus
MALSLESTSFPMLAVSRSTASELPGGFNVSHNSSWTGPTDPSSLQDLVATGVIGAVLSTMGVVGVVGNVYTLVVMCRFLRASASMYVYVVNLALADLLYLLSIPFIVATYVTKDWHFGDVGCRVLFSLDFLTMHASIFTLTIMSSERYAAVLRPLDTVQRSKGYRKLLALGTWLLALLLTLPMMLAIRLVRRGSKSLCLPAWGPRAHRTYLTLLFGTSIVGPGLVIGLLYIRLARAYWLSQQASFKQTRRLPNPRVLYLILGIVLLFWACFLPFWLWQLLAQYHQAMPLTPETARIINYLTACLTYGNSCINPFLYTLLTKNYREYLRGRQRSLGSSCRGPGSAGSFLSSRVHLQQDSGRSLSSNSQQATETLVLSPVPPNGAFV

SEQ ID NO: 476 - protein, 360 aa, Homo sapiens
MDPEETSVYLDYYYATSPNSDIRETHSHVPYTSVFLPVFYTAVFLTGVLGNLVLMGALHFKPGSRRLIDIFIINLAASDFIFLVTLPLWVDKEASLGLWRTGSFLCKGSSYMISVNMHCSVLLLTCMSVDRYLAIVWPVVSRKFRRTDCAYVVCASIWFISCLLGLPTLLSRELTLIDDKPYCAEKKATPIKLIWSLVALIFTFFVPLLSIVTCYCCIARKLCAHYQQSGKHNKKLKKSIKIIFIVVAAFLVSWLPFNTFKFLAIVSGLRQEHYLPSAILQLGMEVSGPLAFANSCVNPFIYYIFDSYIRRAIVHCLCPCLKNYDFGSSTETSDSHLTKALSTFIHAEDFARRRKRSVSL

SEQ ID NO: 477 - protein, 360 aa, Mus musculus
MEPATALLIVDYYDYTSPDPPFLETPSHLSYTSVFLPIFYTVVFLTGVVGNFILMIALHFKRGNRRLIDIFIINLAASDFIFLVTVPLWMDKEASLGLWRTGSFLCKGSSYVISVNMHCSVFLLTCMSMDRYLAIMHPALAKRLRRRSSAYAVCAVVWIISCVLGLPTLLSRELTHIEGKPYCAEKKPTSLKLMWGLVALITTFFVPLLSIVTCYCCITRRLCAHYQQSGKHNKKLKKSIKIVIIAVAAFTVSWVPFNTFKLLAIVSGFQPEGLFHSEALQLAMNVTGPLAFASSCVNPLIYYVFDSYIRRAIVRCLCPCLKTHNFGSSTETSDSHLTKALSNFIHAEDFIRRRKRSVSL

SEQ ID NO: 478 - protein, 331 aa, Homo sapiens
MITLNNQDQPVPFNSSHPDEYKIAALVFYSCIFIIGLFVNITALWVFSCTTKKRTTVTIYMMNVALVDLIFIMTLPFRMFYYAKDEWPFGEYFCQILGALTVFYPSIALWLLAFISADRYMAIVQPKYAKELKNTCKAVLACVGVWIMTLTTTTPLLLLYKDPDKDSTPATCLKISDIIYLKAVNVLNLTRLTFFFLIPLFIMIGCYLVIIHNLLHGRTSKLKPKVKEKSIRIIITLLVQVLVCFMPFHICFAFLMLGTGENSYNPWGAFTTFLMNLSTCLDVILYYIVSKQFQARVISVMLYRNYLRSMRRKSFRSGSLRSLSNINSEML

SEQ ID NO: 479 - protein, 331 aa, Mus musculus
MATLSNHNQLDLSNGSHPEEYKIAALVFYSCIFLIGLFVNVTALWVFSCTTKKRTTVTIYMMNVALLDLVFILSLPFRMFYYAKGEWPFGEYFCHILGALVVFYPSLALWLLAFISADRYMAIVQPKYAKELKNTGKAVLACGGVWVMTLTTTVPLLLLYEDPDKASSPATCLKISDITHLKAVNVLNFTRLIFFFLIPLFIMIGCYVVIIHSLLRGQTSKLKPKVKEKSIRIIMTLLLQVLVCFVPFHICFAVLMLQGQENSYSPWGAFTTFLMNLSTCLDVVLYYIVSKQFQARVISVMLYRNYLRSVRRKSVRSGSLRSLSNMNSEML

SEQ ID NO: 480 - protein, 415 aa, Homo sapiens
MVFAHRMDNSKPHLIIPTLLVPLQNRSCTETATPLPSQYLMELSEEHSWMSNQTDLHYVLKPGEVATASIFFGILWLFSIFGNSLVCLVIHRSRRTQSTTNYFVVSMACADLLISVASTPFVLLQFTTGRWTLGSATCKVVRYFQYLTPGVQIYVLLSICIDRFYTIVYPLSFKVSREKAKKMIAASWIFDAGFVTPVLFFYGSNWDSHCNYFLPSSWEGTAYTVIHFLVGFVIPSVLIILFYQKVIKYIWRIGTDGRTVRRTMNIVPRTKVKTIKMFLILNLLFLLSWLPFHVAQLWHPHEQDYKKSSLVFTAITWISFSSSASKPTLYSIYNANFRRGMKETFCMSSMKCYRSNAYTITTSSRMAKKNYVGISEIPSMAKTITKDSIYDSFDREAKEKKLAWPINSNPPNTFV

SEQ ID NO: 481 - protein, 409 aa, Mus musculus
MDNDQPPVVTATLLVPLQNGSCAEAAEALLPHGLMGLHEEHSWMSNRTELQYELNPGEVATASIFFGALWLFSIFGNSLVCLVIHRSRRTQSTTNYFVVSMACADLLISVASTPFVVLQFTTGRWTLGSAMCKVVRYFQYLTPGVQIYVLLSICIDRFYTIVYPLSFKVSREKAKKMIAASWILDAAFVTPVFFFYGSNWDSHCNYFLPPSWEGTAYTVIHFLVGFVIPSILIILFYQKVIKYIWRIGTDGRTLRRTMNIVPRTKVKTVKMFLLLNLVFLFSWLPFHVAQLWHPHEQDYKKSSLVFTAVTWVSFSSSASKPTLYSIYNANFRRGMKETFCMSSMKCYRSNAYTITTSSRMAKRNYVGISEIPPVSRTITKDSIYDSFDREAREKKLAWPINSNPPNTFV

SEQ ID NO: 482 - protein, 362 aa, Homo sapiens
MGTEATEQVSWGHYSGDEEDAYSAEPLPELCYKADVQAFSRAFQPSVSLTVAALGLAGNGLVLATHLAARRAARSPTSAHLLQLALADLLLALTLPFAAAGALQGWSLGSATCRTISGLYSASFHAGFLFLACISADRYVAIARALPAGPRPSTPGRAHLVSVIVWLLSLLLALPALLFSQDGQREGQRRCRLIFPEGLTQTVKGASAVAQVALGFALPLGVMVACYALLGRTLLAARGPERRRALRVVVALVAAFVVLQLPYSLALLLDTADLLAARERSCPASKRKDVALLVTSGLALARCGLNPVLYAFLGLRFRQDLRRLLRGGSSPSGPQPRRGCPRRPRLSSCSAPTETHSLSWDN

SEQ ID NO: 483 - protein, 362 aa, Mus musculus
MGTKPTEQVSWGLYSGYDEEAYSVGPLPELCYKADVQAFSRAFQPSVSLMVAVLGLAGNGLVLATHLAARRTTRSPTSVHLLQLALADLLLALTLPFAAAGALQGWNLGSTTCRAISGLYSASFHAGFLFLACINADRYVAIARALPAGQRPSTPSRAHLVSVFVWLLSLFLALPALLFSRDGPREGQRRCRLIFPESLTQTVKGASAVAQVVLGFALPLGVMAACYALLGRTLLAARGPERRRALRVVVALVVAFVVLQLPYSLALLLDTADLLAARERSCSSSKRKDLALLVTGGLTLVRCSLNPVLYAFLGLRFRRDLRRLLQGGGCSPKPNPRGRCPRRLRLSSCSAPTETHSLSWDN

SEQ ID NO: 484 - protein, 433 aa, Homo sapiens
MCFSPILEINMQSESNITVRDDIDDINTNMYQPLSYPLSFQVSLTGFLMLEIVLGLGSNLTVLVLYCMKSNLINSVSNIITMNLHVLDVIICVGCIPLTIVILLLSLESNTALICCFHEACVSFASVSTAINVFAITLDRYDISVKPANRILTMGRAVMLMISIWIFSFFSFLIPFIEVNFFSLQSGNTWENKTLLCVSTNEYYTELGMYYHLLVQIPIFFFTVVVMLITYTKILQALNIRIGTRFSTGQKKKARKKKTISLTTQHEATDMSQSSGGRNVVFGVRTSVSVIIALRRAVKRHRERRERQKRVFRMSLLIISTFLLCWTPISVLNTTILCLGPSDLLVKLRLCFLVMAYGTTIFHPLLYAFTRQKFQKVLKSKMKKRVVSIVEADPLPNNAVIHNSWIDPKRNKKITFEDSEIREKRLVPQVVTD

SEQ ID NO: 485 - protein, 432 aa, Mus musculus
MCFSPVLEINMQSESNVTVRDDIDDIDTNMYQPLSYPLSFQVSLTGFLMLEIVLGLGSNLTVLVLYCMKSNLINSVSNIITMNLHVLDVIICVGCIPLTIVILLLSLESNTALICCFHEACVSFASVSTAINVFAITLDRYDISVKPANRILTMGRAVMLMTSIWIFSFFSFLIPFIEVNFFSLQSGNTWANKTLLCVSTSEYYTELGMYYHLLVQIPIFFFTVIVMLITYTKILQALNIRIGTRFSTGQKKKARKKKTISLATHETTDMSQSSGGRNVVFGVRTSVSVIIALRRAVKRHRERRERQKRVFKMSLLIISTFLLCWTPISVLNTTILCLGPSDLLVKLRLCFLVMAYGTTIFHPLLYAFTRQKFQKVLKSKMKKRVVSIVEADPMPNNAVIHNSWIDPKRNKKVTYEDSEIREKCLVPQVVTD

SEQ ID NO: 486 - protein, 402 aa, Homo sapiens
MLCPSKTDGSGHSGRIHQETHGEGKRDKISNSEGRENGGRGFQMNGGSLEAEHASRMSVLRAKPMSNSQRLLLLSPGSPPRTGSISYINIIMPSVFGTICLLGIIGNSTVIFAVVKKSKLHWCNNVPDIFIINLSVVDLLFLLGMPFMIHQLMGNGVWHFGETMCTLITAMDANSQFTSTYILTAMAIDRYLATVHPISSTKFRKPSVATLVICLLWALSFISITPVWLYARLIPFPGGAVGCGIRLPNPDTDLYWFTLYQFFLAFALPFVVITAAYVRILQRMTSSVAPASQRSIRLRTKRVTRTAIAICLVFFVCWAPYYVLQLTQLSISRPTLTFVYLYNAAISLGYANSCLNPFVYIVLCETFRKRLVLSVKPAAQGQLRAVSNAQTADEERTESKGT

SEQ ID NO: 487 - protein, 353 aa, Mus musculus
MDLQASLLSTGPNASNISDGQDNFTLAGPPPRTRSVSYINIIMPSVFGTICLLGIVGNSTVIFAVVKKSKLHWCSNVPDIFIINLSVVDLLFLLGMPFMIHQLMGNGVWHFGETMCTLITAMDANSQFTSTYILTAMAIDRYLATVHPISSTKFRKPSMATLVICLLWALSFISITPVWLYARLIPFPGGAVGCGIRLPNPDTDLYWFTLYQFFLAFALPFVVITAAYVKILQRMTSSVAPASQRSIRLRTKRVTRTAIAICLVFFVCWAPYYVLQLTQLSISRPTLTFVYLYNAAISLGYANSCLNPFVYIVLCETFRKRLVLSVKPAAQGQLRTVSNAQTADEERTESKGT

SEQ ID NO: 488 - protein, 375 aa, Homo sapiens
MANASEPGGSGGGEAAALGLKLATLSLLLCVSLAGNVLFALLIVRERSLHRAPYYLLLDLCLADGLRALACLPAVMLAARRAAAAAGAPPGALGCKLLAFLAALFCFHAAFLLLGVGVTRYLAIAHHRFYAERLAGWPCAAMLVCAAWALALAAAFPPVLDGGGDDEDAPCALEQRPDGAPGALGFLLLLAVVVGATHLVYLRLLFFIHDRRKMRPARLVPAVSHDWTFHGPGATGQAAANWTAGFGRGPTPPALVGIRPAGPGRGARRLLVLEEFKTEKRLCKMFYAVTLLFLLLWGPYVVASYLRVLVRPGAVPQAYLTASVWLTFAQAGINPVVCFLFNRELRDCFRAQFPCCQSPRTTQATHPCDLKGIGL

SEQ ID NO: 489 - protein, 379 aa, Mus musculus
MANASEPGGGGSGGGAEAAALGLRLATLSLLLCVSLAGNVLFALLIVRERSLHRAPYYLLLDLCLADGLRALACLPAVMLAARRAAAAAGTPPGALGCKLLAFLAALFCFHAAFLLLGVGVTRYLAIAHHRFYAERLAGWPCAAMLVCAAWALALAAAFPPVLDGGGADDEDAPCALEQRPDGAPGALGFLLLLAAVVGATHLVYLRLLFFIHDRRKMRPARLVPAVSHDWTFHGPGATGQAAANWTAGFGRGPTPPALVGIRPAGPGRGARRLLVLEEFKTEKRLCKMFYAITLLFLLLWGPYVVASYLRVLVRPGAVPQAYLTASVWLTFAQAGINPVVCFLFNRELRDCFRAQFPCCQSPQATQATLPCDLKGIGL

SEQ ID NO: 490 - protein, 330 aa, Homo sapiens
MMWGAGSPLAWLSAGSGNVNVSSVGPAEGPTGPAAPLPSPKAWDVVLCISGTLVSCENALVVAIIVGTPAFRAPMFLLVGSLAVADLLAGLGLVLHFAAVFCIGSAEMSLVLVGVLAMAFTASIGSLLAITVDRYLSLYNALTYYSETTVTRTYVMLALVWGGALGLGLLPVLAWNCLDGLTTCGVVYPLSKNHLVVLAIAFFMVFGIMLQLYAQICRIVCRHAQQIALQRHLLPASHYVATRKGIATLAVVLGAFAACWLPFTVYCLLGDAHSPPLYTYLTLLPATYNSMINPIIYAFRNQDVQKVLWAVCCCCSSSKIPFRSRSPSDV

SEQ ID NO: 491 - protein, 330 aa, Mus musculus
MMWGAGSSMAWFSAGSGSVNVSSVDPVEEPTGPATLLPSPRAWDVVLCISGTLVSCENALVVAIIVGTPAFRAPMFLLVGSLAVADLLAGLGLVLHFAADFCIGSPEMSLMLVGVLAMAFTASIGSLLAITVDRYLSLYNALTYYSETTVTRTYVMLALVWVGALGLGLVPVLAWNCRDGLTTCGVVYPLSKNHLVVLAIAFFMVFGIMLQLYAQICRIVCRHAQQIALQRHLLPASHYVATRKGIATLAVVLGAFAACWLPFTVYCLLGDADSPRLYTYLTLLPATYNSMINPVIYAFRNQDVQKVLWAICCCCSTSKIPFRSRSPSDV

SEQ ID NO: 492 - protein, 375 aa, Homo sapiens
MDVTSQARGVGLEMYPGTAQPAAPNTTSPELNLSHPLLGTALANGTGELSEHQQYVIGLFLSCLYTIFLFPIGFVGNILILVVNISFREKMTIPDLYFINLAVADLILVADSLIEVFNLHERYYDIAVLCTFMSLFLQVNMYSSVFFLTWMSFDRYIALARAMRCSLFRTKHHARLSCGLIWMASVSATLVPFTAVHLQHTDEACFCFADVREVQWLEVTLGFIVPFAIIGLCYSLIVRVLVRAHRHRGLRPRRQKALRMILAVVLVFFVCWLPENVFISVHLLQRTQPGAAPCKQSFRHAHPLTGHIVNLAAFSNSCLNPLIYSFLGETFRDKLRLYIEQKTNLPALNRFCHAALKAVIPDSTEQSDVRFSSAV

SEQ ID NO: 493 - protein, 375 aa, Mus musculus
MDATTPAQTVGVEIYLGPVWPAPSNSTPLALNLSLALREDAPGNLTGDLSEHQQYVIALFLSCLYTIFLFPIGFVGNILILVVNISFREKMTIPDLYFINLAAADLILVADSLIEVFNLDEQYYDIAVLCTFMSLFLQINMYSSVFFLTWMSFDRYLALAKAMRCGLFRTKHHARLSCGLIWMASVSATLVPFTAVHLRHTEEACFCFADVREVQWLEVTLGFIMPFAIIGLCYSLIVRALIRAHRHRGLRPRRQKALRMIFAVVLVFFICWLPENVFISVHLLQWTQPGDTPCKQSFRHAYPLTGHIVNLAAFSNSCLNPLIYSFLGETFRDKLRLYVEQKTSLPALNRFCHATLKAVIPDSTEQSEIRFSSAV

SEQ ID NO: 494 - protein, 381 aa, Homo sapiens
MRSHTITMTTTSVSSWPYSSHRMRFITNHSDQPPQNFSATPNVTTCPMDEKLLSTVLTTSYSVIFIVGLVGNIIALYVFLGIHRKRNSIQIYLLNVAIADLLLIFCLPFRIMYHINQNKWTLGVILCKVVGTLFYMNMYISIILLGFISLDRYIKINRSIQQRKAITTKQSIYVCCIVWMLALGGFLTMIILTLKKGGHNSTMCFHYRDKHNAKGEAIFNFILVVMFWLIFLLIILSYIKIGKNLLRISKRRSKFPNSGKYATTARNSFIVLIIFTICFVPYHAFRFIYISSQLNVSSCYWKEIVHKTNEIMLVLSSFNSCLDPVMYFLMSSNIRKIMCQLLFRRFQGEPSRSESTSEFKPGYSLHDTSVAVKIQSSSKST

SEQ ID NO: 495 - protein, 375 aa, Mus musculus
MTTTSVDSWLCSSHGMHFITNYSDQASQNFSGVPNVTSCPMDEKLLSTVLTTFYSVIFLVGLVGNIIALYVFLGIHRKRNSIQIYLLNVAVADLLLIFCLPFRIMYHINQNKWTLGVILCKVVGTLFYMNMYISIILLGFISLDRYIKINRSIQQRRAITTKQSIYVCCIVWTVALAGFLTMIILTLKKGGHNSTMCFHYRDRHNAKGEAIFNFVLVVMFWLIFLLIILSYIKIGKNLLRISKRRSKFPNSGKYATTARNSFIVLIIFTICFVPYHAFRFIYISSQLNVSSCYWKEIIHKTNEIMLVFSSFNSCLDPVMYFLMSSNIRKIMCQLLFRRFQSEASRSESTSEFKPGHSLHDLSVTVKMPQYSTKGN

SEQ ID NO: 496 - protein, 309 aa, Homo sapiens
MNGTYNTCGSSDLTWPPAIKLGFYAYLGVLLVLGLLLNSLALWVFCCRMQQWTETRIYMTNLAVADLCLLCTLPFVLHSLRDTSDTPLCQLSQGIYLTNRYMSISLVTAIAVDRYVAVRHPLRARGLRSPRQAAAVCAVLWVLVIGSLVARWLLGIQEGGFCFRSTRHNFNSMRFPLLGFYLPLAVVVFCSLKVVTALAQRPPTDVGQAEATRKAARMVWANLLVFVVCFLPLHVGLTVRLAVGWNACALLETIRRALYITSKLSDANCCLDAICYYYMAKEFQEASALAVAPRAKAHKSQDSLCVTLA

SEQ ID NO: 497 - protein, 307 aa, Mus musculus
MNSTTCNSTLTWPASVNNFFIIYSALLLVLGLLLNSVALWVFCYRMHQWTETRIYMTNLAVADLCLLCSLPFVLYSLKYSSSDTPVCQLSQGIYLANRYMSISLVTAIAVDRYVAVRHPLRARELRSPRQAAAVCVALWVIVVTSLVVRWRLGMQEGGFCFSSQTRRNFSTTAFSLLGFYLPLAIVVFCSLQVVTVLSRRPAADVGQAEATQKATHMVWANLAVFVICFLPLHVVLTVQVSLNLNTCAARDTFSRALSITGKLSDTNCCLDAICYYYMAREFQEASKPATSSNTPHKSQDSQILSLT

SEQ ID NO: 498 - protein, 613 aa, Homo sapiens
MRAPGALLARMSRLLLLLLLKVSASSALGVAPASRNETCLGESCAPTVIQRRGRDAWGPGNSARDVLRARAPREEQGAAFLAGPSWDLPAAPGRDPAAGRGAEASAAGPPGPPTRPPGPWRWKGARGQEPSETLGRGNPTALQLFLQISEEEEKGPRGAGISGRSQEQSVKTVPGASDLFYWPRRAGKLQGSHHKPLSKTANGLAGHEGWTIALPGRALAQNGSLGEGIHEPGGPRRGNSTNRRVRLKNPFYPLTQESYGAYAVMCLSVVIFGTGIIGNLAVMCIVCHNYYMRSISNSLLANLAFWDFLIIFFCLPLVIFHELTKKWLLEDFSCKIVPYIEVASLGVTTFTLCALCIDRFRAATNVQMYYEMIENCSSTTAKLAVIWVGALLLALPEVVLRQLSKEDLGFSGRAPAERCIIKISPDLPDTIYVLALTYDSARLWWYFGCYFCLPTLFTITCSLVTARKIRKAEKACTRGNKRQIQLESQMNCTVVALTILYGFCIIPENICNIVTAYMATGVSQQTMDLLNIISQFLLFFKSCVTPVLLFCLCKPFSRAFMECCCCCCEECIQKSSTVTSDDNDNEYTTELELSPFSTIRREMSTFASVGTHC

SEQ ID NO: 499 - protein, 600 aa, Mus musculus
MPARGAPLSRTSRLLLLLLFKVSVSAALSFVPEPRNGTCLGESCSPLIQRRSRDARGPGNSAKDALRVHVPREKLEAEVRGATSWDLPPPRGGDTGVIEEAAAAGPLGPPTKPPSAWRWKSAQGKEPSGHLRRRDPTDPQLFFPTSEGGEMSSKRDGIPQSRQEHSVKTEPRDLFYWPRRTGQLQDSQHRPSAVHEGRTLAPPGRALPQNGSADDWVPDQGGPPRGNPTRRVRLKNPFYPLTQESYGAYAVMCLSVVIFGTGIIGNLAVMCIVCHNYYMRSISNSLLANLAFWDFLIIFFCLPLVIFHELTKKWLLEDFSCKIVPYIEVASLGVTTFTLCALCIDRFRAATNVQMYYEMIENCSSTTAKLAVIWVGALLLALPEVVLRQLSKEDLGFSGQAPAERCVIKISPDLPDTIYVLALTYDGARLWWYFGCYFCLPTLFTITCSLVTARKIRKAEKASTRGNKRQIHLESQMNCTVVALTILYGFCIIPENICNIVTAYMATGVSQQTMDLLNIISQFLLFFKSCVTPVLLFCLCRPFSRAFMECCCCCCEECIQKSSTVTSDDNDNEYTTELELSPFSTIRREMSTFASVGTHC

SEQ ID NO: 500 - protein, 300 aa, Homo sapiens
MDLPPQLSFGLYVAAFALGFPLNVLAIRGATAHARLRLTPSLVYALNLGCSDLLLTVSLPLKAVEALASGAWPLPASLCPVFAVAHFFPLYAGGGFLAALSAGRYLGAAFPLGYQAFRRPCYSWGVCAAIWALVLCHLGLVFGLEAPGGWLDHSNTSLGINTPVNGSPVCLEAWDPASAGPARFSLSLLLFFLPLAITAFCYVGCLRALARSGLTHRRKLRAAWVAGGALLTLLLCVGPYNASNVASFLYPNLGGSWRKLGLITGAWSVVLNPLVTGYLGRGPGLKTVCAARTQGGKSQK

SEQ ID NO: 501 - protein, 300 aa, Mus musculus
MDLPPQLSFALYVSAFALGFPLNLLAIRGAVSHAKLRLTPSLVYTLHLGCSDLLLAITLPLKAVEALASGAWPLPLPFCPVFALAHFAPLYAGGGFLAALSAGRYLGAAFPFGYQAIRRPRYSWGVCVAIWALVLCHLGLALGLETSGSWLDNSTSSLGINIPVNGSPVCLEAWDPDSARPARLSFSILLFFLPLVITAFCYVGCLRALVRSGLSHKRKLRAAWVAGGALLTLLLCLGPYNASNVASFINPDLGGSWRKLGLITGAWSVVLNPLVTGYLGTGPGRGTICVTRTQRGTIQK

SEQ ID NO: 502 - protein, 346 aa, Homo sapiens
MDTGPDQSYFSGNHWFVFSVYLLTFLVGLPLNLLALVVFVGKLQRRPVAVDVLLLNLTASDLLLLLFLPFRMVEAANGMHWPLPFILCPLSGFIFFTTIYLTALFLAAVSIERFLSVAHPLWYKTRPRLGQAGLVSVACWLLASAHCSVVYVIEFSGDISHSQGTNGTCYLEFRKDQLAILLPVRLEMAVVLFVVPLIITSYCYSRLVWILGRGGSHRRQRRVAGLLAATLLNFLVCFGPYNVSHVVGYICGESPAWRIYVTLLSTLNSCVDPFVYYFSSSGFQADFHELLRRLCGLWGQWQQESSMELKEQKGGEEQRADRPAERKTSEHSQGCGTGGQVACAES

SEQ ID NO: 503 - protein, 319 aa, Mus musculus
MGTSFFLGNYWLFFSVYLLVFLVGLPLNVMALVVFVGKLRRRPVAVDLLLLNLTISDLLLLLFLPFRMVEAACGMRWLLPFIFCPLSGFLFFTTIYLTSLFLTAVSIERFLSVAYPLWYKTRPRLAQAGLVSVVCWFLASAHCSVVYITEYWGNATYSQGTNGTCYLEFREDQLAILLPVRLEMAVVLFMVPLCITSYCYSRLVWILSRGASRRRRKRIMGLLAATLLIFFVCFGPYNMSHVVGYVSRESPSWRSYVLLLSTLNSCIDPLVFYFSSSKFQADFHQLLGRLLRTCVPWTQQVSLELKVKNGEEPSKECPS

SEQ ID NO: 504 - protein, 330 aa, Homo sapiens
MLPDWKSSLILMAYIIIFLTGLPANLLALRAFVGRIRQPQPAPVHILLLSLTLADLLLLLLLPFKIIEAASNFRWYLPKVVCALTSFGFYSSIYCSTWLLAGISIERYLGVAFPVQYKLSRRPLYGVIAALVAWVMSFGHCTIVIIVQYLNTTEQVRSGNEITCYENFTDNQLDVVLPVRLELCLVLFFIPMAVTIFCYWRFVWIMLSQPLVGAQRRRRAVGLAVVTLLNFLVCFGPYNVSHLVGYHQRKSPWWRSIAVVFSSLNASLDPLLFYFSSSVVRRAFGRGLQVLRNQGSSLLGRRGKDTAEGTNEDRGVGQGEGMPSSDFTTE

SEQ ID NO: 505 - protein, 330 aa, Mus musculus
MTPDWHSSLILTAYILIFLTGLPANLLALRAFMGRVRQPQPAPVHILLLNLTLADLLLLLLLPFRIVEAASNFRWYLPKIVCALTGFGFYSSIYCSTWLLAGISMERYLGVAFPVQYKLSRRPLYGVIAALVAWIMSFGHCTIVIIVQYLNSTEQVGTENQITCYENFTQEQLDVVLPVRLELCLVLFFVPMAVTIFCYWRFVWIMLTQPHVGAQRRRRAVGLAVVTLLNFLVCFGPYNMSHLVGFYLRQSPSWRVEAVVFSSLNASLDPLLFYFSSSVVRRAFGKGLLLIRNPASSMLGRGAKETVEGTKMDRGGSQAEGVQSSEFVTE

SEQ ID NO: 506 - protein, 395 aa, Homo sapiens
MSANATLKPLCPILEQMSRLQSHSNTSIRYIDHAAVLLHGLASLLGLVENGVILFVVGCRMRQTVVTTWVLHLALSDLLASASLPFFTYFLAVGHSWELGTTFCKLHSSIFFLNMFASGFLLSAISLDRCLQVVRPVWAQNHRTVAAAHKVCLVLWALAVLNTVPYFVFRDTISRLDGRIMCYYNVLLLNPGPDRDATCNSRQAALAVSKFLLAFLVPLAIIASSHAAVSLRLQHRGRRRPGRFVRLVAAVVAAFALCWGPYHVFSLLEARAHANPGLRPLVWRGLPFVTSLAFFNSVANPVLYVLTCPDMLRKLRRSLRTVLESVLVDDSELGGAGSSRRRRTSSTARSASPLALCSRPEEPRGPARLLGWLLGSCAASPQTGPLNRALSSTSS

SEQ ID NO: 507 - protein, 382 aa, Mus musculus
MANVTLKPLCPLLEEMVQLPNHSNSSLRYIDHVSVLLHGLASLLGLVENGLILFVVGCRMRQTVVTTWVLHLALSDLLAAASLPFFTYFLAVGHSWELGTTFCKLHSSVFFLNMFASGFLLSAISLDRCLQVVRPVWAQNHRTVAVAHRVCLMLWALAVLNTIPYFVFRDTIPRLDGRIMCYYNLLLWNPGPDRDTTCDYRQKALAVSKFLLAFMVPLAIIASSHVAVSLRLHHRGRQRTGRFVRLVAAIVVAFVLCWGPYHIFSLLEARAHSVTTLRQLASRGLPFVTSLAFFNSVVNPLLYVFTCPDMLYKLRRSLRAVLESVLVEDSDQSGGLRNRRRRASSTATPASTLLLADRIPQLRPTRLIGWMRRGSAEVPQRV

SEQ ID NO: 508 - protein, 372 aa, Homo sapiens
MACNSTSLEAYTYLLLNTSNASDSGSTQLPAPLRISLAIVMLLMTVVGFLGNTVVCIIVYQRPAMRSAINLLLATLAFSDIMLSLCCMPFTAVTLITVRWHFGDHFCRLSATLYWFFVLEGVAILLIISVDRFLIIVQRQDKLNPRRAKVIIAVSWVLSFCIAGPSLTGWTLVEVPARAPQCVLGYTELPADRAYVVTLVVAVFFAPFGVMLCAYMCILNTVRKNAVRVHNQSDSLDLRQLTRAGLRRLQRQQQVSVDLSFKTKAFTTILILFVGFSLCWLPHSVYSLLSVFSQRFYCGSSFYATSTCVLWFSYLKSVFNPIVYCWRIKKFREACIELLPQTFQILPKVPERIRRRIQPSTVYVCNENQSAV

SEQ ID NO: 509 - protein, 373 aa, Mus musculus
MACNSTPMGTYEHLLLNVSNTLDPGDTPLSAPLRISLAIMMLLMIVVGFLGNTVVCIIVYQRPAMRSAINLLLATLAFSDIMLSLCCMPFTAITLITVRWHFGDHFCRLSATLYWFFVLEGVAILLIISVDRFLIIVQRQDKLNPRRAKMIIAASWVLSFCISAPSFTGWTFMEVPARAPQCVLGYTEFPAERAYVVTLVVAVFFAPFGVMLCSYLCILNTVRKNAVRVHNQSDSLDLRQLTGAGLRRLRRQQQQASLDLSFKTKAFTTILILFVGFSLCWLPHSVYSLLSAFSRRFYYSASFYTTSTCVLWLSYLKSVFNPIVYCWRIKKFREACIELLPHTFQILPKVPERIQRKIQPSTIYVCNENQSAV

SEQ ID NO: 510 - protein, 907 aa, Homo sapiens
MDTSRLGVLLSLPVLLQLATGGSSPRSGVLLRGCPTHCHCEPDGRMLLRVDCSDLGLSELPSNLSVFTSYLDLSMNNISQLLPNPLPSLRFLEELRLAGNALTYIPKGAFTGLYSLKVLMLQNNQLRHVPTEALQNLRSLQSLRLDANHISYVPPSCFSGLHSLRHLWLDDNALTEIPVQAFRSLSALQAMTLALNKIHHIPDYAFGNLSSLVVLHLHNNRIHSLGKKCFDGLHSLETLDLNYNNLDEFPTAIRTLSNLKELGFHSNNIRSIPEKAFVGNPSLITIHFYDNPIQFVGRSAFQHLPELRTLTLNGASQITEFPDLTGTANLESLTLTGAQISSLPQTVCNQLPNLQVLDLSYNLLEDLPSFSVCQKLQKIDLRHNEIYEIKVDTFQQLLSLRSLNLAWNKIAIIHPNAFSTLPSLIKLDLSSNLLSSFPITGLHGLTHLKLTGNHALQSLISSENFPELKVIEMPYAYQCCAFGVCENAYKISNQWNKGDNSSMDDLHKKDAGMFQAQDERDLEDFLLDFEEDLKALHSVQCSPSPGPFKPCEHLLDGWLIRIGVWTIAVLALTCNALVTSTVFRSPLYISPIKLLIGVIAAVNMLTGVSSAVLAGVDAFTFGSFARHGAWWENGVGCHVIGFLSIFASESSVFLLTLAALERGFSVKYSAKFETKAPFSSLKVIILLCALLALTMAAVPLLGGSKYGASPLCLPLPFGEPSTMGYMVALILLNSLCFLMMTIAYTKLYCNLDKGDLENIWDCSMVKHIALLLFTNCILNCPVAFLSFSSLINLTFISPEVIKFILLVVVPLPACLNPLLYILFNPHFKEDLVSLRKQTYVWTRSKHPSLMSINSDDVEKQSCDSTQALVTFTSSSITYDLPPSSVPSPAYPVTESCHLSSVAFVPCL

SEQ ID NO: 511 - protein, 907 aa, Mus musculus
MDTSCVHMLLSLLALLQLVAAGSSPGPDAIPRGCPSHCHCELDGRMLLRVDCSDLGLSELPSNLSVFTSYLDLSMNNISQLPASLLHRLCFLEELRLAGNALTHIPKGAFTGLHSLKVLMLQNNQLRKVPEEALQNLRSLQSLRLDANHISYVPPSCFSGLHSLRHLWLDDNALTDVPVQAFRSLSALQAMTLALNKIHHIADYAFGNLSSLVVLHLHNNRIHSLGKKCFDGLHSLETLDLNYNNLDEFPTAIKTLSNLKELGFHSNNIRSIPERAFVGNPSLITIHFYDNPIQFVGVSAFQHLPELRTLTLNGASHITEFPHLTGTATLESLTLTGAKISSLPQAVCDQLPNLQVLDLSYNLLEDLPSLSGCQKLQKIDLRHNEIYEIKGSTFQQLFNLRSLNLAWNKIAIIHPNAFSTLPSLIKLDLSSNLLSSFPVTGLHGLTHLKLTGNRALQSLIPSANFPELKIIEMPSAYQCCAFGGCENVYKISNQWNKDDGNSVDDLHKKDAGLFQVQDERDLEDFLLDFEEDLNALHSVQCSPSPGPFKPCEHLFGSWLIRIGVWTTAVLTLSCNALVALTVFRTPLYISSIKLLIGVIAVVDILMGVSSAVLAAVDAFTFGRFAQHGAWWEDGIGCQIVGFLSIFASESSIFLLTLAALERGFSVKCSSKFEVKAPLFSLRAIVLLCVLLALTIATIPLLGGSKYNASPLCLPLPFGEPSTTGYMVALVLLNSLCFLIMTIAYTKLYCSLEKGELENLWDCSMVKHIALLLFANCILYCPVAFLSFSSLLNLTFISPDVIKFILLVIVPLPSCLNPLLYIVFNPHFKEDMGSLGKHTRFWMRSKHASLLSINSDDVEKRSCESTQALVSFTHASIAYDLPSTSGASPAYPMTESCHLSSVAFVPCL

SEQ ID NO: 512 - protein, 613 aa, Homo sapiens
MGPTLAVPTPYGCIGCKLPQPEYPPALIIFMFCAMVITIVVDLIGNSMVILAVTKNKKLRNSGNIFVVSLSVADMLVAIYPYPLMLHAMSIGGWDLSQLQCQMVGFITGLSVVGSIFNIVAIAINRYCYICHSLQYERIFSVRNTCIYLVITWIMTVLAVLPNMYIGTIEYDPRTYTCIFNYLNNPVFTVTIVCIHFVLPLLIVGFCYVRIWTKVLAARDPAGQNPDNQLAEVRNFLTMFVIFLLFAVCWCPINVLTVLVAVSPKEMAGKIPNWLYLAAYFIAYFNSCLNAVIYGLLNENFRREYWTIFHAMRHPIIFFPGLISDIREMQEARTLARARAHARDQAREQDRAHACPAVEETPMNVRNVPLPGDAAAGHPDRASGHPKPHSRSSSAYRKSASTHHKSVFSHSKAASGHLKPVSGHSKPASGHPKSATVYPKPASVHFKGDSVHFKGDSVHFKPDSVHFKPASSNPKPITGHHVSAGSHSKSAFSAATSHPKPIKPATSHAEPTTADYPKPATTSHPKPAAADNPELSASHCPEIPAIAHPVSDDSDLPESASSPAAGPTKPAASQLESDTIADLPDPTVVTTSTNDYHDVVVVDVEDDPDEMAV

SEQ ID NO: 513 - protein, 583 aa, Mus musculus
MGPTKAVPTPFGCIGCKLPKPDYPPALIIFMFCAMVITVVVDLIGNSMVILAVTKNKKLRNSGNIFVASLSVADMLVAIYPYPLMLYAMSVGGWDLSQLQCQMVGLVTGLSVVGSIFNITAIAINRYCYICHSLQYKRIFSLRNTCIYLVVTWVMTVLAVLPNMYIGTIEYDPRTYTCIFNYVNNPAFTVTIVCIHFVLPLIIVGYCYTKIWIKVLAARDPAGQNPDNQFAEVRNFLTMFVIFLLFAVCWCPVNVLTVLVAVIPKEMAGKIPNWLYLAAYCIAYFNSCLNAIIYGILNESFRREYWTIFHAMRHPILFISHLISDIRETWETRALTRARVRARDQVREQERARACVAVEGTPRNVRNVLLPGDASAPHSDRASVRPKPQTRSTSVYRKPASIHHKSISGHPKSASVYPKPASSVHCKPASVHFKPASVHFKGDSVYFKGDTVHYRAASKLVTSHRISAGPSTSHPTSMAGYIKSGTSHPATTTVDYLEPATTSHSVLTAVDLPEVSASHCLEMTSTGHLRADISASVLPSVPFELAATPPDTTAIPIASGDYRKVVLIDDDSDDSDCSDEMAV

SEQ ID NO: 514 - protein, 398 aa, Homo sapiens
MHTVATSGPNASWGAPANASGCPGCGANASDGPVPSPRAVDAWLVPLFFAALMLLGLVGNSLVIYVICRHKPMRTVTNFYIANLAATDVTFLLCCVPFTALLYPLPGWVLGDFMCKFVNYIQQVSVQATCATLTAMSVDRWYVTVFPLRALHRRTPRLALAVSLSIWVGSAAVSAPVLALHRLSPGPRAYCSEAFPSRALERAFALYNLLALYLLPLLATCACYAAMLRHLGRVAVRPAPADSALQGQVLAERAGAVRAKVSRLVAAVVLLFAACWGPIQLFLVLQALGPAGSWHPRSYAAYALKTWAHCMSYSNSALNPLLYAFLGSHFRQAFRRVCPCAPRRPRRPRRPGPSDPAAPHAELHRLGSHPAPARAQKPGSSGLAARGLCVLGEDNAPL

SEQ ID NO: 515 - protein, 396 aa, Mus musculus
MATEATLAPNVTWWAPSNASGCPGCGVNASDDPGSAPRPLDAWLVPLFFATLMLLGLVGNSLVIYVICRHKHMQTVTNFYIANLAATDVTFLLCCVPFTALLYPLPAWVLGDFMCKFVNYIQQVSVQATCATLTAMSVDRWYVTVFPLRALHRRTPRLALAVSLSIWVGSAAVSAPVLALHRLSPGPRTYCSEAFPSRALERAFALYNLLALYLLPLLATCACYGAMLRHLGRAAVRPAPTDGALQGQLLAQRAGAVRTKVSRLVAAVVLLFAACWGPIQLFLVLQALGPSGAWHPRSYAAYAVKIWAHCMSYSNSALNPLLYAFLGSHFRQAFCRVCPCCRQRQRRPHTSAHSDRAATHTVPHSRAAHPVRIRSPEPGNPVVRSPCAQSERTASL

SEQ ID NO: 516 - protein, 319 aa, Homo sapiens
MSQQNTSGDCLFDGVNELMKTLQFAVHIPTFVLGLLLNLLAIHGFSTFLKNRWPDYAATSIYMINLAVFDLLLVLSLPFKMVLSQVQSPFPSLCTLVECLYFVSMYGSVFTICFISMDRFLAIRYPLLVSHSGPPGRSLGSACTIWVLVWTGSIPIYSFHGKVEKYMCFHNMSDDTWSAKVFFPLEVFGFLLPMGIMGFCCSRSIHILLGRRDHTQDWVQQKACIYSIAASLAVFVVSFLPVHLGFFLQFLVRNSFIVECRAKQSISFFLQLSMCFSNVNCCLDVFCYYFVIKEFRMNIRAHRPSRVQLVLQDTTISRG

SEQ ID NO: 517 - protein, 327 aa, Mus musculus
MSQPERDNCSFDSVDKLTRTLQLAVHIPTFLLGLVLNLLAIRGFSAFLKKRKLDYIATSIYMINLAVFDLLLVLSLPFKMVLPQVESPLPSFCTLVECLYFISMYGSVFTICFISLDRFLAIQYPILASHLRSPRKTFGICCIIWMLVWIGSIPIYTFHREVERYKCFHNMSDVTWSASVFFPLEIFGFLLPMGIMGFCSYRSIHILLRRPDSTEDWVQQRDTKGWVQKRACIWTIATNLVIFVVSFLPVHLGFFLQYLVRNRFILDCRMKQGISLFLQLSLCFSNINCCLDVFCYYFVIKEFRMRIKAHRPSTIKLVNQDTMVSRG

SEQ ID NO: 518 - protein, 687 aa, Homo sapiens [sequence omitted]

SEQ ID NO: 519 - protein, 687 aa, Mus musculus
MAVQVLRQMVYFLLSLFSLVQGAHSGSPREDFRFCGQRNQTQQSTLHYDQSSEPHIFVWNTEETLTIRAPFLAAPDIPRFFPEPRGLYHFCLYWSRHTGRLHLRYGKHDYLLSSQASRLLCFQKQEQSLKQGAPLIATSVSSWQIPQNTSLPGAPSFIFSFHNAPHKVSHNASVDMCDLKKELQQLSRYLQHPQKAAKRPTAAFISQQLQSLESKLTSVSFLGDTLSFEEDRVNATVWKLPPTAGLEDLHIHSQKEEEQSEVQAYSLLLPRAVFQQTRGRRRDDAKRLLVVDFSSQALFQDKNSSQVLGEKVLGIVVQNTKVTNLSDPVVLTFQHQPQPKNVTLQCVFWVEDPASSSTGSWSSAGCETVSRDTQTSCLCNHLTYFAVLMVSSTEVEATHKHYLTLLSYVGCVISALACVFTIAAYLCSRRKSRDYTIKVHMNLLSAVFLLDVSFLLSEPVALTGSEAACRTSAMFLHFSLLACLSWMGLEGYNLYRLVVEVFGTYVPGYLLKLSIVGWGFPVFLVTLVALVDVNNYGPIILAVRRTPERVTYPSMCWIRDSLVSYVTNLGLFSLVFLFNLAMLATMVVQILRLRPHSQNWPHVLTLLGLSLVLGLPWALVFFSFASGTFQLVILYLFSIITSYQGFLIFLWYWSMRFQAQGGPSPLKNNSDSAKLPISSGSTSSSRI

SEQ ID NO: 520 - protein, 343 aa, Homo sapiens
MDLTYIPEDLSSCPKFVNKILSSHQPLFSCPGDNVFGYDWSHDYPLFGNLVIMVSISHFKQLHSPTNFLILSMATTDFLLGFVIMPYSIMRSVESCWYFGDGFCKFHTSFDMMLRLTSIFHLCSIAIDRFYAVCYPLHYTTKMTNSTIKQLLAFCWSVPALFSFGLVLSEADVSGMQSYKILVACFNFCALTFNKFWGTILFTTCFFTPGSIMVGIYGKIFIVSKQHARVISHVPENTKGAVKKHLSKKKDRKAAKTLGIVMGVFLACWLPCFLAVLIDPYLDYSTPILILDLLVWLRYFNSTCNPLIHGFFNPWFQKAFKYIVSGKIFSSHSETANLFPEAH

SEQ ID NO: 521 - protein, 343 aa, Mus musculus
MDLIYIPEDLSSCPKFGNKSCPPTNRSFRVRMIMYLFMTGAMVITIFGNLVIIISISHFKQLHSPTNFLILSMATTDFLLGFVIMPYSMVRSVESCWYFGDSFCKFHASFDMMLSLTSIFHLCSIAIDRFYAVCDPLHYTTTMTVSMIKRLLAFCWAAPALFSFGLVLSEANVSGMQSYEILVACFNFCALTFNKFWGTILFTTCFFTPGSIMVGIYGKIFIVSRRHARALSDMPANTKGAVGKNLSKKKDRKAAKTLGIVMGVFLACWLPCFLAVLIDPYLDYSTPIIVLDLLVWLGYFNSTCNPLIHGFFYPWFRKALQFIVSGKIFRSNSDTANLFPEAH

SEQ ID NO: 522 - protein, 362 aa, Homo sapiens
MNASAASLNDSQVVVVAAEGAAAAATAAGGPDTGEWGPPAAAALGAGGGANGSLELSSQLSAGPPGLLLPAVNPWDVLLCVSGTVIAGENALVVALIASTPALRTPMFVLVGSLATADLLAGCGLILHFVFQYLVPSETVSLLTVGFLVASFAASVSSLLAITVDRYLSLYNALTYYSRRTLLGVHLLLAATWTVSLGLGLLPVLGWNCLAERAACSVVRPLARSHVALLSAAFFMVFGIMLHLYVRICQVVWRHAHQIALQQHCLAPPHLAATRKGVGTLAVVLGTFGASWLPFAIYCVVGSHEDPAVYTYATLLPATYNSMINPIIYAFRNQEIQRALWLLLCGCFQSKVPFRSRSPSEV

SEQ ID NO: 523 - protein, 363 aa, Mus musculus
MNASAAALNESQVVAVAAEGAAAAATAAGAPDTGEWGPPAASAALGGGGGPNGSLELSSQLPAGPSGLLLSAVNPWDVLLCVSGTVIAGENALVVALIASTPALRTPMFVLVGSLATADLLAGCGLILHFVFQYVVPSETVSLLMVGFLVASFAASVSSLLAITVDRYLSLYNALTYYSRRTLLGVHLLLAATWTVSLGLGLLPVLGWNCLADRTSCSVVRPLTRSHVALLSTSFFVVFGIMLHLYVRICQVVWRHAHQIALQQHCLAPPHLAATRKGVGTLAVVLGTFGASWLPFAIYCVVGSQEDPAIYTYATLLPATYNSMINPIIYAFRNQEIQRALWLLFCGCFQSKVPFRSRSPSEV

SEQ ID NO: 524 - protein, 451 aa, Homo sapiens
MESSPIPQSSGNSSTLGRVPQTPGPSTASGVPEVGLRDVASESVALFFMLLLDLTAVAGNAAVMAVIAKTPALRKFVFVFHLCLVDLLAAPTLMPLAMLSSSALFDHALFGEMACRLYLFLSVCFVSLAILSVSAINVERYYYVVHPMRYEVRMTLGLVASVLVGVWVKALAMASVPVLGRVSWEEGAPSVPPGCSLQWSHSAYCQLFVVVFAVLYFLLPLLLILVVYCSMFRVARVAAMQHGPLPTWMETPRQRSESLSSRSTMVTSSGAPQTTPHRTFGGGKAAVVLLAVGGQFLLCWLPYFSFHLYVALSAQPISTGQVESVVTWIGYFCFTSNPFFYGCLNRQIRGELSKQFVCFFKPAPEEELRLPSREGSIEENFLQFLQGTGCPSESWVSRPLPSPKQEPPAVDFRIPGQIAEETSEFLEQQLTSDIIMSDSYLRPAASPRLES

SEQ ID NO: 525 - protein, 449 aa, Mus musculus
MESSPIPQSSGNSSTLGRALQTPGPSTASGVPELGLRDVASESVALFFMLLLDLTAVAGNAAVMAVIAKTPALRKFVFVFHLCLVDLLAALTLMPLAMLSSSALFDHALFGEVACRLYLFLSVCFVSLAILSVSAINVERYYYVVHPMRYEVRMTLGLVASVLVGVWVKALAMASVPVLGRVYWEEGAPSVNPGCSLQWSHSAYCQLFVVVFAVLYFLLPLILIFVVYCSMFRVARVAAMQHGPLPTWMETPRQRSESLSSRSTMVTSSGAHQTTPHRTFGGGKAAVVLLAVGGQFLLCWLPYFSFHLYVALSAQPISAGQVENVVTWIGYFCFTSNPFFYGCLNRQIRGELSKQFVCFFKAAPEEELRLPSREGSIEENFLQFLQGTSENWVSRPLPSPKREPPPVVDFRIPGQIAEETSEFLEQQLTSDIIMSDSYLRPAPSPRLES

SEQ ID NO: 526 - protein, 419 aa, Homo sapiens
MVFSAVLTAFHTGTSNTTFVVYENTYMNITLPPPFQHPDLSPLLRYSFETMAPTGLSSLTVNSTAVPTTPAAFKSLNLPLQITLSAIMIFILFVSFLGNLVVCLMVYQKAAMRSAINILLASLAFADMLLAVLNMPFALVTILTTRWIFGKFFCRVSAMFFWLFVIEGVAILLIISIDRFLIIVQRQDKLNPYRAKVLIAVSWATSFCVAFPLAVGNPDLQIPSRAPQCVFGYTTNPGYQAYVILISLISFFIPFLVILYSFMGILNTLRHNALRIHSYPEGICLSQASKLGLMSLQRPFQMSIDMGFKTRAFTTILILFAVFIVCWAPFTTYSLVATFSKHFYYQHNFFEISTWLLWLCYLKSALNPLIYYWRIKKFHDACLDMMPKSFKFLPQLPGHTKRRIRPSAVYVCGEHRTVV

SEQ ID NO: 527 - protein, 425 aa, Mus musculus
MVVSGVLTAPAVLTAPHSGTSNTTFVVFENSHVNITAPLPFQHPSAGPLLRYSLETMTSPGFSSLAVNSTAVTPAPAVFKSLNLAVQIILSAIMIFILFVSFLGNLVVCLMVYQKAAMRSAINILLASLAFADMLLAVLNMPFALVTILTTRWIFGKFFCRLSAMFFWLFVIEGVAILLIISIDRFLIIVQRQDKLNPYRAKVLIAVSWATAFSVAFPLAVGNPDLQIPSRAPQCVFGYTTNSGYQAYVILISLISFFIPFLVILYSFMGILNTLRHNALRIHSYPEGICLSQASKLGLMSLQRPFQMSIDMGFKTRAFTTILILFAVFIVCWAPFTTYSLVATFSKHFYYQHNFFEISTWLLWLCYLKSALNPLIYYWRIKKFHDACLDMMPKSFKFLPRLPGHTSRRIRPSAVYVCGEHRTVL

SEQ ID NO: 528 - protein, 337 aa, Homo sapiens
MNSTCIEEQHDLDHYLFPIVYIFVIIVSIPANIGSLCVSFLQPKKESELGIYLFSLSLSDLLYALTLPLWIDYTWNKDNWTFSPALCKGSAFLMYMKFYSSTAFLTCIAVDRYLAVVYPLKFFFLRTRRIALMVSLSIWILETIFNAVMLWEDETVVEYCDAEKSNFTLCYDKYPLEKWQINLNLFRTCTGYAIPLVTILICNRKVYQAVRHNKATENKEKKRIIKLLVSITVTFVLCFTPFHVMLLIRCILEHAVNFEDHSNSGKRTYTMYRITVALTSLNCVADPILYCFVTETGRYDMWNILKFCTGRCNTSQRQRKRILSVSTKDTMELEVLE

SEQ ID NO: 529 - protein, 337 aa, Mus musculus
MAMNSMCIEEQRHLEHYLFPVVYIIVFIVSVPANIGSLCVSFLQAKKENELGIYLFSLSLSDLLYALTLPLWINYTWNKDNWTFSPTLCKGSVFFTYMNFYSSTAFLTCIALDRYLAVVYPLKFSFLRTRRFAFITSLSIWILESFFNSMLLWKDETSVEYCDSDKSNFTLCYDKYPLEKWQINLNLFRTCMGYAIPLITIMICNHKVYRAVRHNQATENSEKRRIIKLLASITLTFVLCFTPFHVMVLIRCVLERDMNVNDKSGWQTFTVYRVTVALTSLNCVADPILYCFVTETGRADMWNILKLCTRKHNRHQGKKRDILSVSTRDAVELEIID

SEQ ID NO: 530 - protein, 403 aa, Homo sapiens
MACNGSAARGHFDPEDLNLTDEALRLKYLGPQQTELFMPICATYLLIFVVGAVGNGLTCLVILRHKAMRTPTNYYLFSLAVSDLLVLLVGLPLELYEMWHNYPFLLGVGGCYFRTLLFEMVCLASVLNVTALSVERYVAVVHPLQARSMVTRAHVRRVLGAVWGLAMLCSLPNTSLHGIRQLHVPCRGPVPDSAVCMLVRPRALYNMVVQTTALLFFCLPMAIMSVLYLLIGLRLRRERLLLMQEAKGRGSAAARSRYTCRLQQHDRGRRQVTKMLFVLVVVFGICWAPFHADRVMWSVVSQWTDGLHLAFQHVHVISGIFFYLGSAANPVLYSLMSSRFRETFQEALCLGACCHRLRPRHSSHSLSRMTTGSTLCDVGSLGSWVHPLAGNDGPEAQQETDPS

SEQ ID NO: 531 - protein, 405 aa, Mus musculus
MVCNISEFKWPYQPEDLNLTDEALRLKYLGPQQMKQFVPICVTYLLIFVVGTLGNGLTCTVILRNKTMRTPTNFYLFSLAVSDMLVLLVGLPLELYEMQQNYPFQLGASACYFRILLLETVCLASVLNVTALSVERYVAVVRPLQAKSVMTRAHVRRMVGAIWVLATLFSLPNTSLHGLSQLTVPCRGPVPDSAICSLVGPMDFYKLVVLTTALLFFCLPMVTISVLYLLIGLRLRRERMLLQVEVKGRKTAATQETSHRRIQLQDRGRRQVTKMLFALVVVFGICWAPFHADRIMWSLVYGHSTEGLHLAYQCVHIASGIFFYLGSAANPVLYSLMSTRFRETFLQALGLGTQCCHRRQPYHGSHNHIRLTTGSTLCDVGHRNSRDEPLAVNEDPGCQQETDPS

SEQ ID NO: 532 - protein, 328 aa, Homo sapiens
MDNASFSEPWPANASGPDPALSCSNASTLAPLPAPLAVAVPVVYAVICAVGLAGNSAVLYVLLRAPRMKTVTNLFILNLAIADELFTLVLPINIADFLLRQWPFGELMCKLIVAIDQYNTFSSLYFLTVMSADRYLVVLATAESRRVAGRTYSAARAVSLAVWGIVTLVVLPFAVFARLDDEQGRRQCVLVFPQPEAFWWRASRLYTLVLGFAIPVSTICVLYTTLLCRLHAMRLDSHAKALERAKKRVTFLVVAILAVCLLCWTPYHLSTVVALTTDLPQTPLVIAISYFITSLTYANSCLNPFLYAFLDASFRRNLRQLITCRAAA

SEQ ID NO: 533 - protein, 329 aa, Mus musculus
MHNLTLFESGGDNVSCGGSSLGCPNGSSLAPLPLPQPLAVAVPVVYGVICAVGLAGNSAVLYVLLRTPRMKTVTNVFILNLAIADELFTLVLPINIADFLLRRWPFGEVMCKLIVAVDQYNTFSSLYFLAVMSADRYLVVLATAESRRVSGRTYGAARAVSLAVWALVTLVVLPFAVFARLDEEQGRRQCVLVFPQPEAFWWRASRLYTLVLGFAIPVTTICALYTTLLCRLRAIQLDSHAKALDRAKKRVTLLVAAILAVCLLCWTPYHLSTIVALTTDLPQTPLVIGISYFITSLSYANSCLNPFLYAFLDDSFRRSLRQLVSCRSA

SEQ ID NO: 534 - protein, 393 aa, Homo sapiens
METTMGFMDDNATNTSTSFLSVLNPHGAHATSFPFNFSYSDYDMPLDEDEDVTNSRTFFAAKIVIGMALVGIMLVCGIGNFIFIAALVRYKKLRNLTNLLIANLAISDFLVAIVCCPFEMDYYVVRQLSWEHGHVLCTSVNYLRTVSLYVSTNALLAIAIDRYLAIVHPLRPRMKCQTATGLIALVWTVSILIAIPSAYFTTETVLVIVKSQEKIFCGQIWPVDQQLYYKSYFLFIFGIEFVGPVVTMTLCYARISRELWFKAVPGFQTEQIRKRLRCRRKTVLVLMCILTAYVLCWAPFYGFTIVRDFFPTVFVKEKHYLTAFYIVECIAMSNSMINTLCFVTVKNDTVKYFKKIMLLHWKASYNGGKSSADLDLKTIGMPATEEVDCIRLK

SEQ ID NO: 535 - protein, 393 aa, Mus musculus
METTVGALGENTTDTFTDFFSALDGHEAQTGSLPFTFSYGDYDMPLDEEEDVTNSRTFFAAKIVIGMALVGIMLVCGIGNFIFITALARYKKLRNLTNLLIANLAISDFLVAIVCCPFEMDYYVVRQLSWEHGHVLCASVNYLRTVSLYVSTNALLAIAIDRYLAIVHPLRPRMKCQTAAGLIFLVWSVSILIAIPAAYFTTETVLVIVERQEKIFCGQIWPVDQQFYYRSYFLLVFGLEFVGPVVAMTLCYARVSRELWFKAVPGFQTEQIRRTVRCRRRTVLGLVCVLSAYVLCWAPFYGFTIVRDFFPSVFVKEKHYLTAFYVVECIAMSNSMINTLCFVTVRNNTSKYLKRILRLQWRASPSGSKASADLDLRTTGIPATEEVDCIRLK

SEQ ID NO: 536 - protein, 384 aa, Homo sapiens
MAAQNGNTSFTPNFNPPQDHASSLSFNFSYGDYDLPMDEDEDMTKTRTFFAAKIVIGIALAGIMLVCGIGNFVFIAALTRYKKLRNLTNLLIANLAISDFLVAIICCPFEMDYYVVRQLSWEHGHVLCASVNYLRTVSLYVSTNALLAIAIDRYLAIVHPLKPRMNYQTASFLIALVWMVSILIAIPSAYFATETVLFIVKSQEKIFCGQIWPVDQQLYYKSYFLFIFGVEFVGPVVTMTLCYARISRELWFKAVPGFQTEQIRKRLRCRRKTVLVLMCILTAYVLCWAPFYGFTIVRDFFPTVFVKEKHYLTAFYVVECIAMSNSMINTVCFVTVKNNTMKYFKKMMLLHWRPSQRGSKSSADLDLRTNGVPTTEEVDCIRLK

SEQ ID NO: 537 - protein, 381 aa, Mus musculus
MGPQNRNTSFAPDLNPPQDHVSLNYSYGDYDLPLGEDEDVTKTQTFFAAKIVIGVALAGIMLVCGIGNFVFIAALARYKKLRNLTNLLIANLAISDFLVAIVCCPFEMDYYVVRQLSWAHGHVLCASVNYLRTVSLYVSTNALLAIAIDRYLAIVHPLKPRMNYQTASFLIALVWMVSILIAVPSAYFTTETILVIVKNQEKIFCGQIWSVDQQLYYKSYFLFVFGLEFVGPVVTMTLCYARISQELWFKAVPGFQTEQIRKRLRCRRKTVLLLMGILTAYVLCWAPFYGFTIVRDFFPTVVVKEKHYLTAFYVVECIAMSNSMINTICFVTVKNNTMKYFKKMLRLHWRPSHYGSKSSADLDLKTSGVPATEEVDCIRLK

SEQ ID NO: 538 - protein, 522 aa, Homo sapiens
MNSFFGTPAASWCLLESDVSSAPDKEAGRERRALSVQQRGGPAWSGSLEWSRQSAGDRRRLGLSRQTAKSSWSRSRDRTCCCRRAWWILVPAADRARRERFIMNEKWDTNSSENWHPIWNVNDTKHHLYSDINITYVNYYLHQPQVAAIFIISYFLIFFLCMMGNTVVCFIVMRNKHMHTVTNLFILNLAISDLLVGIFCMPITLLDNIIAGWPFGNTMCKISGLVQGISVAASVFTLVAIAVDRFQCVVYPFKPKLTIKTAFVIIMIIWVLAITIMSPSAVMLHVQEEKYYRVRLNSQNKTSPVYWCREDWPNQEMRKIYTTVLFANIYLAPLSLIVIMYGRIGISLFRAAVPHTGRKNQEQWHVVSRKKQKIIKMLLIVALLFILSWLPLWTLMMLSDYADLSPNELQIINIYIYPFAHWLAFGNSSVNPIIYGFFNENFRRGFQEAFQLQLCQKRAKPMEAYALKAKSHVLINTSNQLVQESTFQNPHGETLLYRKSAEKPQQELVMEELKETTNSSEI

SEQ ID NO: 539 - protein, 417 aa, Mus musculus
MSEKWDSNSSESWNHIWSGNDTQHHWYSDINITYVNYYLHQPQVAAVFISSYLLIFVLCMVGNTVVCFIVIRNRHMHTVTNFFILNLATSDLLVGIFCMPITLLDNIIAGWPFGSSMCKISGLVQGISVAASVFTLVAIAVDRFRCVVYPFKPKLTVKTAFVTIVIIWGLAIAIMTPSAIMLHVQEEKYYRVRLSSHNKTSTVYWCREDWPRHEMRRIYTTVLFATIYLAPLSLIVIMYARIGASLFKTAAHCTGKQRPEQWHVSKKKQKVIKMLLTVALLFILSWLPLWTLMMLSDYTDLSPNKLRIINIYIYPFAHWLAFCNSSVNPIIYGFFNENFRNGFQDAFQICQKKAKPQEAYSLRAKRNMVINTSGLLVQEPVSQNPGGENLGCGKSADNPTQESLIEEMGEATNSTVA

SEQ ID NO: 540 - protein, 540 aa, Homo sapiens
MNSTGHLQDAPNATSLHVPHSQEGNSTSLQEGLQDLIHTATLVTCTFLLAVIFCLGSYGNFIVFLSFFDPAFRKFRTNFDFMILNLSFCDLFICGVTAPMFTFVLFFSSASSIPDAFCFTFHLTSSGFIIMSLKTVAVIALHRLRMVLGKQPNRTASFPCTVLLTLLLWATSFTLATLATLKTSKSHLCLPMSSLIAGKGKAILSLYVVDFTFCVAVVSVSYIMIAQTLRKNAQVRKCPPVITVDASRPQPFMGVPVQGGGDPIQCAMPALYRNQNYNKLQHVQTRGYTKSPNQLVTPAASRLQLVSAINLSTAKDSKAVVTCVIIVLSVLVCCLPLGISLVQVVLSSNGSFILYQFELFGFTLIFFKSGLNPFIYSRNSAGLRRKVLWCLQYIGLGFFCCKQKTRLRAMGKGNLEVNRNKSSHHETNSAYMLSPKPQKKFVDQACGPSHSKESMVSPKISAGHQHCGQSSSTPINTRIEPYYSIYNSSPSQEESSPCNLQPVNSFGFANSYIAMHYHTTNDLVQEYDSTSAKQIPVPSV

SEQ ID NO: 541 - protein, 540 aa, Mus musculus
MNTSAPLQNVPNATLLNMPPLHGGNSTSLQEGLRDFIHTATLVTCTFLLAIIFCLGSYGNFIVFLSFFDPSFRKFRTNFDFMILNLSFCDLFICGVTAPMFTFVLFFSSASSIPDSFCFTFHLTSSGFVIMSLKMVAVIALHRLRMVMGKQPNCTASFSCILLLTLLLWATSFTLATLATLRTNKSHLCLPMSSLMDGEGKAILSLYVVDFTFCVAVVSVSYIMIAQTLRKNAQVKKCPPVITVDASRPQPFMGASVKGNGDPIQCTMPALYRNQNYNKLQHSQTHGYTKNINQMPIPSASRLQLVSAINFSTAKDSKAVVTCVVIVLSVLVCCLPLGISLVQMVLSDNGSFILYQFELFGFTLIFFKSGLNPFIYSRNSAGLRRKVLWCLRYTGLGFLCCKQKTRLRAMGKGNLEINRNKSSHHETNSAYMLSPKPQRKFVDQACGPSHSKESAASPKVSAGHQPCGQSSSTPINTRIEPYYSIYNSSPSQQESGPANLPPVNSFGFASSYIAMHYYTTNDLMQEYDSTSAKQIPIPSV

SEQ ID NO: 542 - protein, 337 aa, Homo sapiens [sequence omitted]

SEQ ID NO: 543 - protein, 344 aa, Mus musculus
MMNHTTSEYYDYEYDHEHYSDLPDVPVDCPAGTCFTSDVYLIVLLVLYAAVFLVGVPGNTLVAWVTWKESRHRLGASWFLHLTMADLLCCVSLPFLAVPIAQKGHWPYGAAGCWLLSSITILSMYASVLLLTGLSGDLFLLAFRPSWKGADHRTFGVRVVQASSWMLGLLLTVPSAVYRRLLQEHYPPRLVCGIDYGGSVSAEVAITTVRFLFGFLGPLVFMAGCHGILQRQMARRHWPLGTAVVVGFFICWTPYHVLRVIIAAAPPHSLLLARVLEAEPLFNGLALAHSALNPIMFLYFGRKQLCKSLQAACHWALRDPQDEESAVTKVSISTSHEMVSEMPV

SEQ ID NO: 544 - protein, 337 aa, Homo sapiens
MNEPLDYLANASDFPDYAAAFGNCTDENIPLKMHYLPVIYGIIFLVGFPGNAVVISTYIFKMRPWKSSTIIMLNLACTDLLYLTSLPFLIHYYASGENWIFGDFMCKFIRFSFHFNLYSSILFLTCFSIFRYCVIIHPMSCFSIHKTRCAVVACAVVWIISLVAVIPMTFLITSTNRTNRSACLDLTSSDELNTIKWYNLILTATTFCLPLVIVTLCYTTIIHTLTHGLQTDSCLKQKARRLTILLLLAFYVCFLPFHILRVIRIESRLLSISCSIENQIHEAYIVSRPLAALNTFGNLLLYVVVSDNFQQAVCSTVRCKVSGNLEQAKKISYSNNP

SEQ ID NO: 545 - protein, 337 aa, Mus musculus
MIEPLDSPASDSDFLDYPSALGNCTDEQISFKMQYLPVIYSIIFLVGFPGNTVAISIYIFKMRPWRGSTVIMLNLALTDLLYLTSLPFLIHYYASGENWIFGDFMCKFIRFGFHFNLYSSILFLTCFSLFRYVVIIHPMSCFSIQKTRWAVVACAGVWVISLVAVMPMTFLITSTTRTNRSACLDLTSSDDLTTIKWYNLILTATTFCLPLVIVTLCYTTIISTLTHGPRTHSCFKQKARRLTILLLLVFYICFLPFHILRVIRIESRLLSISCSIESHIHEAYIVSRPLAALNTFGNLLLYVVVSNNFQQAFCSIVRCKASGDLEQGKKDSCSNNP

SEQ ID NO: 546 - protein, 346 aa, Homo sapiens
MYNGSCCRIEGDTISQVMPPLLIVAFVLGALGNGVALCGFCFHMKTWKPSTVYLFNLAVADFLLMICLPFRTDYYLRRRHWAFGDIPCRVGLFTLAMNRAGSIVFLTVVAADRYFKVVHPHHAVNTISTRVAAGIVCTLWALVILGTVYLLLENHLCVQETAVSCESFIMESANGWHDIMFQLEFFMPLGIILFCSFKIVWSLRRRQQLARQARMKKATRFIMVVAIVFITCYLPSVSARLYFLWTVPSSACDPSVHGALHITLSFTYMNSMLDPLVYYFSSPSFPKFYNKLKICSLKPKQPGHSKTQRPEEMPISNLGRRSCISVANSFQSQSDGQWDPHIVEWH

SEQ ID NO: 547 - protein, 343 aa, Mus musculus
MDNGSCCLIEGEPISQVMPPLLILVFVLGALGNGIALCGFCFHMKTWKSSTIYLFNLAVADFLLMICLPLRTDYYLRRRHWIFGDIACRLVLFKLAMNRAGSIVFLTVVAVDRYFKVVHPHHMVNAISNRTAAATACVLWTLVILGTVYLLMESHLCVQGTLSSCESFIMESANGWHDVMFQLEFFLPLTIILFCSVNVVWSLRRRQQLTRQARMRRATRFIMVVASVFITCYLPSVLARLYFLWTVPTSACDPSVHTALHVTLSFTYLNSMLDPLVYYFSSPSLPKFYTKLTICSLKPKRPGRTKTRRSEEMPISNLCSKSSIDGANRSQRPSDGQWDLQVC

SEQ ID NO: 548 - protein, 423 aa, Homo sapiens
MVPHLLLLCLLPLVRATEPHEGRADEQSAEAALAVPNASHFFSWNNYTFSDWQNFVGRRRYGAESQNPTVKALLIVAYSFIIVFSLFGNVLVCHVIFKNQRMHSATSLFIVNLAVADIMITLLNTPFTLVRFVNSTWIFGKGMCHVSRFAQYCSLHVSALTLTAIAVDRHQVIMHPLKPRISITKGVIYIAVIWTMATFFSLPHAICQKLFTFKYSEDIVRSLCLPDFPEPADLFWKYLDLATFILLYILPLLIISVAYARVAKKLWLCNMIGDVTTEQYFALRRKKKKTIKMLMLVVVLFALCWFPLNCYVLLLSSKVIRTNNALYFAFHWFAMSSTCYNPFIYCWLNENFRIELKALLSMCQRPPKPQEDGQPSPVPSFRVAWTEKNDGQRAPLANNLLPTSQLQSGKTDLSSVEPIVTMS

SEQ ID NO: 549 - protein, 423 aa, Mus musculus
MKVPPVLLLFLLSSVRATEQPQVVTEHPSMEAALTGPNASSHFWANYTFSDWQNFVGRRRYGAESQNPTVKALLIVAYSFTIVFSLFGNVLVCHVIFKNQRMHSATSLFIVNLAVADIMITLLNTPFTLVRFVNSTWVFGKGMCHVSRFAQYCSLHVSALTLTAIAVDRHQVIMHPLKPRISITKGVIYIAVIWVMATFFSLPHAICQKLFTFKYSEDIVRSLCLPDFPEPADLFWKYLDLATFILLYLLPLFIISVAYARVAKKLWLCNTIGDVTTEQYLALRRKKKTTVKMLVLVVVLFALCWFPLNCYVLLLSSKAIHTNNALYFAFHWFAMSSTCYNPFIYCWLNENFRVELKALLSMCQRPPKPQEDRLPSPVPSFRVAWTEKSHGRRAPLPNHHLPSSQIQSGKTDLSSVEPVVAMS

SEQ ID NO: 550 - protein, 396 aa, Homo sapiens
MWNSSDANFSCYHESVLGYRYVAVSWGVVVAVTGTVGNVLTLLALAIQPKLRTRFNLLIANLTLADLLYCTLLQPFSVDTYLHLHWRTGATFCRVFGLLLFASNSVSILTLCLIALGRYLLIAHPKLFPQVFSAKGIVLALVSTWVVGVASFAPLWPIYILVPVVCTCSFDRIRGRPYTTILMGIYFVLGLSSVGIFYCLIHRQVKRAAQALDQYKLRQASIHSNHVARTDEAMPGRFQELDSRLASGGPSEGISSEPVSAATTQTLEGDSSEVGDQINSKRAKQMAEKSPPEASAKAQPIKGARRAPDSSSEFGKVTRMCFAVFLCFALSYIPFLLLNILDARVQAPRVVHMLAANLTWLNGCINPVLYAAMNRQFRQAYGSILKRGPRSFHRLH

SEQ ID NO: 551 - protein, 396 aa, Mus musculus
MWNSSDANFSCYHESVLGYRYFAIIWGVAVAVTGTVGNVLTLLALAIRPKLRTRFNLLIANLTLADLLYCTLLQPFSVDTYLHLHWRTGAVFCRIFGLLLFTSNSVSILTLCLIALGRYLLIAHPKLFPQVFSAKGIVLALVGSWVVGVTSFAPLWNVFVLVPVVCTCSFDRMRGRPYTTILMGIYFVLGLSSVGVFYCLIHRQVKRAARALDQYGLHQASIRSHQVAGTQEAMPGHFQELDSGVASRGPSEGISSEPVSAATTQTLEGDSSEAGGQGIRKAAQQIAERSLPEVHRKPRETAGARRATDAPSEFGKVTRMCFAVFLCFALSYIPFLLLNILDARGRAPRVVHMVAANLTWLNSCINPVLYAAMNRQFRHAYGSILKRGPQSFRRFH

SEQ ID NO: 552 - protein, 370 aa, Homo sapiens
MANYSHAADNILQNLSPLTAFLKLTSLGFIIGVSVVGNLLISILLVKDKTLHRAPYYFLLDLCCSDILRSAICFPFVFNSVKNGSTWTYGTLTCKVIAFLGVLSCFHTAFMLFCISVTRYLAIAHHRFYTKRLTFWTCLAVICMVWTLSVAMAFPPVLDVGTYSFIREEDQCTFQHRSFRANDSLGFMLLLALILLATQLVYLKLIFFVHDRRKMKPVQFVAAVSQNWTFHGPGASGQAAANWLAGFGRGPTPPTLLGIRQNANTTGRRRLLVLDEFKMEKRISRMFYIMTFLFLTLWGPYLVACYWRVFARGPVVPGGFLTAAVWMSFAQAGINPFVCIFSNRELRRCFSTTLLYCRKSRLPREPYCVI

SEQ ID NO: 553 - protein, 370 aa, Mus musculus; identical to SEQ ID NO: 552

SEQ ID NO: 554 - protein, 333 aa, Homo sapiens
MNTTVMQGFNRSERCPRDTRIVQLVFPALYTVVFLTGILLNTLALWVFVHIPSSSTFIIYLKNTLVADLIMTLMLPFKILSDSHLAPWQLRAFVCRFSSVIFYETMYVGIVLLGLIAFDRFLKIIRPLRNIFLKKPVFAKTVSIFIWFFLFFISLPNMILSNKEATPSSVKKCASLKGPLGLKWHQMVNNICQFIFWTVFILMLVFYVVIAKKVYDSYRKSKSKDRKNNKKLEGKVFVVVAVFFVCFAPFHFARVPYTHSQTNNKTDCRLQNQLFIAKETTLFLAATNICMDPLIYIFLCKKFTEKLPCMQGRKTTASSQENHSSQTDNITLG

SEQ ID NO: 555 - protein, 337 aa, Mus musculus
MLGTINTTGMQGFNKSERCPRDTRMTQLLFPVLYTVVFLAGILLNTVALWVFVHIPSNSTFIVYLKNTLVADLIMALMLPFKILSDSHLAPWQLRGFVCTLSSVVFYETMYVGIMMLGLIAFDRFLKIIMPFRKTFVKKTAFAKTVSISVWSLMFFISLPNMILNKEATPSSVKKCASLKSPLGLWWHQVVSHTCQLIFWAVFILMLLFYAVITKKVYNSYRKFRSKDSRHKRLEVKVFIVMAVFFVCFAPLHFVRIPYTYSQTTNKTDCRLENQLFIAKEATLFLATTNICMDPLIYIILCKKFTQKVPCVRWGKARTAGSSEDHHSSQTDNITLA

SEQ ID NO: 556 - protein, 358 aa, Homo sapiens
MGFNLTLAKLPNNELHGQESHNSGNRSDGPGKNTTLHNEFDTIVLPVLYLIIFVASILLNGLAVWIFFHIRNKTSFIFYLKNIVVADLIMTLTFPFRIVHDAGFGPWYFKFILCRYTSVLFYANMYTSIVFLGLISIDRYLKVVKPFGDSRMYSITFTKVLSVCVWVIMAVLSLPNIILTNGQPTEDNIHDCSKLKSPLGVKWHTAVTYVNSCLFVAVLVILIGCYIAISRYIHKSSRQFISQSSRKRKHNQSIRVVVAVFFTCFLPYHLCRIPFTFSHLDRLLDESAQKILYYCKEITLFLSACNVCLDPIIYFFMCRSFSRRLFKKSNIRTRSESIRSLQSVRRSEVRIYYDYTDV

SEQ ID NO: 557 - protein, 359 aa, Mus musculus
MAVPNVNVSTFAGNELYSQASHTANSTSEGHGKNSTLHNKFDTIILPVLYLVIFVASILLNGLAVWIFFHIRNKTSFIFYLKNIVVADLIMTLTFPFRIVRDAGFGPWYFEFILCRYTSVLFYANMYTSIVFLGLISVDRYLKVVKPFGDSRMYSITFTKVLSVCVWVIMAILSLPNIILTNGQPTKENIHDCMKLKSPLGAKWHMAVTYVDSCLFVAVLVILIGCYIAISRYIHKSSRQFISQSSRKRKHNQSIRVVVAVFFTCFLPYHLCRIPFTFSNLDRLLDESAHKILYYCKEMTLFLSACNVCLDPIIYFFMCKSFSRRLFKKSNIRTRSESIRSLQSVRRSEVRIYYDYTDV

SEQ ID NO: 558 - protein, 384 aa, Homo sapiens
MTNSSSTSTSSTTGGSLLLLCEEEESWAGRRIPVSLLYSGLAIGGTLANGMVIYLVSSFRKLQTTSNAFIVNGCAADLSVCALWMPQEAVLGLLPTGSAEPPADWDGAGGSYRLLRGGLLGLGLTVSLLSHCLVALNRYLLITRAPATYQALYQRRHTAGMLALSWALALGLVLLLPPWAPRPGAAPPRIHYPALLAAAALLAQTALLLHCYLGIVRRVRVSVKRVSVLNFHLLHQLPGCAAAAAAFPGAQHAPGPGGAAHPAQAQPLPPALHPRRAQRRLSGLSVLLLCCVFLLATQPLVWVSLASGFSLPVPWGVHAASWLLCCALSALNPLLYTWRNEEFRRSVRSVLPGVGDAAAAAVAATAVPAVSQAQLGTRAAGQHW

SEQ ID NO: 559 - protein, 384 aa, Mus musculus
MTNSSSTSTSTTTGGSLLLLCEEEESWAGRRIPVSLLYSGLAIGGTLANGMVIYLVSSFRKLQTTSNAFIVNGCAADLSVCALWMPQEAVLGLLPSGSAEPPGDWDGGGGSYRLLRGGLLGLGLTVSLLSHCLVALNRYLLITRAPATYQVLYQRRHTVGMLALSWALALGLVLLLPPWAPKPGAEPPQVHYPALLAAGALLAQTALLLHCYLGIVRRVRVSVKRVSVLNFHLLHQLPGCAAAAAAFPAAPHAPGPGGAAHPAQPQPLPAALQPRRAQRRLSGLSVLLLCCVFLLATQPLVWVSLASGFSLPVPWGVQAASWLLCCALSALNPLLYTWRNEEFRRSVRSVLPGVGDAAAAAAAATAVPAMSQAQLGTRAAGQHW

SEQ ID NO: 560 - protein, 368 aa, Homo sapiens
MVLEVSDHQVLNDAEVAALLENFSSSYDYGENESDSCCTSPPCPQDFSLNFDRAFLPALYSLLFLLGLLGNGAVAAVLLSRRTALSSTDTFLLHLAVADTLLVLTLPLWAVDAAVQWVFGSGLCKVAGALFNINFYAGALLLACISFDRYLNIVHATQLYRRGPPARVTLTCLAVWGLCLLFALPDFIFLSAHHDERLNATHCQYNFPQVGRTALRVLQLVAGFLLPLLVMAYCYAHILAVLLVSRGQRRLRAMRLVVVVVVAFALCWTPYHLVVLVDILMDLGALARNCGRESRVDVAKSVTSGLGYMHCCLNPLLYAFVGVKFRERMWMLLLRLGCPNQRGLQRQPSSSRRDSSWSETSEASYSGL

SEQ ID NO: 561 - protein, 367 aa, Mus musculus
MYLEVSERQVLDASDFAFLLENSTSPYDYGENESDFSDSPPCPQDFSLNFDRTFLPALYSLLFLLGLLGNGAVAAVLLSQRTALSSTDTFLLHLAVADVLLVLTLPLWAVDAAVQWVFGPGLCKVAGALFNINFYAGAFLLACISFDRYLSIVHATQIYRRDPRVRVALTCIVVWGLCLLFALPDFIYLSANYDQRLNATHCQYNFPQVGRTALRVLQLVAGFLLPLLVMAYCYAHILAVLLVSRGQRRFRAMRLVVVVVAAFAVCWTPYHLVVLVDILMDVGVLARNCGRKSHVDVAKSVTSGMGYMHCCLNPLLYAFVGVKFREKMWMLFTRLGRSDQRGPQRQPSSSRRESSWSETTEASYLGL

SEQ ID NO: 562 - protein, 330 aa, Homo sapiens
MAWNATCKNWLAAEAALEKYYLSIFYGIEFVVGVLGNTIVVYGYIFSLKNWNSSNIYLFNLSVSDLAFLCTLPMLIRSYANGNWIYGDVLCISNRYVLHANLYTSILFLTFISIDRYLIIKYPFREHLLQKKEFAILISLAIWVLVTLELLPILPLINPVITDNGTTCNDFASSGDPNYNLIYSMCLTLLGFLIPLFVMCFFYYKIALFLKQRNRQVATALPLEKPLNLVIMAVVIFSVLFTPYHVMRNVRIASRLGSWKQYQCTQVVINSFYIVTRPLAFLNSVINPVFYFLLGDHFRDMLMNQLRHNFKSLTSFSRWAHELLLSFREK

SEQ ID NO: 563 - protein, 317 aa, Mus musculus
MAQNLSCENWLATEAILNKYYLSAFYAIEFIFGLLGNVTVVFGYLFCMKNWNSSNVYLFNLSISDFAFLCTLPILIKSYANDKGTYGDVLCISNRYVLHTNLYTSMLLLTVISMDRYLLMKYPFREHFLQKKEFAILISLAVWALVTLEVLPMLTFINSVPKEEGSNCIDYASSGNPEHNLIYSLCLTLLGFLIPLSVMCFFYYKMVVFLKRRSQQQATALPLDKPQRLVVLAVVIFSILFTPYHIMRNLRIASRLDSWPQGCTQKAIKSIYTLTRPLAFLNSAINPIFYFLMGDHYREMLISKFRQYFKSLTSFRT

SEQ ID NO: 564 - protein, 403 aa, Homo sapiens
MFVASERKMRAHQVLTFLLLFVITSVASENASTSRGCGLDLLPQYVSLCDLDAIWGIVVEAVAGAGALITLLLMLILLVRLPFIKEKEKKSPVGLHFLFLLGTLGLFGLTFAFIIQEDETICSVRRFLWGVLFALCFSCLLSQAWRVRRLVRHGTGPAGWQLVGLALCLMLVQVIIAVEWLVLTVLRDTRPACAYEPMDFVMALIYDMVLLVVTLGLALFTLCGKFKRWKLNGAFLLITAFLSVLIWVAWMTMYLFGNVKLQQGDAWNDPTLAITLAASGWVFVIFHAIPEIHCTLLPALQENTPNYFDTSQPRMRETAFEEDVQLPRAYMENKAFSMDEHNAALRTAGFPNGSLGKRPSGSLGKRPSAPFRSNVYQPTEMAVVLNGGTIPTAPPSHTGRHLW

SEQ ID NO: 565 - protein, 410 aa, Mus musculus
MFLVLERKMRTHQVFPLPLLLVIASVASENASTSRGCGLDLLPQYVSLCDLDAIWGIVVEAVAGAGALITLLLMLILLVRLPFIKDKERKRPVCLHFLFLLGTLGLFGLTFAFIIQMDETICSIRRFLWGVLFALCFSCLLSQAWRVRRLVRQGTSPASWQLVSLALCLMLVQVIIATEWLVLTVLRDTKPACAYEPMDFVMALIYDMVLLAITLAQSLFTLCGKFKRWKVNGAFILVTTFLSALIWVVWMTMYLFGNSLIKQGDAWSDPTLAITLAASGWVFVIFHAIPEIHYTLLPPLQENPPNYFDTSQPRMRETAFDEEMHLPRAYMENKAFSMDEHNAALRSAVGFSNGSLEQRSSSLGKKPSSLGNRPSAPFRSNVYQPTEMAVVLNGGTIPTAPPSHTGRHHW

SEQ ID NO: 566 - protein, 441 aa, Homo sapiens
MAIHKALVMCLGLPLFLFPGAWAQGHVPPGCSQGLNPLYYNLCDRSGAWGIVLEAVAGAGIVTTFVLTIILVASLPFVQDTKKRSLLGTQVFFLLGTLGLFCLVFACVVKPDFSTCASRRFLFGVLFAICFSCLAAHVFALNFLARKNHGPRGWVIFTVALLLTLVEVIINTEWLIITLVRGSGEGGPQGNSSAGWAVASPCAVANMDFVMALIYVMLLLLGAFLGAWPALCGRYKRWRKHGVFVLLTTATSVAIWVVWIVMYTYGNKQHNSPTWDDPTLAIALAANAWAFVLFYVIPEVSQVTKSSPEQSYQGDMYPTRGVGYETILKEQKGQSMFVENKAFSMDEPVAAKRPVSPYSGYNGQLLTSVYQPTEMALMHKVPSEGAYDIILPRATANSQVMGSANSTLRAEDMYSAQSHQAATPPKDGKNSQVFRNPYVWD

SEQ ID NO: 567 - protein, 440 aa, Mus musculus
MATHRTLLMCLGLPLFFPGALAQNHAPPGCSPDLDPLYYNLCDRSGAWGIVLEAVAGAGIITTFVLTIILVASLPFVQDTKKRSLLGTQVFFLLGTLGLFCLVFACVVKPDFSTCASRRFLFGVLFAICFSCLVAHVLSLNFLTRKNHGPRGWVIFTVALLLTLVEVIINTEWLIITLVRGGGQVSPLGNVSADSTMTSPCAIANMDFVMALIYVMLLLLTAFLGAWPTLCGRFKRWRKHGVFVLLTTVISIAIWVVWIVMYTYGNEQHHSPTWDDPTLAIALAANAWTFVLFYVIPEVSQVTKPSPEQSYQGDMYPTRGVGYETILKEQTGQSMFVENKAFSMDEPASAKRPVSPYSGYNGQLLTSVYQPTEMALMHKGPSEGAYDVILPRATANSQVMGSANSTLRAEDMYMVQSHQVATPPKDGKISQVFRNPYVWD

SEQ ID NO: 568 - protein, 345 aa, Homo sapiens
MYKDCIESTGDYFLLCDAEGPWGIILESLAILGIVVTILLLLAFLFLMRKIQDCSQWNVLPTQLLFLLSVLGLFGLAFAFIIELNQQTAPVRYFLFGVLFALCFSCLLAHASNLVKLVRGCVSFSWTTILCIAIGCSLLQIIIATEYVTLIMTRGMMFVNMTPCQLNVDFVVLLVYVLFLMALTFFVSKATFCGPCENWKQHGRLIFITVLFSIIIWVVWISMLLRGNPQFQRQPQWDDPVVCIALVTNAWVFLLLYIVPELCILYRSCRQECPLQGNACPVTAYQHSFQVENQELSRARDSDGAEEDVALTSYGTPIQPQTVDPTQECFIPQAKLSPQQDAGGV

SEQ ID NO: 569 - protein, 300 aa, Mus musculus
MYEDCVKSTEDYYLFCDNEGPWAIVLESLAVIGIVVTILLLLAFLFLMRKVQDCSQWNVLPTQFLFLLAVLGLFGLTFAFIIQLNHQTAPVRYFLFGVLFAICFSCLLAHASNLVKLVRGRVSFCWTTILFIAIGVSLLQTIIAIEYVTLIMTRGLMFEHMTPYQLNVDFVCLLIYVLFLMALTFFVSKATFCGPCENWKQHGRLIFATVLVSIIIWVVWISMLLRGNPQLQRQPHWDDAVICIGLVTNAWVFLLIYIIPELSILYRSCRQECPTQGNVCQVPVYQRSFRMDTQEPTREC

SEQ ID NO: 570 - protein, 926 aa, Homo sapiens
MAFLIILITCFVIILATSQPCQTPDDFVAATSPGHIIIGGLFAIHEKMLSSEDSPRRPQIQECVGFEISVFLQTLAMIHSIEMINNSTLLSGVKLGYEIYDTCTEVTVAMAATLRFLSKFNCSRETVEFKCDYSSYMPRVKAVIGSGYSEITMAVSRMLNLQLMPQVGYESTAEILSDKIRFPSFLRTVPSDFHQIKAMAHLIQKSGWNWIGIITTDDDYGRLALNTFIIQAEANNVCIAFKEVLPAFLSDNTIEVRINRTLKKIILEAQVNVIVVFLRQFHVFDLFNKAIEMNINKMWIASDNWSTATKITTIPNVKKIGKVVGFAFRRGNISSFHSFLQNLHLLPSDSHKLLHEYAMHLSACAYVKDTDLSQCIFNHSQRTLAYKANKAIERNFVMRNDFLWDYAEPGLIHSIQLAVFALGYAIRDLCQARDCQNPNAFQPWELLGVLKNVTFTDGWNSFHFDAHGDLNTGYDVVLWKEINGHMTVTKMAEYDLQNDVFIIPDQETKNEFRNLKQIQSKCSKECSPGQMKKTTRSQHICCYECQNCPENHYTNQTDMPHCLLCNNKTHWAPVRSTMCFEKEVEYLNWNDSLAILLLILSLLGIIFVLVVGIIFTRNLNTPVVKSSGGLRVCYVILLCHFLNFASTSFFIGEPQDFTCKTRQTMFGVSFTLCISCILTKSLKILLAFSFDPKLQKFLKCLYRPILIIFTCTGIQVVICTLWLIFAAPTVEVNVSLPRVIILECEEGSILAFGTMLGYIAILAFICFIFAFKGKYENYNEAKFITFGMLIYFIAWITFIPIYATTFGKYVPAVEIIVILISNYGILYCTFIPKCYVIICKQEINTKSAFLKMIYSYSSHSVSSIALSPASLDSMSGNVTMTNPSSSGKSATWQKSKDLQAQAFAHICRENATSVSKTLPRKRMSSI

SEQ ID NO: 571 - protein, 928 aa, Mus musculus
MALLITVVTCFMIILDTSQSCHTPDDFVAITSPGHIMIGGLFAIHEKMLSSDDHPRRPQIQKCAGFEISVFLQTLAMIHSIEMINNSTLLSGVKLGYEIYDTCTEVTAAMAATLRFLSKFNCSRETVVFQCDYSSYMPRVKAVIGAGYSETSIAVSRMLNLQLMPQVSYESTAEILSDKIRFPSFLRTVPSDFYQTKAMAHLIRQSGWNWIGAITTDDDYGRLALNTFAIQAAENNVCIAFKEVLPAFLSDNTIEVRINQTLEKIIAEAQVNVIVVFLRKFHVFNLFTKAIERKISKIWIASDNWSTATKIITIPNVKKLGKVVGFAFRRGNTSSFHSFLQTLHMYPNDNNKPLHEFAMLVSACKYIKDGDLSQCISNYSQATLTYDTTKTIENHLFKRNDFLWHYTEPGLIYSIQLAVFALGHAIRDLCQARDCKKPNAFQPWELLAVLKNVTFTDGRNSFHFDAHGDLNTGYDVVLWKETNGLMTVTKMAEYDLQRDVFITTNQETKHEFRKLKQILSKCSKECSPGQMKKATGSQHSCCYECVSCPENHYSNETDMDHCLLCNNETHWAPVRSTTCFEKEVEYLDWDDSLALLLIALSLLGIAFVLAIGIIFTRNLKTPVVKSSGGLVVCYVMLICHALNFASTGFFIGEPQDFACKTRQTLFGVSFTLCVSCILTKSLKILLAFSFDPKLTMFLKCLYRPVPIVLTCTGIQVVICTLWLVLAAPSVEENISLPRVIILECEEGSALAFGTMLGYITVLAFICFVFAFKGRKLPENYNEAKFLTFGMLIYFIAWITFIPVYTTTFGKYLPAVEIIVILISNYGILCCIFFPKCYIILCKQKTNTKSAFLQMVYNYSAHSVDSLALSHVSLDSTSYDTATTNQSPGNKMTACQNDNHLPAQVLPHTGTAKTIKASKTLRQKRSSSI

SEQ ID NO: 572 - protein, 588 aa, Homo sapiens
MARGGAGAEEASLRSNALSWLACGLLALLANAWIILSISAKQQKHKPLELLLCFLAGTHILMAAVPLTTFAVVQLRRQASSDYDWNESICKVFVSTYYTLALATCFTVASLSYHRMWMVRWPVNYRLSNAKKQALHAVMGIWMVSFILSTLPSIGWHNNGERYYARGCQFIVSKIGLGFGVCFSLLLLGGIVMGLVCVAITFYQTLWARPRRARQARRVGGGGGTKAGGPGALGTRPAFEVPAIVVEDARGKRRSSLDGSESAKTSLQVTNLVSAIVFLYDSLTGVPILVVSFFSLKSDSAPPWMVLAVLWCSMAQTLLLPSFIWSCERYRADVRTVWEQCVAIMSEEDGDDDGGCDDYAEGRVCKVRFDANGATGPGSRDPAQVKLLPGRHMLFPPLERVHYLQVPLSRRLSHDETNIFSTPREPGSFLHKWSSSDDIRVLPAQSRALGGPPEYLGQRHRLEDEEDEEEAEGGGLASLRQFLESGVLGSGGGPPRGPGFFREEITTFIDETPLPSPTASPGHSPRRPRPLGLSPRRLSLGSPESRAVGLPLGLSAGRRCSLTGGEESARAWGGSWGPGNPIFPQLTL

SEQ ID NO: 573 - protein, 588 aa, Mus musculus
MARGGLGAEEASLRSNALSWLACGLLALLANAWIILSISAKQQKHKPLELLLCFLAGTHILMAAVPLTTFAVVQLRRQASSDYDWNESICKVFVSTYYTLALATCFTVASLSYHRMWMVRWPVNYRLSNAKKQALHAVMGIWMVSFILSTLPSIGWHNNGERYYARGCQFIVSKIGLGFGVCFSLLLLGGIVMGLVCVAITFYQTLWARPRRARQARRAGGSVGTKAGGLGGLGTRPAFEVPAIVVEDTRGKRRSSLDGSESAKTSLQVTNLVSAIVFLYDSLTGVPILVVSFFSLKSDSAPPWMVLAVLWCSMAQTLLLPSFIWSCERYRADVRTVWEQCVAIMSEDDGDDDGTCDDYTDGRVCKIRFDANGATGSGSRDPTQVKLLPGRHMLFPPLERVHYLQVPLSRRLSHDETNIFSTPRAPGSFLHKWSSSDDIRILPAQSRALGGPPEYLGQRHRLEDEEDEEEAEGGGLASLRQFLESGVLGSGGGPPRGPGFFREEITTFIDETPLPSPTASPGPSPRRPRPLGFSPRRLSLGSPDSRAVGLPLGLSAGRRCSLTGSEGSSRAWGRPWGPGNPIFPQLTL

SEQ ID NO: 574 - protein, 1194 aa, Homo sapiens [sequence omitted]

SEQ ID NO: 575 - protein, 1199 aa, Mus musculus
MVRLLLIFFPMIFLEMSILPRMPDRKVLLAGASSQRSVARMDGDVIIGALFSVHHQPPAEKVPERKCGEIREQYGIQRVEAMFHTLDKINADPVLLPNITLGSEIRDSCWHSSVALEQSIEFIRDSLISIRDEKDGLNRCLPDGQTLPPGRTKKPIAGVIGPGSSSVAIQVQNLLQLFDIPQIAYSATSIDLSDKTLYKYFLRVVPSDTLQARAMLDIVKRYNWTYVSAVHTEGNYGESGMDAFKELAAQEGLCIAHSDKIYSNAGEKSFDRLLRKLRERLPKARVVVCFCEGMTVRGLLSAMRRLGVVGEFSLIGSDGWADRDEVIEGYEVEANGGITIKLQSPEVRSFDDYFLKLRLDTNTRNPWFPEFWQHRFQCRLPGHLLENPNFKKVCTGNESLEENYVQDSKMGFVINAIYAMAHGLQNMHHALCPGYVGLCDAMKPIDGRKLLDFLIKSSFVGVSGEEVWFDEKGDAPGRYDIMNLQYTEANRYDYVHVGTWHEGVLNIDDYKIQMNKSGMVRSVCSEPCLKGQIKVIRKGEVSCCWICTACKENEFVQDEFTCRACDLGWWPNAELTGCEPITIRYLEWSDIESIIAIAFSCLGILVTLFVTLIFVLYRDTPVVKSSSRELCYIILAGIFLGYVCPFTLIAKPTTTSCYLQRLLVGLSSAMCYSALVTKTNRIARILAGSKKKICTRKPRFMSAWAQVIIASILISVQLTLVVTLIIMEPPMPILSYPSIKEVYLICNTSNLGVVAPVGYNGLLIMSCTYYAFKTRNVPANFNEAKYIAFTMYTTCIIWLAFVPIYFGSNYKIITTCFAVSLSVTVALGCMFTPKMYIIIAKPERNVRSAFTTSDVVRMHVGDGKLPCRSNTFLNIFRRKKPGAGNANSNGKSVSWSEPGGRQAPKGQHVWQRLSVHVKTNETACNQTAVIKPLTKSYQGSGKSLTFSDASTKTLYNVEEEDNTPSTHFSPPSSPSMVVHRRGPPVATTPPLPPHLSAEETPLFLADSVIPKGLPPPLPQQQQQPPPQPPPQQPKSLMDQLQGVVTNFGSGIPDFHAVLAGPGTPGNGLRSLYPPPPPPQHLQMLPLQLSTFREEPISPPGEDDDDDSSERFKLLQEFVYEREGNTEEDDLEEEEDLPAASKLTPEDSPALTPPSPFRDSVASGSSVPSSPVSESVLCTPPNVTYASVILRDYKQSSSTL

SEQ ID NO: 576 - protein, 877 aa, Homo sapiens
MLTRLQVLTLALFSKGFLLSLGDHNFLRREIKIEGDLVLGGLFPINEKGTGTEECGRINEDRGIQRLEAMLFAIDEINKDDYLLPGVKLGVHILDTCSRDTYALEQSLEFVRASLTKVDEAEYMCPDGSYAIQENIPLLIAGVIGGSYSSVSIQVANLLRLFQIPQISYASTSAKLSDKSRYDYFARTVPPDFYQAKAMAEILRFFNWTYVSTVASEGDYGETGIEAFEQEARLRNICIATAEKVGRSNIRKSYDSVIRELLQKPNARVVVLFMRSDDSRELIAAASRANASFTWVASDGWGAQESIIKGSEHVAYGAITLELASQPVRQFDRYFQSLNPYNNHRNPWFRDFWEQKFQCSLQNKRNHRRVCDKHLAIDSSNYEQESKIMFVVNAVYAMAHALHKMQRTLCPNTTKLCDAMKILDGKKLYKDYLLKINFTAPFNPNKDADSIVKFDTFGDGMGRYNVFNFQNVGGKYSYLKVGHWAETLSLDVNSIHWSRNSVPTSQCSDPCAPNEMKNMQPGDVCCWICIPCEPYEYLADEFTCMDCGSGQWPTADLTGCYDLPEDYIRWEDAWAIGPVTIACLGFMCTCMVVTVFIKHNNTPLVKASGRELCYILLFGVGLSYCMTFFFIAKPSPVICALRRLGLGSSFAICYSALLTKTNCIARIFDGVKNGAQRPKFISPSSQVFICLGLILVQIVMVSVWLILEAPGTRRYTLAEKRETVILKCNVKDSSMLISLTYDVILVILCTVYAFKTRKCPENFNEAKFIGFTMYTTCIIWLAFLPIFYVTSSDYRVQTTTMCISVSLSGFVVLGCLFAPKVHIILFQPQKNVVTHRLHLNRFSVSGTGTTYSQSSASTYVPTVCNGREVLDSTTSSL

SEQ ID NO: 577 - protein, 879 aa, Mus musculus
MKMLTRLQVLMLALFSKGFLVSLGDHNFMRREIKIEGDLVLGGLFPINEKGTGTEECGRINEDRGIQRLEAMLFAIDEINKDNYLLPGVKLGVHILDTCSRDTYALEQSLEFVRASLTKVDEAEYMCPDGSYAIQENIPLLIAGVIGGSYSSVSIQVANLLRLFQIPQISYASTSAKLSDKSRYDYFARTVPPDFYQAKAMAEILRYFNWTYVSTVASEGDYGETGIEAFEQEARLRNICIATAEKVGRSNIRKSYDSVIRELLQKPNARVVVLFMRSDDSRELIAAASRVNASFTWVASDGWGAQESIVKGSEHVAYGAITLELASHPVRQFDRYFQSLNPYNNHRNPWFRDFWEQKFQCSLQNKRNHRQICDKHLAIDSSNYEQESKIMFVVNAVYAMAHALHKMQRTLCPNTTKLCDAMKILDGKKLYKDYLLKINFTAPFNPNKGADSIVKFDTYGDGMGRYNVFNFQHIGGKYSYLKVGHWAETLYLDVDSIHWSRNSVPTSQCSDPCAPNEMKNMQPGDVCCWICIPCEPYEYLVDEFTCMDCGPGQWPTADLSGCYNLPEDYIRWEDAWAIGPVTIACLGFMCTCIVITVFIKHNNTPLVKASGRELCYILLFGVSLSYCMTFFFIAKPSPVICALRRLGLGTSFAICYSALLTKTNCIARIFDGVKNGAQRPKFISPSSQVFICLGLILVQIVMVSVWLILETPGTRRYTLPEKRETVILKCNVKDSSMLISLTYDVVLVILCTVYAFKTRKCPENFNEAKFIGFTMYTTCIIWLAFLPIFYVTSSDYRVQTTTMCISVSLSGFVVLGCLFAPKVHIVLFQPQKNVVTHRLHLNRFSVSGTATTYSQSSASTYVPTVCNGREVLDSTTSSL

SEQ ID NO: 578 - protein, 908 aa, Homo sapiens
MVCEGKRSASCPCFFLLTAKFYWILTMMQRTHSQEYAHSIRVDGDIILGGLFPVHAKGERGVPCGELKKEKGIHRLEAMLYAIDQINKDPDLLSNITLGVRILDTCSRDTYALEQSLTFVQALIEKDASDVKCANGDPPIFTKPDKISGVIGAAASSVSIMVANILRLFKIPQISYASTAPELSDNTRYDFFSRVVPPDSYQAQAMVDIVTALGWNYVSTLASEGNYGESGVEAFTQISREIGGVCIAQSQKIPREPRPGEFEKIIKRLLETPNARAVIMFANEDDIRRILEAAKKLNQSGHFLWIGSDSWGSKIAPVYQQEEIAEGAVTILPKRASIDGFDRYFRSRTLANNRRNVWFAEFWEENFGCKLGSHGKRNSHIKKCTGLERIARDSSYEQEGKVQFVIDAVYSMAYALHNMHKDLCPGYIGLCPRMSTIDGKELLGYIRAVNFNGSAGTPVTFNENGDAPGRYDIFQYQITNKSTEYKVIGHWTNQLHLKVEDMQWAHREHTHPASVCSLPCKPGERKKTVKGVPCCWHCERCEGYNYQVDELSCELCPLDQRPNMNRTGCQLIPIIKLEWHSPWAVVPVFVAILGIIATTFVIVTFVRYNDTPIVRASGRELSYVLLTGIFLCYSITFLMIAAPDTIICSFRRVFLGLGMCFSYAALLTKTNRIHRIFEQGKKSVTAPKFISPASQLVITFSLISVQLLGVFVWFVVDPPHIIIDYGEQRTLDPEKARGVLKCDISDLSLICSLGYSILLMVTCTVYAIKTRGVPETFNEAKPIGFTMYTTCIIWLAFIPIFFGTAQSAEKMYIQTTTLTVSMSLSASVSLGMLYMPKVYIIIFHPEQNVQKRKRSFKAVVTAATMQSKLIQKGNDRPNGEVKSELCESLETNTSSTKTTYISYSNHSI

SEQ ID NO: 579 - protein, 908 aa, Mus musculus
MVCEGKRSTSCPCFFLLTAKFYWILTMMQRTHSQEYAHSIRLDGDIILGGLFPVHAKGERGVPCGDLKKEKGIHRLEAMLYAIDQTNKDPDLLSNITLGVRILDTCSRDTYALEQSLTFVQALIEKDASDVKCANGDPPIFTKPDKISGVIGAAASSVSIMVANILRLFKIPQISYASTAPELSDNTRYDFFSRVVPPDSYQAQAMVDIVTALGWNYVSTLASEGNYGESGVEAFTQISREIGGVCIAQSQKIPREPRPGEFEKIIKRLLETPNARAVIMFANEDDIRGILEAAKKLNQSGHFLWIGSDSWGSKIAPVYQQEEIAEGAVTILPKRASIDGFDRYFRSRTLANNRRNVWFAEFSEGNFGCKSGSHGKRNSHIKKCTGLERIARDSSYEQEGKVQFVIDAVYSMAYALHNMHKELCPGYIGLCPRMVTIDGKELLGYIRAVNFNGSAGTPVTFNENGDAPGRYDIFQYQINNKSTEYKIIGHWTNQLHLKVEDMQWANREHTHPASVCSLPCKPGERKKTVKGVPCCWHCGRCEGYNYQVDELSCELCPLDQRPNINRTGCQRIPIIKLEWHSPWAVVPVLIAILGIIATTFVIVTFVRYNDTPIVRASGRELSYVLLTGIFLCYSITFLMIAAPDTIICSFRRIFLGLGMCFSYAALLTKTNRIHRIFEQGKKSVTAPKFISPASQLVITFSLISVQLLGVFVWFVVDPPHTIIDYGEQRTLDPENARGVLKCDISDLSLICSLGYSILLMVTCTVYAIKTRGVPETFNEAKPIGFTMYTTCIIWLAFIPIFFGTAQSAEKMYIQTTTLTVSMSLSASVSLGMLYMPKVYIIIFHPEQNVQKRKRSFKAVVTAATMQSKLIQKGNDRPNGEVKSELCESLETNTSSTKTTYISYSDHSI

SEQ ID NO: 580 - protein, 384 aa, Homo sapiens
MALNDCFLLNLEVDHFMHCNISSHSADLPVNDDWSHPGILYVIPAVYGVIILIGLIGNITLIKIFCTVKSMRNVPNLFISSLALGDLLLLITCAPVDASRYLADRWLFGRIGCKLIPFIQLTSVGVSVFTLTALSADRYKAIVRPMDIQASHALMKICLKAAFIWIISMLLAIPEAVFSDLHPFHEESTNQTFISCAPYPHSNELHPKIHSMASFLVFYVIPLSIISVYYYFIAKNLIQSAYNLPVEGNIHVKKQIESRKRLAKTVLVFVGLFAFCWLPNHVIYLYRSYHYSEVDTSMLHFVTSICARLLAFTNSCVNPFALYLLSKSFRKQFNTQLLCCQPGLIIRSHSTGRSTTCMTSLKSTNPSVATFSLINGNICHERYV

SEQ ID NO: 581 - protein, 384 aa, Mus musculus
MAPNNCSHLNLDVDPFLSCNDTFNQSLSPPKMDNWFHPGFIYVIPAVYGLIIVIGLIGNITLIKIFCTVKSMRNVPNLFISSLALGDLLLLVTCAPVDASKYLADRWLFGRIGCKLIPFIQLTSVGVSVFTLTALSADRYKAIVRPMDIQASHALMKICLKAALIWIVSMLLAIPEAVFSDLHPFHVKDTNQTFISCAPYPHSNELHPKIHSMASFLVFYVIPLAIISVYYYFIARNLIQSAYNLPVEGNIHVKKQIESRKRLAKTVLVFVGLFAFCWLPNHVIYLYRSYHYSEVDTSMLHFVTSICARLLAFTNSCVNPFALYLLSKSFRKQFNTQLLCCQPGLMNRSHSTGRSTTCMTSFKSTNPSATFSLINRNICHEGYV

SEQ ID NO: 582 - protein, 319 aa, Homo sapiens
MTNSSFFCPVYKDLEPFTYFFYLVFLVGIIGSCFATWAFIQKNTNHRCVSIYLINLLTADFLLTLALPVKIVVDLGVAPWKLKIFHCQVTACLIYINMYLSIIFLAFVSIDRCLQLTHSCKIYRIQEPGFAKMISTVVWLMVLLIMVPNMMIPIKDIKEKSNVGCMEFKKEFGRNWHLLTNFICVAIFLNFSAIILISNCLVIRQLYRNKDNENYPNVKKALINILLVTTGYIICFVPYHIVRIPYTLSQTEVITDCSTRISLFKAKEATLLLAVSNLCFDPILYYHLSKAFRSKVTETFASPKETKAQKEKLRCENNA

SEQ ID NO: 583 - protein, 319 aa, Mus musculus
MTNSSTFCPVYRDLEPFTYFFYLVFLIGIIGSCFATWAFIQKTTNHRCVSIYLINLLTADFLLTLALPVKIIVDLGVAPWKLRIFHCQVTACLIYINMYLSIIFLAFVSIDRCLQLIHSCKIYRIQEPGFAKMISAVVWLMVLLIMVPNMVIPIKDIKEKSNVGCMEFKKEFGRNWHLLTNFICVAIFLNFSVIILISNFLAIRQLYRNRDNTNYPSVKSALLHILLVTASYIICFVPYHAVRIPYTLSQTEVISDCSTRIALFKAKEATLLLAVSNLCFDPILYYHLSKAFRLKVTETFASPKKSKPLEERLRSENDV

SEQ ID NO: 584 - protein, 374 aa, Homo sapiens
MPTLNTSASPPTFFWANASGGSVLSADDAPMPVKFLALRLMVALAYGLVGAIGLLGNLAVLWVLSNCARRAPGPPSDTFVFNLALADLGLALTLPFWAAESALDFHWPFGGALCKMVLTATVLNVYASIFLITALSVARYWVVAMAAGPGTHLSLFWARIATLAVWAAAALVTVPTAVFGVEGEVCGVRLCLLRFPSRYWLGAYQLQRVVLAFMVPLGVITTSYLLLLAFLQRRQRRRQDSRVVARSVRILVASFFLCWFPNHVVTLWGVLVKFDLVPWNSTFYTIQTYVFPVTTCLAHSNSCLNPVLYCLLRREPRQALAGTFRDLRLRLWPQGGGWVQQVALKQVGRRWVASNPRESRPSTLLTNLDRGTPG

SEQ ID NO: 585 - protein, 414 aa, Mus musculus
MATSNSSASLPTLFWVNGSGDSVLSTDGAAMPVQFLVLRIMVALAYGLVGIIGLLGNLAVLWVLGNCGQRVPGLSSDTFVFSLALADLGLALTLPFWATESAMDFHWPFGSALCKVVLTTTVLSIYASTFLITALSIARYWVVAMAVGPGSHLSVFWARVVTLAVWVAAALVTVPTAIFGAEVELWGVCLCLLRFPSRYWLGAYQLQRVVLAFIVPLGVITTSYLLLLAFLERQQRCRPRQWQDSRVVARSVRVLVASFALCWVPNHVVTLWEILVRFDLVPWDSTFYTFHTYILPITTCLAHSNSCLNPVIYCLLRREPQQVLVSSFRALWSRLWPQRKACMEQMALKEVGGRTVASTQESGSSRTHTNTMEHLDEGCSLNTLLSETYQGQSPQILGRSSCSLSQAAVSPGEV

SEQ ID NO: 586 - protein, 330 aa, Homo sapiens
MTPNSTGEVPSPIPKGALGLSLALASLIITANLLLALGIAWDRRLRSPPAGCFFLSLLLAGLLTGLALPTLPGLWNQSRRGYWSCLLVYLAPNFSFLSLLANLLLVHGERYMAVLRPLQPPGSIRLALLLTWAGPLLFASLPALGWNHWTPGANCSSQAIFPAPYLYLEVYGLLLPAVGAAAFLSVRVLATAHRQLQDICRLERAVCRDEPSALARALTWRQARAQAGAMLLFGLCWGPYVATLLLSVLAYEQRPPLGPGTLLSLLSLGSASAAAVPVAMGLGDQRYTAPWRAAAQRCLQGLWGRASRDSPGPSIAYHPSSQSSVDLDLN

SEQ ID NO: 587 - protein, 328 aa, Mus musculus
MTPNSTELSAIPMGVLGLSLALASLIVIANLLLALGIALDRHLRSPPAGCFFLSLLLAGLLTGLALPMLPGLWSRNHQGYWSCLLLHLTPNFCFLSLLANLLLVHGERYMAVLQPLRPHGSVRLALFLTWVSSLFFASLPALGWNHWSPDANCSSQAVFPAPYLYLEVYGLLLPAVGATALLSVRVLATAHRQLCEIRRLERAVCRDVPSTLARALTWRQARAQAGATLLFLLCWGPYVATLLLSVLAYERRPPLGPGTLLSLISLGSTSAAAVPVAMGLGDQRYTAPWRTAAQRCLRVLRGRAKRDNPGPSTAYHTSSQCSIDLDLN

SEQ ID NO: 588 - protein, 335 aa, Homo sapiens
MESSFSFGVILAVLASLIIATNTLVAVAVLLLIHKNDGVSLCFTLNLAVADTLIGVAISGLLTDQLSSPSRPTQKTLCSLRMAFVTSSAAASVLTVMLITFDRYLAIKQPFRYLKIMSGFVAGACIAGLWLVSYLIGFLPLGIPMFQQTAYKGQCSFFAVFHPHFVLTLSCVGFFPAMLLFVFFYCDMLKIASMHSQQIRKMEHAGAMAGGYRSPRTPSDFKALRTVSVLIGSFALSWTPFLITGIVQVACQECHLYLVLERYLWLLGVGNSLLNPLIYAYWQKEVRLQLYHMALGVKKVLTSFLLFLSARNCGPERPRESSCHIVTISSSEFDG

SEQ ID NO: 589 - protein, 335 aa, Mus musculus
MESSFSFGVILAVLTILIIAVNALVVVAMLLSIYKNDGVGLCFTLNLAVADTLIGVAISGLVTDQLSSSAQHTQKTLCSLRMAFVTSSAAASVLTVMLIAFDRYLAIKQPLRYFQIMNGLVAGACIAGLWLVSYLIGFLPLGVSIFQQTTYHGPCSFFAVFHPRFVLTLSCAGFFPAVLLFVFFYCDMLKIASVHSQQIRKMEHAGAMAGAYRPPRSVNDFKAVRTIAVLIGSFTLSWSPFLITSIVQVACHKCCLYQVLEKYLWLLGVGNSLLNPLIYAYWQREVRQQLYHMALGVKKFFTSILLLLPARNRGPERTRESAYHIVTISHPELDG

SEQ ID NO: 590 - protein, 387 aa, Homo sapiens
MNRHHLQDHFLEIDKKNCCVFRDDFIAKVLPPVLGLEFIFGLLGNGLALWIFCFHLKSWKSSRIFLFNLAVADFLLIICLPFVMDYYVRRSDWNFGDIPCRLVLFMFAMNRQGSIIFLTVVAVDRYFRVVHPHHALNKISNWTAAIISCLLWGITVGLTVHLLKKKLLIQNGPANVCISFSICHTFRWHEAMFLLEFLLPLGIILFCSARIIWSLRQRQMDRHAKIKRAITFIMVVAIVFVICFLPSVVVRIRIFWLLHTSGTQNCEVYRSVDLAFFITLSFTYMNSMLDPVVYYFSSPSFPNFFSTLINRCLQRKMTGEPDNNRSTSVELTGDPNKTRGAPEALMANSGEPWSPSYLGPTSNNHSKKGHCHQEPASLEKQLGCCIE

SEQ ID NO: 591 - protein, 360 aa, Mus musculus
MSKSDHFLVINGKNCCVFRDENIAKVLPPVLGLEFVFGLLGNGLALWIFCFHLKSWKSSRIFLFNLAVADFLLIICLPFLTDNYVHNWDWRFGGIPCRVMLFMLAMNRQGSIIFLTVVAVDRYFRVVHPHHFLNKISNRTAAIISCFLWGLTIGLTVHLLYTNMMTKNGEAYLCSSFSICYNFRWHDAMFLLEFFLPLAIILFCSGRIIWSLRQRQMDRHAKIKRAINFIMVVAIVFIICFLPSVAVRIRIFWLLYKYNVRNCDIYSSVDLAFFTTLSFTYMNSMLDPVVYYFSSPSFPNFFSTCINRCLRKKTLGEPDNNRSTSVELTGDPSTTRSIPGALMADPSEPGSPPYLASTSR

SEQ ID NO: 592 - protein, 487 aa, Homo sapiens
MSLPNSSCLLEDKMCEGNKTTMASPQLMPLVVVLSTICLVTVGLNLLVLYAVRSERKLHTVGNLYIVSLSVADLIVGAVVMPMNILYLLMSKWSLGRPLCLFWLSMDYVASTASIFSVFILCIDRYRSVQQPLRYLKYRTKTRASATILGAWFLSFLWVIPILGWNHFMQQTSVRREDKCETDFYDVTWFKVMTAIINFYLPTLLMLWFYAKIYKAVRQHCQHRELINRSLPSFSEIKLRPENPKGDAKKPGKESPWEVLKRKPKDAGGGSVLKSPSQTPKEMKSPVVFSQEDDREVDKLYCFPLDIVHMQAAAEGSSRDYVAVNRSHGQLKTDEQGLNTHGASEISEDQMLGDSQSFSRTDSDTTTETAPGKGKLRSGSNTGLDYIKFTWKRLRSHSRQYVSGLHMNRERKAAKQLGFIMAAFILCWIPYFIFFMVIAFCKNCCNEHLHMFTIWLGYINSTLNPLIYPLCNENFKKTFKRILHIRS

SEQ ID NO: 593 - protein, 488 aa, Mus musculus
MRLPNTSSASEDKMCEGNRTAMASPQLLPLVVVLSSISLVTVGLNLGVLYAVRSERKLHTVGNLYIVSLSVADLIVGAIVMPMNILYLIMTKWSLGRPLCLFWLSMDYVASTASIFSVFILCIDRYRSVQQPLRYLRYRTKTRASATILGAWFLSFLWVIPILGWHHFTPLAPELREDKCETDFYNVTWFKIMTAIINFYLPTLLMLWFYVKIYNGVRRHCQHPQLTNGSLPTFLEIKLRSEDSKEGAKKPGKESPWGVQTRPSRDPTGGLDQKSTSADPKVTSPTVFSQEGERETVTRPCFRLDVMQTQPVPEGDARGSKANDQTLSQPKMDEQSLSTCRRISETSEDQTLVDRQSFSRTTDSDTSIEPGLGKVKARRRSNSGLDYIKVTWKRLRSHSRQYVSGLHLNRERKAAKQLGCIMAAFILCWIPYFIFFMVIAFCNSCCSEPVHMFTIWLGYINSTLNPLIYPLCNENFKKTFKKILHIRS

SEQ ID NO: 594 - protein, 359 aa, Homo sapiens
MAPNGTASSFCLDSTACKITITVVLAVLILITVAGNVVVCLAVGLNRRLRNLTNCFIVSLAITDLLLGLLVLPFSAIYQLSCKWSFGKVFCNIYTSLDVMLCTASILNLFMISLDRYCAVMDPLRYPVLVTPVRVAISLVLIWVISITLSFLSIHLGWNSRNETSKGNHTTSKCKVQVNEVYGLVDGLVTFYLPLLIMCITYYRIFKVARDQAKRINHISSWKAATIREHKATVTLAAVMGAFIICWFPYFTAFVYRGLRGDDAINEVLEAIVLWLGYANSALNPILYAALNRDFRTGYQQLFCCRLANRNSHKTSLRSNASQLSRTQSREPRQQEEKPLKLQVWSGTEVTAPQGATDR

SEQ ID NO: 595 - protein, 358 aa, Mus musculus
MEPNGTVHSCCLDSIALKVTISVVLTTLIFITVAGNVVVCLAVSLNRRLRSLTNCFIVSLAATDLLLGLLVMPFSAIYQLSFKWRFGQVFCNIYTSLDVMLCTASILNLFMISLDRYCAVTDPLRYPVLVTPVRVAISLVFIWVISITLSFLSIHLGWNSRNGTRGGNDTFKCKVQVNEVYGLVDGMVTFYLPLLIMCVTYYRIFKIAREQAKRINHISSWKAATIREHKATVTLAAVMGAFIVCWFPYFTAFVYRGLRGDDPVNEVVEGIVLWLGYANSALNPILYATLNRDFRMAYQQLFHCKLASHNSHKTSLRLNNSLLSRSQSREGRWQEEKPLKLQVWSGTELTHPQGSPVR

SEQ ID NO: 596 - protein, 445 aa, Homo sapiens
MERAPPDGPLNASGALAGEAAAAGGARGFSAAWTAVLAALMALLIVATVLGNALVMLAFVADSSLRTQNNFFLLNLAISDFLVGAFCIPLYVPYVLTGRWTFGRGLCKLWLVVDYLLCTSSAFNIVLISYDRFLSVTRAVSYRAQQGDTRRAVRKMLLVWVLAFLLYGPAILSWEYLSGGSSIPEGHCYAEFFYNWYFLITASTLEFFTPFLSVTFFNLSIYLNIQRRTRLRLDGAREAAGPEPPPEAQPSPPPPPGCWGCWQKGHGEAMPLHRYGVGEAAVGAEAGEATLGGGGGGGSVASPTSSSGSSSRGTERPRSLKRGSKPSASSASLEKRMKMVSQSFTQRFRLSRDRKVAKSLAVIVSIFGLCWAPYTLLMIIRAACHGHCVPDYWYETSFWLLWANSAVNPVLYPLCHHSFRRAFTKLLCPQKLKIQPHSSLEHCWK

SEQ ID NO: 597 - protein, 445 aa, Mus musculus
MERAPPDGLMNASGALAGEAAAAGGARGFSAAWTAVLAALMALLIVATVLGNALVMLAFVADSSLRTQNNFFLLNLAISDFLVGAFCIPLYVPYVLTGRWTFGRGLCKLWLVVDYLLCASSVFNIVLISYDRFLSVTRAVSYRAQQGDTRRAVRKMALVWVLAFLLYGPAILSWEYLSGGSSIPEGHCYAEFFYNWYFLITASTLEFFTPFLSVTFFNLSIYLNIQRRTRLRLDGGREAGPEPPPDAQPSPPPAPPSCWGCWPKGHGEAMPLHRYGVGEAGPGVETGEAGLGGGSGGGAAASPTSSSGSSSRGTERPRSLKRGSKPSASSASLEKRMKMVSQSITQRFRLSRDKKVAKSLAIIVSIFGLCWAPYTLLMIIRAACHGHCVPDYWYETSFWLLWANSAVNPVLYPLCHYSFRRAFTKLLCPQKLKVQPHGSLEQCWK

SEQ ID NO: 598 - protein, 390 aa, Homo sapiens
MPDTNSTINLSLSTRVTLAFFMSLVAFAIMLGNALVILAFVVDKNLRHRSSYFFLNLAISDFFVGVISIPLYIPHTLFEWDFGKEICVFWLTTDYLLCTASVYNIVLISYDRYLSVSNAVSYRTQHTGVLKIVTLMVAVWVLAFLVNGPMILVSESWKDEGSECEPGFFSEWYILAITSFLEFVIPVILVAYFNMNIYWSLWKRDHLSRCQSHPGLTAVSSNICGHSFRGRLSSRRSLSASTEVPASFHSERQRRKSSLMFSSRTKMNSNTIASKMGSFSQSDSVALHQREHVELLRARRLAKSLAILLGVFAVCWAPYSLFTIVLSFYSSATGPKSVWYRIAFWLQWFNSFVNPLLYPLCHKRFQKAFLKIFCIKKQPLPSQHSRSVSS

SEQ ID NO: 599 - protein, 391 aa, Mus musculus
MSESNSTGILPPAAQVPLAFLMSSFAFAIMVGNAVVILAFVVDRNLRHRSNYFFLNLAISDFLVGLISIPLYIPHVLFNWNFGSGICMFWLITDYLLCTASVYNIVLISYDRYQSVSNAVSYRAQHTGIMKIVAQMVAVWILAFLVNGPMILASDSWKNSTNTKDCEPGFVTEWYILTITMLLEFLLPVISVAYFNVQIYWSLWKRRALSRCPSHAGFSTTSSSASGHLHRAGVACRTSNPGLKESAASRHSESPRRKSSILVSLRTHMNSSITAFKVGSFWRSESAALRQREYAELLRGRKLARSLAILLSAFAICWAPYCLFTIVLSTYPRTERPKSVWYSIAFWLQWFNSFVNPFLYPLCHRRFQKAFWKILCVTKQPALSQNQSVSS

SEQ ID NO: 600 - protein, 421 aa, Homo sapiens
MDVLSPGQGNNTTSPPAPFETGGNTTGISDVTVSYQVITSLLLGTLIFCAVLGNACVVAAIALERSLQNVANYLIGSLAVTDLMVSVLVLPMAALYQVLNKWTLGQVTCDLFIALDVLCCTSSILHLCAIALDRYWAITDPIDYVNKRTPRPRALISLTWLIGFLISIPPILGWRTPEDRSDPDACTISKDHGYTIYSTFGAFYIPLLLMLVLYGRIFRAARFRIRKTVKKVEKTGADTRHGASPAPQPKKSVNGESGSRNWRLGVESKAGGALCANGAVRQGDDGAALEVIEVHRVGNSKEHLPLPSEAGPTPCAPASFERKNERNAEAKRKMALARERKTVKTLGIIMGTFILCWLPFFIVALVLPFCESSCHMPTLLGAIINWLGYSNSLLNPVIYAYFNKDFQNAFKKIIKCNFCRQ

SEQ ID NO: 601 - protein, 421 aa, Mus musculus
MDMFSLGQGNNTTTSLEPFGTGGNDTGLSNVTFSYQVITSLLLGTLIFCAVLGNACVVAAIALERSLQNVANYLIGSLAVTDLMVSVLVLPMAALYQVLNKWTLGQVTCDLFIALDVLCCTSSILHLCAIALDRYWAITDPIDYVNKRTPRRAAALISLTWLIGFLISIPPMLGWRAPEDRSNPNECTISKDHGYTIYSTFGAFYIPLLLMLVLYGRIFRAARFRIRKTVKKVEKKGAGTSFGTSSAPPPKKSLNGQPGSGDCRRSAENRAVGTPCANGAVRQGEDDATLEVIEVHRVGNSKGDLPLPSESGATSYVPACLERKNERTAEAKRKMALARERKTVKTLGIIMGTFILCWLPFFIVALVLPFCESSCHMPELLGAIINWLGYSNSLLNPVIYAYFNKDFQNAFKKIIKCKFCR

SEQ ID NO: 602 - protein, 390 aa, Homo sapiens
MEEPGAQCAPPPPAGSETWVPQANLSSAPSQNCSAKDYIYQDSISLPWKVLLVMLLALITLATTLSNAFVIATVYRTRKLHTPANYLIASLAVTDLLVSILVMPISTMYTVTGRWTLGQVVCDFWLSSDITCCTASILHLCVIALDRYWAITDAVEYSAKRTPKRAAVMIALVWVFSISISLPPFFWRQAKAEEEVSECVVNTDHILYTVYSTVGAFYFPTLLLIALYGRIYVEARSRILKQTPNRTGKRLTRAQLITDSPGSTSSVTSINSRVPDVPSESGSPVYVNQVKVRVSDALLEKKKLMAARERKATKTLGIILGAFIVCWLPFFIISLVMPICKDACWFHLAIFDFFTWLGYLNSLINPIIYTMSNEDFKQAFHKLIRFKCTS

SEQ ID NO: 603 - protein, 386 aa, Mus musculus
MEEQGIQCAPPPPAASQTGVPLTNLSHNCSADGYIYQDSIALPWKVLLVALLALITLATTLSNAFVIATVYRTRKLHTPANYLIASLAVTDLLVSILVMPISTMYTVTGRWTLGQVVCDFWLSSDITCCTASIMHLCVIALDRYWAITDAVEYSAKRTPKRAAIMIVLVWVFSISISLPPFFWRQAKAEEEMLDCFVNTDHVLYTVYSTVGAFYLPTLLLIALYGRIYVEARSRILKQTPNKTGKRLTRAQLITDSPGSTSSVTSINSRAPDVPSESGSPVYVNQVKVRVSDALLEKKKLMAARERKATKTLGIILGAFIVCWLPFFIISLVMPICKDACWFHMAIFDFFNWLGYLNSLINPIIYTMSNEDFKQAFHKLIRFKCAG

SEQ ID NO: 604 - protein, 377 aa, Homo sapiens
MSPLNQSAEGLPQEASNRSLNATETSEAWDPRTLQALKISLAVVLSVITLATVLSNAFVLTTILLTRKLHTPANYLIGSLATTDLLVSILVMPISIAYTITHTWNFGQILCDIWLSSDITCCTASILHLCVIALDRYWAITDALEYSKRRTAGHAATMIAIVWAISICISIPPLFWRQAKAQEEMSDCLVNTSQISYTIYSTCGAFYIPSVLLIILYGRIYRAARNRILNPPSLYGKRFTTAHLITGSAGSSLCSLNSSLHEGHSHSAGSPLFFNHVKIKLADSALERKRISAARERKATKILGIILGAFIICWLPFFVVSLVLPICRDSCWIHPALFDFFTWLGYLNSLINPIIYTVFNEEFRQAFQKIVPFRKAS

SEQ ID NO: 605 - protein, 374 aa, Mus musculus
MSLPNQSLEGLPQEASNRSLNATGAWDPEVLQALRISLVVVLSVITLATVLSNAFVLTTILLTKKLHTPANYLIGSLATTDLLVSILVMPISIAYTTTRTWNFGQILCDIWVSSDITCCTASILHLCVIALDRYWAITDALEYSKRRTAGHAAAMIAAVWIISICISIPPLFWRQATAHEEMSDCLVNTSQISYTIYSTCGAFYIPSILLIILYGRIYVAARSRILNPPSLYGKRFTTAQLITGSAGSSLCSLNPSLHESHTHTVGSPLFFNQVKIKLADSILERKRISAARERKATKTLGIILGAFIICWLPFFVVSLVLPICRDSCWIHPALFDFFTWLGYLNSLINPVIYTVFNEDFRQAFQKVVHFRKAS

SEQ ID NO: 606 - protein, 366 aa, Homo sapiens
MDFLNSSDQNLTSEELLNRMPSKILVSLTLSGLALMTTTINSLVIAAIIVTRKLHHPANYLICSLAVTDFLVAVLVMPFSIVYIVRESWIMGQVVCDIWLSVDITCCTCSILHLSAIALDRYRAITDAVEYARKRTPKHAGIMITIVWIISVFISMPPLFWRHQGTSRDDECIIKHDHIVSTIYSTFGAFYIPLALILILYYKIYRAAKTLYHKRQASRIAKEEVNGQVLLESGEKSTKSVSTSYVLEKSLSDPSTDFDKIHSTVRSLRSEFKHEKSWRRQKISGTRERKAATTLGLILGAFVICWLPFFVKELVVNVCDKCKISEEMSNFLAWLGYLNSLINPLIYTIFNEDFKKAFQKLVRCRC

SEQ ID NO: 607 - protein, 366 aa, Mus musculus
MDFLNASDQNLTSEELLNRMPSKILVSLTLSGLALMTTTINSLVIAAIIVTRKLHHPANYLICSLAVTDFLVAVLVMPFSIVYIVRESWIMGQVLCDIWLSVDIICCTCSILHLSAIALDRYRAITDAVEYARKRTPRHAGIMITIVWVISVFISMPPLFWRHQGTSRDDECVIKHDHIVSTIYSTFGAFYIPLVLILILYYKIYRAARTLYHKRQASRMIKEELNGQVFLESGEKSIKLVSTSYMLEKSLSDPSTDFDRIHSTVKSPRSELKHEKSWRRQKISGTRERKAATTLGLILGAFVICWLPFFVKELVVNVCEKCKISEEMSNFLAWLGYLNSLINPLIYTIFNEDFKKAFQKLVRCRY

SEQ ID NO: 608 - protein, 471 aa, Homo sapiens
MDILCEENTSLSSTTNSLMQLNDDTRLYSNDFNSGEANTSDAFNWTVDSENRTNLSCEGCLSPSCLSLLHLQEKNWSALLTAVVIILTIAGNILVIMAVSLEKKLQNATNYFLMSLAIADMLLGFLVMPVSMLTILYGYRWPLPSKLCAVWIYLDVLFSTASIMHLCAISLDRYVAIQNPIHHSRFNSRTKAFLKIIAVWTISVGISMPIPVFGLQDDSKVFKEGSCLLADDNFVLIGSFVSFFIPLTIMVITYFLTIKSLQKEATLCVSDLGTRAKLASFSFLPQSSLSSEKLFQRSIHREPGSYTGRRTMQSISNEQKACKVLGIVFFLFVVMWCPFFITNIMAVICKESCNEDVIGALLNVFVWIGYLSSAVNPLVYTLFNKTYRSAFSRYIQCQYKENKKPLQLILVNTIPALAYKSSQLQMGQKKNSKQDAKTTDNDCSMVALGKQHSEEASKDNSDGVNEKVSCV

SEQ ID NO: 609 - protein, 471 aa, Mus musculus
MEILCEDNISLSSIPNSLMQLGDDSRLYPNDFNSRDANTSEASNWTIDAENRTNLSCEGYLPPTCLSILHLQEKNWSALLTTVVIILTIAGNILVIMAVSLEKKLQNATNYFLMSLAIADMLLGFLVMPVSMLTILYGYRWPLPSKLCAVWIYLDVLFSTASIMHLCAISLDRYVAIQNPIHHSRFNSRTKAFLKIIAVWTISVGISMPIPVFGLQDDSKVFKEGSCLLADDNFVLIGSFVAFFIPLTIMVITYFLTIKSLQKEATLCVSDLSTRAKLSSFSFLPQSSLSSEKLFQRSIHREPGSYAGRRTMQSISNEQKACKVLGIVFFLFVVMWCPFFITNIMAVICKESCNENVIGALLNVFVWIGYLSSAVNPLVYTLFNKTYRSAFSRYIQCQYKENRKPLQLILVNTIPTLAYKSSQLQVGQKKNSQEDAEPTANDCSMVTLGNQHSEEMCTDNIETVNEKVSCV

SEQ ID NO: 610 - protein, 481 aa, Homo sapiens
MALSYRVSELQSTIPEHILQSTFVHVISSNWSGLQTESIPEEMKQIVEEQGNKLHWAALLILMVIIPTIGGNTLVILAVSLEKKLQYATNYFLMSLAVADLLVGLFVMPIALLTIMFEAMWPLPLVLCPAWLFLDVLFSTASIMHLCAISVDRYIAIKKPIQANQYNSRATAFIKITVVWLISIGIAIPVPIKGIETDVDNPNNITCVLTKERFGDFMLFGSLAAFFTPLAIMIVTYFLTIHALQKKAYLVKNKPPQRLTWLTVSTVFQRDETPCSSPEKVAMLDGSRKDKALPNSGDETLMRRTSTIGKKSVQTISNEQRASKVLGIVFFLFLLMWCPFFITNITLVLCDSCNQTTLQMLLEIFVWIGYVSSGVNPLVYTLFNKTFRDAFGRYITCNYRATKSVKTLRKRSSKIYFRNPMAENSKFFKKHGIRNGINPAMYQSPMRLRSSTIQSSSIILLDTLLLTENEGDKTEEQVSYV

SEQ ID NO: 611 - protein, 481 aa, Mus musculus
MASSYKMSEQSTTSEHILQKTCDHLILTNRSGLETDSVAEEMKQTVEGQGHTVHWAALLILAVIIPTIGGNILVILAVALEKRLQYATNYFLMSLAIADLLVGLFVMPIALLTIMFEAIWPLPLALCPAWLFLDVLFSTASIMHLCAISLDRYIAIKKPIQANQCNTRATAFIKITVVWLISIGIAIPVPIKGIETDVINPHNVTCELTKDRFGSFMVFGSLAAFFVPLTIMVVTYFLTIHTLQKKAYLVKNKPPQRLTRWTVPTVFLREDSSFSSPEKVAMLDGSHRDKILPNSSDETLMRRMSSVGKRSAQTISNEQRASKALGVVFFLFLLMWCPFFITNLTLALCDSCNQTTLKTLLEIFVWIGYVSSGVNPLIYTLFNKTFREAFGRYITCNYRATKSVKALRKFSSTLCFGNSMVENSKFFTKHGIRNGINPAMYQSPMRLRCSTIQSSSIILLDTLLTENDGDKAEEQVSYILQ

SEQ ID NO: 612 - protein, 458 aa, Homo sapiens
MVNLRNAVHSFLVHLIGLLVWQCDISVSPVAAIVTDIFNTSDGGRFKFPDGVQNWPALSIVIIIIMTIGGNILVIMAVSMEKKLHNATNYFLMSLAIADMLVGLLVMPLSLLAILYDYVWPLPRYLCPVWISLDVLFSTASIMHLCAISLDRYVAIRNPIEHSRFNSRTKAIMKIAIVWAISIGVSVPIPVIGLRDEEKVFVNNTTCVLNDPNFVLIGSFVAFFIPLTIMVITYCLTIYVLRRQALMLLHGHTEEPPGLSLDFLKCCKRNTAEEENSANPNQDQNARRRKKKERRPRGTMQAINNERKASKVLGIVFFVFLIMWCPFFITNILSVLCEKSCNQKLMEKLLNVFVWIGYVCSGINPLVYTLFNKIYRRAFSNYLRCNYKVEKKPPVRQIPRVAATALSGRELNVNIYRHTNEPVIEKASDNEPGIEMQVENLELPVNPSSVVSERISSV

SEQ ID NO: 613 - protein, 459 aa, Mus musculus
MVNLGTAVRSLLVHLIGLLVWQFDISISPVAAIVTDTFNSSDGGRLFQFPDGVQNWPALSIVVIIIMTIGGNILVIMAVSMEKKLHNATNYFLMSLAIADMLVGLLVMPLSLLAILYDYVWPLPRYLCPVWISLDVLFSTASIMHLCAISLDRYVAVRSPVEHSRFNSRTKAIMKIAIVWAISIGVSVPIPVIGLRDESKVFVNNTTCVLNDPNFVLIGSFVAFFIPLTIMVITYFLTIYVLRRQTLMLLRGHTEEELRNISLNFLKCCCKKGDEEENAPNPNPDQKPRRKKKEKRPRGTMQAINNEKKASKVLGIVFFVFLIMWCPFFITNILSVLCGKACNQKLMEKLLNVFVWIGYVCSGINPLVYTLFNKIYRRAFSKYLRCDYKPDKKPPVRQIPRVAATALSGRELNVNIYRHTNERVVRKANDTEPGIEMQVENLELPVNPSNVVSERISSV

SEQ ID NO: 614 - protein, 388 aa, Homo sapiens
MDKLDANVSSEEGFGSVEKVVLLTFLSTVILMAILGNLLVMVAVCWDRQLRKIKTNYFIVSLAFADLLVSVLVMPFGAIELVQDIWIYGEVFCLVRTSLDVLLTTASIFHLCCISLDRYYAICCQPLVYRNKMTPLRIALMLGGCWVIPTFISFLPIMQGWNNIGIIDLIEKRKFNQNSNSTYCVFMVNKPYAITCSVVAFYIPFLLMVLAYYRIYVTAKEHAHQIQMLQRAGASSESRPQSADQHSTHRMRTETKAAKTLCIIMGCFCLCWAPFFVTNIVDPFIDYTVPGQVWTAFLWLGYINSGLNPFLYAFLNKSFRRAFLIILCCDDERYRRPSILGQTVPCSTTTINGSTHVLRDAVECGGQWESQCHPPATSPLVAAQPSDT

SEQ ID NO: 615 - protein, 388 aa, Mus musculus
MDKLDANVSSNEGFRSVEKVVLLTFLAVVILMAILGNLLVMVAVCRDRQLRKIKTNYFIVSLAFADLLVSVLVMPFGAIELVQDIWAYGEMFCLVRTSLDVLLTTASIFHLCCISLDRYYAICCQPLVYRNKMTPLRIALMLGGCWVLPMFISFLPIMQGWNNIGIVDVIEKRKFSHNSNSTWCVFMVNKPYAITCSVVAFYIPFLLMVLAYYRIYVTAKEHAQQIQMLQRAGATSESRPQPADQHSTHRMRTETKAAKTLCVIMGCFCFCWAPFFVTNIVDPFIDYTVPEQVWTAFLWLGYINSGLNPFLYAFLNKSFRRAFLIILCCDDERYKRPPILGQTVPCSTTTINGSTHVLRDAVECGGQWESRCHLTATSPLVAAQPSDT

SEQ ID NO: 616 - protein, 357 aa, Homo sapiens
MDLPVNLTSFSLSTPSPLETNHSLGKDDLRPSSPLLSVFGVLILTLLGFLVAATFAWNLLVLATILRVRTFHRVPHNLVASMAVSDVLVAALVMPLSLVHELSGRRWQLGRRLCQLWIACDVLCCTASIWNVTAIALDRYWSITRHMEYTLRTRKCVSNVMIALTWALSAVISLAPLLFGWGETYSEGSEECQVSREPSYAVFSTVGAFYLPLCVVLFVYWKIYKAAKFRVGSRKTNSVSPISEAVEVKDSAKQPQMVFTVRHATVTFQPEGDTWREQKEQRAALMVGILIGVFVLCWIPFFLTELISPLCSCDIPAIWKSIFLWLGYSNSFFNPLIYTAFNKNYNSAFKNFFSRQH

SEQ ID NO: 617 - protein, 357 aa, Mus musculus
MDLPVNLTSFSLSTPSSLEPNRSLDTEVLRPSRPFLSAFRVLVLTLLGFLAAATFTWNLLVLATILKVRTFHRVPHNLVASMAISDVLVAVLVMPLSLVHELSGRRWQLGRRLCQLWIACDVLCCTASIWNVTAIALDRYWSITRHLEYTLRTRKRVSNVMILLTWALSTVISLAPLLFGWGETYSEPSEECQVSREPSYTVFSTVGAFYLPLWLVLFVYWKIYRAAKFRMGSRKTNSVSPVPEAVEVKNATQHPQMVFTARHATVTFQTEGDTWREQKEQRAALMVGILIGVFVLCWFPFFVTELISPLCSWDVPAIWKSIFLWLGYSNSFFNPLIYTAFNRSYSSAFKVFFSKQQ

SEQ ID NO: 618 - protein, 440 aa, Homo sapiens
MVPEPGPTANSTPAWGAGPPSAPGGSGWVAAALCVVIALTAAANSLLIALICTQPALRNTSNFFLVSLFTSDLMVGLVVMPPAMLNALYGRWVLARGLCLLWTAFDVMCCSASILNLCLISLDRYLLILSPLRYKLRMTPLRALALVLGAWSLAALASFLPLLLGWHELGHARPPVPGQCRLLASLPFVLVASGLTFFLPSGAICFTYCRILLAARKQAVQVASLTTGMASQASETLQVPRTPRPGVESADSRRLATKHSRKALKASLTLGILLGMFFVTWLPFFVANIVQAVCDCISPGLFDVLTWLGYCNSTMNPIIYPLFMRDFKRALGRFLPCPRCPRERQASLASPSLRTSHSGPRPGLSLQQVLPLPLPPDSDSDSDAGSGGSSGLRLTAQLLLPGEATQDPPLPTRAAAAVNFFNIDPAEPELRPHPLGIPTN

SEQ ID NO: 619 - protein, 440 aa, Mus musculus
MVPEPGPVNSSTPAWGPGPPPAPGGSGWVAAALCVVIVLTAAANSLLIALICTQPALRNTSNFFLVSLFTSDLMVGLVVMPPAMLNALYGRWVLARGLCLLWTAFDVMCCSASILNLCLISLDRYLLILSPLRYKLRMTAPRALALILGAWSLAALASFLPLLLGWHELGKARTSAPGQCRLLASLPYVLVASGVTFFLPSGAICFTYCRILLAARKQAVQVASLTTGTATAGQALETLQVPRTPRPGMESADSRRLTTKHSRKALKASLTLGILLSMFFVTWLPFFVASIAQAVCDCISPGLFDVLTWLGYCNSTMNPIIYPLFMRDFKRALGRFVPCVHCPPEHRASPASPSMWTSHSGARPGLSLQQVLPLPLPPNSDSDSASGGTSGLQLTAQLLLPGEATRDPPPPTRAPTVVNFFVTDSVEPEIRQHPLGSPMN

SEQ ID NO: 620 - protein, 445 aa, Homo sapiens
MMDVNSSGRPDLYGHLRSFLLPEVGRGLPDLSPDGGADPVAGSWAPHLLSEVTASPAPTWDAPPDNASGCGEQINYGRVEKVVIGSILTLITLLTIAGNCLVVISVCFVKKLRQPSNYLIVSLALADLSVAVAVMPFVSVTDLIGGKWIFGHFFCNVFIAMDVMCCTASIMTLCVISIDRYLGITRPLTYPVRQNGKCMAKMILSVWLLSASITLPPLFGWAQNVNDDKVCLISQDFGYTIYSTAVAFYIPMSVMLFMYYQIYKAARKSAAKHKFPGFPRVEPDSVIALNGIVKLQKEVEECANLSRLLKHERKNISIFKREQKAATTLGIIVGAFTVCWLPFFLLSTARPFICGTSCSCIPLWVERTFLWLGYANSLINPFIYAFFNRDLRTTYRSLLQCQYRNINRKLSAAGMHEALKLAERPERPEFVLQNADYCRKKGHDS

SEQ ID NO: 621 - protein, 448 aa, Mus musculus
MMDVNSSGRPDLYGHLRSLILPEVGRRLQDLSPDGGAHSVVSSWMPHLLSGFPEVTASPAPTWDAPPDNVSGCGEQINYGRVEKVVIGSILTLITLLTIAGNCLVVISVCFVKNVRQPSNYLIVSLALADLSVAVAVMPFVSVTDLIGGKWIFGHFFCNVFIAMDVMCCTASIMTLCVISIDRYLGITRPLTYPVRQNGKCMAKMILSVWPLSASITLPPLFGWAQNVNDDKVCLISQDFGYTIYSTAVAFYIPMSVMLFMYYQIYKAARKSAAKHKFSGFPRVQPESVISLNGVVKLQKEVEECANLSRLLKHERKNISSFKREQKAATTLGIIVGAFTVCWLPFFLLSTARPFICGTSCSCIPLWVERTCLWLGYANSLINPFIYSFFNRDLRTTYRSLLQCQYRNINRKLSAAGMHEALKLAERPERSEFVLQNCDHCGKKGHDT

SEQ ID NO: 622 - protein, 482 aa, Homo sapiens [sequence omitted]

SEQ ID NO: 623 - protein, 457 aa, Mus musculus
MEEQARPPGRPAASATLQGSAHPGGAASTATAAALSFSSVATVTLGNQSDAGRPEAAGSRGPAPLLWHGAAVAAQALVLLLIFLLSSLGNCAVMGVIVKHRQLRTVTNAFILSLSLSDLLTALLCLPAAFLDLFAPPGDSGPWRSFCAASRFFSSCFGIVSTFSVALISLDRYCAIVRPPRDKLGRRRALQLLAGAWLAALGFSLPWDLLRAPREPPAPQSFHRCLYRTSPDPAQLGVAYSVGLVVACYLLPFLLMCFCRYHICKTVRLSDVRVRPMTTYARVLRFFSEVRTATTVLIMIIFVMCCWGPYCFLVLLAATRQGQATQAPSLLNVAAVWLTWANGAINPVIYAIRNPNISMLLGRNREEGYRTRNMDAFLPSQGLGFQARSRNRLRNGCANRLGACSRMPSSNPASGSGGEVVMWARKNPVVLFFREGPPDSVMEVGKLHNSETRDSSI

SEQ ID NO: 624 - protein, 350 aa, Homo sapiens [sequence omitted]

SEQ ID NO: 625 - protein, 351 aa, Mus musculus
MAEAEYFIWTNPEGDFEKEFGNITGMLPTGDYFIPCKRVPITNRQALVVFYALVSLLSLLGNSLVMLVILYRRRTRSVMDVYVLNLAIADLLFSLTLPFLAVSKLKGWIFGTPLCKMVSLLKEFNFFSGILLLACISVDRYLAIVHATRTLARKRYLVKFVCVGIWGLSLILSLPFAIFRQAYKPFRSGTVCYEVLGEATTDFRMTLRGLSHIFGFLLPLLTMLVCYGLTLRMLFKTHMRQKHRAMGVIFAVVLVFLLCCLPYNLVLLSDTLLGAHLIEDTCERRNDIDQALYITEILGFSHSCLNPIIYAFVGQNFRHEFLKILANHGLVRKEVLTHRRVAFHTSLTAIY

SEQ ID NO: 626 - protein, 360 aa, Homo sapiens
MEDFNMESDSFEDFWKGEDLSNYSYSSTLPPFLLDAAPCEPESLEINKYFVVIIYALVFLLSLLGNSLVMLVILYSRVGRSVTDVYLLNLALADLLFALTLPIWAASKVNGWIFGTFLCKVVSLLKEVNFYSGILLLACISVDRYLAIVHATRTLTQKRYLVKFICLSIWGLSLLLALPVLLFRRTVYSSNVSPACYEDMGNNTANWRMLLRILPQSFGFIVPLLIMLFCYGFTLRTLFKAHMGQKHRAMRVIFAVVLIFLLCWLPYNLVLLADTLMRTQVIQETCERRNHIDRALDATEILGILHSCLNPLIYAFIGQKFRHGLLKILAIHGLISKDSLPKDSRPSFVGSSSGHTSTTL

SEQ ID NO: 627 - protein, 359 aa, Mus musculus
MGEFKVDKFNIEDFFSGDLDIFNYSSGMPSILPDAVPCHSENLEINSYAVVVIYVLVTLLSLVGNSLVMLVILYNRSTCSVTDVYLLNLAIADLFFALTLPVWAASKVNGWTFGSTLCKIFSYVKEVTFYSSVLLLACISMDRYLAIVHATSTLIQKRHLVKFVCIAMWLLSVILALPILILRNPVKVNLSTLVCYEDVGNNTSRLRVVLRILPQTFGFLVPLLIMLFCYGFTLRTLFKAHMGQKHRAMRVIFAVVLVFLLCWLPYNLVLFTDTLMRTKLIKETCERRDDIDKALNATEILGFLHSCLNPIIYAFIGQKFRHGLLKIMATYGLVSKEFLAKEGRPSFVSSSSANTSTTL

SEQ ID NO: 628 - protein, 754 aa, Homo sapiens
MIVFLVFKHLFSLRLITMFFLLHFIVLINVKDFALTQGSMITPSCQKGYFPCGNLTKCLPRAFHCDGKDDCGNGADEENCGDTSGWATIFGTVHGNANSVALTQECFLKQYPQCCDCKETELECVNGDLKSVPMISNNVTLLSLKKNKIHSLPDKVFIKYTKLKKIFLQHNCIRHISRKAFFGLCNLQILYLNHNCITTLRPGIFKDLHQLTWLILDDNPITRISQRLFTGLNSLFFLSMVNNYLEALPKQMCAQMPQLNWVDLEGNRIKYLTNSTFLSCDSLTVLFLPRNQIGFVPEKTFSSLKNLGELDLSSNTITELSPHLFKDLKLLQKLNLSSNPLMYLHKNQFESLKQLQSLDLERIEIPNINTRMFQPMKNLSHIYFKNFRYCSYAPHVRICMPLTDGISSFEDLLANNILRIFVWVIAFITCFGNLFVIGMRSFIKAENTTHAMSIKILCCADCLMGVYLFFVGIFDIKYRGQYQKYALLWMESVQCRLMGFLAMLSTEVSVLLLTYLTLEKFLVIVFPFSNIRPGKRQTSVILICIWMAGFLIAVIPFWNKDYFGNFYGKNGVCFPLYYDQTEDIGSKGYSLGIFLGVNLLAFLIIVFSYITMFCSIQKTALQTTEVRNCFGREVAVANRFFFIVFSDAICWIPVFVVKILSLFRVEIPDTMTSWIVIFFLPVNSALNPILYTLTTNFFKDKLKQLLHKHQRKSIFKIKKKSLSTSIVWIEDSSSLKLGVLNKITLGDSIMKPVS

SEQ ID NO: 629 - protein, 737 aa, Mus musculus
MWLLLHVILLTEVKDFALADSSMVAPLCPKGYFPCGNLTKCLPRAFHCDGVDDCGNGADEDNCGDTSGWTTIFGTVHGNVNKVTLTQECFLSQYPQHCYCRENELECVKADLKAVPKVSSNVTLLSLKKNKIHRLPVKVFSRYTELRKIYLQHNCITHISRRAFLGLHNLQILYLSHNCITSLRPGIFKDLHQLAWLILDDNPITRISQKSFMGLNSLFFLPMVGNRLEALPETLCAQMPQLNWVDLANNGIKYITNSTFLTCDSLTVLFLPRNQIGFVPEKTFSSLKNLGELDLSSNMITKLPVHLFSDLHLLQKLNLSSNPLLYVHKNQFGSLKQLQSLDLERIEIPNISTGMFQPMKNLSHIYLKTFRYCSYVPHVRICMPSTDGISSSEDLLANGILRVSVWVIAFITCVGNFLVIAVRSLIKAENTTHAMSIKILCCADCLMGVYLFSVGVFDIKYRGQYQKYALLWMESVPCRLLGFLATLSTEVSVLLLTFLTLEKFLVIVFPFSNLRLGKRQTAVALASIWVVGFLIAAVPFTREDYFGNFYGKNGVCFPLHYDQAEDFGSRGYSLGIFLGVNLLAFLVIVISYVTMFCSIHKTALQTAEVRSHIGKEVAVANRFFFIVFSDAICWIPVFVVKILSLLQVEIPGTITSWIVVFFLPVNSALNPILYTLTTSFFKDKLKQLLHKHRRKPIFKVKKKSLSASIVWTDESSLKLGVLSKIALGDSIMKPVSP

SEQ ID NO: 630 - protein, 699 aa, Homo sapiens
MKQRFSALQLLKLLLLLQPPLPRALREALCPEPCNCVPDGALRCPGPTAGLTRLSLAYLPVKVIPSQAFRGLNEVIKIEISQIDSLERIEANAFDNLLNLSEILIQNTKNLRYIEPGAFINLPGLKYLSICNTGIRKFPDVTKVFSSESNFILEICDNLHITTIPGNAFQGMNNESVTLKLYGNGFEEVQSHAFNGTTLTSLELKENVHLEKMHNGAFRGATGPKTLDISSTKLQALPSYGLESIQRLIATSSYSLKKLPSRETFVNLLEATLTYPSHCCAFRNLPTKEQNFSHSISENFSKQCESTVRKVSNKTLYSSMLAESELSGWDYEYGFCLPKTPRCAPEPDAFNPCEDIMGYDFLRVLIWLINILAIMGNMTVLFVLLTSRYKLTVPRFLMCNLSFADFCMGLYLLLIASVDSQTKGQYYNHAIDWQTGSGCSTAGFFTVFASELSVYTLTVITLERWHTITYAIHLDQKLRLRHAILIMLGGWLFSSLIAMLPLVGVSNYMKVSICFPMDVETTLSQVYILTILILNVVAFFIICACYIKIYFAVRNPELMATNKDTKIAKKMAILIFTDFTCMAPISFFAISAAFKVPLITVTNSKVLLVLFYPINSCANPFLYAIFTKTFQRDFFLLLSKFGCCKRRAELYRRKDFSAYTSNCKNGFTGSNKPSQSTLKLSTLHCQGTALLDKTRYTEC

SEQ ID NO: 631 - protein, 700 aa, Mus musculus
MGRRVPALRQLLVLAMLVLKQSQLHSPELSGSRCPEPCDCAPDGALRCPGPRAGLARLSLTYLPVKVIPSQAFRGLNEVVKIEISQSDSLERIEANAFDNLLNLSEILIQNTKNLLYIEPGAFTNLPRLKYLSICNTGIRTLPDVSKISSSEFNFILEICDNLYITTIPGNAFQGMNNESITLKLYGNGFEEVQSHAFNGTTLISLELKENIYLEKMHSGTFQGATGPSILDVSSTKLQALPSHGLESIQTLIATSSYSLKTLPSREKFTSLLVATLTYPSHCCAFRNLPKKEQNFSFSIFENFSKQCESTVREANNETLYSAIFEENELSGWDYDYDFCSPKTLQCTPEPDAFNPCEDIMGYAFLRVLIWLINILAIFGNLTVLFVLLTSRYKLTVPRFLMCNLSFADFCMGLYLLLIASVDSQTKGQYYNHAIDWQTGSGCSAAGFFTVFASELSVYTLTVITLERWHTITYAVQLDQKLRLRHAIPIMLGGWIFSTLMATLPLVGVSSYMKVSICLPMDVESTLSQVYILSILLLNAVAFVVICACYVRIYFAVQNPELTAPNKDTKIAKKMAILIFTDFTCMAPISFFAISAAFKVPLITVTNSKVLLVLFYPVNSCANPFLYAVFTKAFQRDFFLLLSRFGCCKHRAELYRRKEFSACTFNSKNGFPRSSKPSQAALKLSIVHCQQPTPPRVLIQ

SEQ ID NO: 632 - protein, 352 aa, Homo sapiens
MNTTSSAAPPSLGVEFISLLAIILLSVALAVGLPGNSFVVWSILKRMQKRSVTALMVLNLALADLAVLLTAPFFLHFLAQGTWSFGLAGCRLCHYVCGVSMYASVLLITAMSLDRSLAVARPFVSQKLRTKAMARRVLAGIWVLSFLLATPVLAYRTVVPWKTNMSLCFPRYPSEGHRAFHLIFEAVTGFLLPFLAVVASYSDIGRRLQARRFRRSRRTGRLVVLIILTFAAFWLPYHVVNLAEAGRALAGQAAGLGLVGKRLSLARNVLIALAFLSSSVNPVLYACAGGGLLRSAGVGFVAKLLEGTGSEASSTRRGGSLGQTARSGPAALEPGPSESLTASSPLKLNELN

SEQ ID NO: 633 - protein, 351 aa, Mus musculus
MAANTTSPAAPSSPGGMSLSLLPIVLLSVALAVGLPGNSFVVWSILKRMQKRTVTALLVLNLALADLAVLLTAPFFLHFLARGTWSFREMGCRLCHYVCGISMYASVLLITIMSLDRSLAVARPFMSQKVRTKAFARWVLAGIWVVSFLLAIPVLVYRTVKWNNRTLICAPNYPNKEHKVFHLLFEAITGFLLPFLAVVASYSDIGRRLQARRFRRSRRTGRLVVLIILAFAAFWLPYHLVNLVEAGRTVAGWDKNSPAGQRLRLARYVLIALAFLSSSVNPVLYACAGGGLLRSAGVGFVVKLLEGTGSEVSSTRRGGTLVQTPKDTPACPEPGPTDSFMTSSTIPESSK

SEQ ID NO: 634 - protein, 389 aa, Homo sapiens
MAPSHRASQVGFCPTPERPLWRLPPTCRPRRMSVCYRPPGNETLLSWKTSRATGTAFLLLAALLGLPGNGFVVWSLAGWRPARGRPLAATLVLHLALADGAVLLLTPLFVAFLTRQAWPLGQAGCKAVYYVCALSMYASVLLTGLLSLQRCLAVTRPFLAPRLRSPALARRLLLAVWLAALLLAVPAAVYRHLWRDRVCQLCHPSPVHAAAHLSLETLTAFVLPFGLMLGCYSVTLARLRGARWGSGRHGARVGRLVSAIVLAFGLLWAPYHAVNLLQAVAALAPPEGALAKLGGAGQAARAGTTALAFFSSSVNPVLYVFTAGDLLPRAGPRFLTRLFEGSGEARGGGRSREGTMELRTTPQLKVVGQGRGNGDPGGGMEKDGPEWDL

SEQ ID NO: 635 - protein, 360 aa, Mus musculus
MSVCYRPPGNETLLSWKGSRATGTAFLLLAALLGLPGNGFVVWSLAGWRPTAGRPLAATLVLHLALADGAVLLLTPLFVAFLSQEAWPLGQVGCKAVYYVCALSMYASVLLTGLLSLQRCLAVTRPFLAPRLRSPALARRLLLGVWLAALVLAVPAAVYRHLWGGRVCQLCHPSPVHAAAHLSLETLTAFVLPFGTVLGCYGVTLARLRGARWGSGRQGTRVGRLVSAIVLAFGLLWAPYHAVNLLQAVAALAPPEGPLARLGGAGQAARAGTTALAFFSSSVNPVLYVFTAGDLLPRAGPRFLTRLFEGSGEARGGSRSREGTMELRTTPKLKVMGQGRGNGDPGGGDGGKTEKDSQEW

SEQ ID NO: 636 - protein, 325 aa, Homo sapiens
MDGSNVTSFVVEEPTNISTGRNASVGNAHRQIPIVHWVIMSISPVGFVENGILLWFLCFRMRRNPFTVYITHLSIADISLLFCIFILSIDYALDYELSSGHYYTIVTLSVTFLFGYNTGLYLLTAISVERCLSVLYPIWYRCHRPKYQSALVCALLWALSCLVTTMEYVMCIDREEESHSRNDCRAVIIFIAILSFLVFTPLMLVSSTILVVKIRKNTWASHSSKLYIVIMVTIIIFLIFAMPMRLLYLLYYEYWSTFGNLHHISLLFSTINSSANPFIYFFVGSSKKKRFKESLKVVLTRAFKDEMQPRRQKDNCNTVTVETVV

SEQ ID NO: 637 - protein, 324 aa, Mus musculus
MDQSNMTSLAEEKAMNTSSRNASLGSSHPPIPIVHWVIMSISPLGFVENGILLWFLCFRMRRNPFTVYITHLSMADISLLFCIFILSIDYALDYELSSGHHYTIVTLSVTFLFGYNTGLYLLTAISVERCLSVLYPIWYTSHRPKHQSAFVCALLCALSCLVTTMEYVMCIDSGEESHSRSDCRAVIIFIAILSFLVFTPLMLVSSSILVVKIRKNTWASHSSKLYIVIMVTIIIFLIFAMPMRVLYLLYYEYWSAFGNLHNISLLFSTINSSANPFIYFFVGSSKKKRFRESLKVVLTRAFKDEMQPRRQEGNGNTVSIETVV

SEQ ID NO: 638 - protein, 317 aa, Homo sapiens
MAVQGSQRRLLGSLNSTPTAIPQLGLAANQTGARCLEVSISDGLFLSLGLVSLVENALVVATIAKNRNLHSPMYCFICCLALSDLLVSGSNVLETAVILLLEAGALVARAAVLQQLDNVIDVITCSSMLSSLCFLGAIAVDRYISIFYALRYHSIVTLPRARRAVAAIWVASVVFSTLFIAYYDHVAVLLCLVVFFLAMLVLMAVLYVHMLARACQHAQGIARLHKRQRPVHQGFGLKGAVTLTILLGIFFLCWGPFFLHLTLIVLCPEHPTCGCIFKNFNLFLALIICNAIIDPLIYAFHSQELRRTLKEVLTCSW

SEQ ID NO: 639 - protein, 315 aa, Mus musculus
MSTQEPQKSLLGSLNSNATSHLGLATNQSEPWCLYVSIPDGLFLSLGLVSLVENVLVVIAITKNRNLHSPMYYFICCLALSDLMVSVSIVLETTIILLLEVGILVARVALVQQLDNLIDVLICGSMVSSLCFLGIIAIDRYISIFYALRYHSIVTLPRARRAVVGIWMVSIVSSTLFITYYKHTAVLLCLVTFFLAMLALMAILYAHMFTRACQHVQGIAQLHKRRRSIRQGFCLKGAATLTILLGIFFLCWGPFFLHLLLIVLCPQHPTCSCIFKNFNLFLLLIVLSSTVDPLIYAFRSQELRMTLKEVLLCSW

SEQ ID NO: 640 - protein, 297 aa, Homo sapiens
MKHIINSYENINNTARNNSDCPRVVLPEEIFFTISIVGVLENLIVLLAVFKNKNLQAPMYFFICSLAISDMLGSLYKILENILIILRNMGYLKPRGSFETTADDIIDSLFVLSLLGSIFSLSVIAADRYITIFHALRYHSIVTMRRTVVVLTVIWTFCTGTGITMVIFSHHVPTVITFTSLFPLMLVFILCLYVHMFLLARSHTRKISTLPRANMKGAITLTILLGVFIFCWAPFVLHVLLMTFCPSNPYCACYMSLFQVNGMLIMCNAVIDPFIYAFRSPELRDAFKKMIFCSRYW

SEQ ID NO: 641 - protein, 296 aa, Mus musculus
MKHIINSYEHTNDTARNNSDCPDVVLPEEIFFTISVIGILENLIVLLAVIKNKNLQSPMYFFICSLAISDMLGSLYKILENILIMFRNMGYLKPRGSFESTADDIIDCMFILSLLGSIFSLSVIAADRYITIFHALQYHSIVTMRRTIITLTIIWMFCTGSGITMVIFSHHIPTVLTFTSLFPLMLVFILCLYIHMFLLARSHARKISTLPRTNMKGAMTLTILLGVFIFCWAPFVLHVLLMTFCPNNPYCVCYMSLFQVNGMLIMCNAVIDPFIYAFRSPELRDAFKRMLFCNRY

SEQ ID NO: 642 - protein, 360 aa, Homo sapiens [sequence omitted]

SEQ ID NO: 643 - protein, 323 aa, Mus musculus
MNSSCCLSSVSPMLPNLSEHPAAPPASNRSGSGFCEQVFIKPEVFLALGIVSLMENILVILAVVRNGNLHSPMYFFLCSLAAADMLVSLSNSLETIMIAVINSDSLTLEDQFIQHMDNIFDSMICISLVASICNLLAIAIDRYVTIFYALRYHSIMTVRKALTLIGVIWVCCGICGVMFIIYSESKMVIVCLITMFFAMVLLMGTLYIHMFLFARLHVQRIAVLPPAGVVAPQQHSCMKGAVTITILLGVFIFCWAPFFLHLVLIITCPTNPYCICYTAHFNTYLVLIMCNSVIDPLIYAFRSLELRNTFKEILCGCNSMNLG

SEQ ID NO: 644 - protein, 332 aa, Homo sapiens
MVNSTHRGMHTSLHLWNRSSYRLHSNASESLGKGYSDGGCYEQLFVSPEVFVTLGVISLLENILVIVAIAKNKNLHSPMYFFICSLAVADMLVSVSNGSETIIITLLNSTDTDAQSFTVNIDNVIDSVICSSLLASICSLLSIAVDRYFTIFYALQYHNIMTVKRVGIIISCIWAACTVSGILFIIYSDSSAVIICLITMFFTMLALMASLYVHMFLMARLHIKRIAVLPGTGAIRQGANMKGAITLTILIGVFVVCWAPFFLHLIFYISCPQNPYCVCFMSHFNLYLILIMCNSIIDPLIYALRSQELRKTFKEIICCYPLGGLCDLSSRY

SEQ ID NO: 645 - protein, 332 aa, Mus musculus
MNSTHHHGMYTSLHLWNRSSYGLHSNASESLGKGHPDGGCYEQLFVSPEVFVTLGVISLLENILVIVAIAKNKNLHSPMYFFICSLAVADMLVSVSNGSETIVITLLNSTDTDAQSFTVNIDNVIDSVICSSLLASICSLLSIAVDRYFTIFYALQYHNIMTVRRVGIIISCIWAACTVSGVLFIIYSDSSAVIICLISMFFTMLVLMASLYVHMFLMARLHIKRIAVLPGTGTIRQGTNMKGAITLTILIGVFVVCWAPFFLHLLFYISCPQNPYCVCFMSHFNLYLILIMCNAVIDPLIYALRSQELRKTFKEIICFYPLGGICELSSRY

SEQ ID NO: 646 - protein, 325 aa, Homo sapiens
MNSSFHLHFLDLNLNATEGNLSGPNVKNKSSPCEDMGIAVEVFLTLGVISLLENILVIGAIVKNKNLHSPMYFFVCSLAVADMLVSMSSAWETITIYLLNNKHLVIADAFVRHIDNVFDSMICISVVASMCSLLAIAVDRYVTIFYALRYHHIMTARRSGAIIAGIWAFCTGCGIVFILYSESTYVILCLISMFFAMLFLLVSLYIHMFLLARTHVKRIAALPGASSARQRTSMQGAVTVTMLLGVFTVCWAPFFLHLTLMLSCPQNLYCSRFMSHFNMYLILIMCNSVMDPLIYAFRSQEMRKTFKEIICCRGFRIACSFPRRD

SEQ ID NO: 647 - protein, 325 aa, Mus musculus
MNSSSTLTVLNLTLNASEDGILGSNVKNKSLACEEMGIAVEVFLTLGLVSLLENILVIGAIVKNKNLHSPMYFFVGSLAVADMLVSMSNAWETVTIYLLNNKHLVIADTFVRHIDNVFDSMICISVVASMCSLLAIAVDRYITIFYALRYHHIMTARRSGVIIACIWTFCISCGIVFIIYYESKYVIICLISMFFTMLFFMVSLYIHMFLLARNHVKRIAASPRYNSVRQRTSMKGAITLTMLLGIFIVCWSPFFLHLILMISCPQNVYCSCFMSYFNMYLILIMCNSVIDPLIYALRSQEMRRTFKEIVCCHGFRRPCRLLGGY

SEQ ID NO: 648 - protein, 321 aa, Homo sapiens
MNQTLNSSGTVESALNYSRGSTVHTAYLVLSSLAMFTCLCGMAGNSMVIWLLGFRMHRNPFCIYILNLAAADLLFLFSMASTLSLETQPLVNTTDKVHELMKRLMYFAYTVGLSLLTAISTQRCLSVLFPIWFKCHRPRHLSAWVCGLLWTLCLLMNGLTSSFCSKFLKFNEDRCFRVDMVQAALIMGVLTPVMTLSSLTLFVWVRRSSQQWRRQPTRLFVVVLASVLVFLICSLPLSIYWFVLYWLSLPPEMQVLCFSLSRLSSSVSSSANPVIYFLVGSRRSHRLPTRSLGTVLQQALREEPELEGGETPTVGTNEMGA

SEQ ID NO: 649 - protein, 321 aa, Mus musculus
MNSTLDSSPAPGLTISPTMDLVTWIYFSVTFLAMATCVGGMAGNSLVIWLLSCNGMQRSPFCVYVLNLAVADFLFLFCMASMLSLETGPLLIVNISAKIYEGMRRIKYFAYTAGLSLLTAISTQRCLSVLFPIWYKCHRPRHLSSVVSGALWALAFLMNFLASFFCVQFWHPNKHQCFKVDIVFNSLILGIFMPVMILTSTILFIRVRKNSLMQRRRPRRLYVVILTSILVFLTCSLPLGINWFLLYWVDVKRDVRLLYSCVSRFSSSLSSSANPVIYFLVGSQKSHRLQESLGAVLGRALRDEPEPEGRETPSTCTNDGV

SEQ ID NO: 650 - protein, 312 aa, Homo sapiens
MMEPREAGQHVGAANSAQEDVAFNLIILSLTEGLGLGGLLGNGAVLWLLSSNVYRNPFAIYLLDVACADLIFLGCHMVAIVPDLLQGRLDFPGFVQTSLATLRFFCYIVGLSLLAAVSVEQCLAALFPAWYSCRRPRHLTTCVCALTWALCLLLHLLLSSACTQFFGEPSRHLCRTLWLVAAVLLALLCCTMCGASLMLLLRVERGPQRPPPRGFPGLILLTVLLFLFCGLPFGIYWLSRNLLWYIPHYFYHFSFLMAAVHCAAKPVVYFCLGSAQGRRLPLRLVLQRALGDEAELGAVRETSRRGLVDIAA

SEQ ID NO: 651 - protein, 310 aa, Mus musculus
MTSLSVHTDSPSTQGEMAFNLTILSLTELLSLGGLLGNGVALWLLNQNVYRNPFSIYLLDVACADLIFLCCHMVAIIPELLQDQLNFPEFVHISLTMLRFFCYIVGLSLLAAISTEQCLATLFPAWYLCRRPRYLTTCVCALIWVLCLLLDLLLSGACTQFFGAPSYHLCDMLWLVVAVLLAALCCTMCVTSLLLLLRVERGPERHQPRGFPTLVLLAVLLFLFCGLPFGIFWLSKNLSWHIPLYFYHFSFFMASVHSAAKPAIYFFLGSTPGQRFREPLRLVLQRALGDEAELGAGREASQGGLVDMTV

SEQ ID NO: 652 - protein, 343 aa, Homo sapiens
MAGNCSWEAHPGNRNKMCPGLSEAPELYSRGFLTIEQIAMLPPPAVMNYIFLLLCLCGLVGNGLVLWFFGFSIKRNPFSIYFLHLASADVGYLFSKAVFSILNTGGFLGTFADYIRSVCRVLGLCMFLTGVSLLPAVSAERCASVIFPAWYWRRRPKRLSAVVCALLWVLSLLVTCLHNYFCVFLGRGAPGAACRHMDIFLGILLFLLCCPLMVLPCLALILHVECRARRRQRSAKLNHVILAMVSVFLVSSIYLGIDWFLFWVFQIPAPFPEYVTDLCICINSSAKPIVYFLAGRDKSQRLWEPLRVVFQRALRDGAELGEAGGSTPNTVTMEMQCPPGNAS

SEQ ID NO: 653 - protein, 343 aa, Mus musculus
MAGNCSWEAHSTNQNKMCPGMSEARELYSRGFLTIEQIATLPPPAVTNYIFLLLCLCGLVGNGLVLWFFGFSIKRTPFSIYFLHLASADGMYLFSKAVIALLNMGTFLGSFPDYIRRVSRIVGLCTFFTGVSLLPAISIERCVSVIFPTWYWRRRPKRLSAGVCALLWMLSFLVTSIHNYFCMFLGHEAPGTVCRNMDIALGILLFFLFCPLMVLPCLALILHVECRARRRQRSAKLNHVVLAIVSVFLVSSIYLGIDWFLFWVFQIPAPFPEYVTDLCICINSSAKPIVYFLAGRDKSQRLWEPLRVVFQRALRDGAEPGDAASSTPNTVTMEMQCPSGNAS

SEQ ID NO: 654 - protein, 350 aa, Homo sapiens [sequence omitted]

SEQ ID NO: 655 - protein, 353 aa, Mus musculus
MKGNVSELLNATQQAPGGGEGGRPRPSWLASTLAFILIFTIVVDILGNLLVILSVYRNKKLRNSGNIFVVSLAVADLVVAVYPYPLVLTSILNNGWNLGYLHCQVSAFLMGLSVIGSIFNITGIAMNRYCYICHSLKYDKIYSNKNSLCYVFLIWMLTLIAIMPNLQTGTLQYDPRIYSCTFTQSVSSAYTIAVVVFHFIVPMIIVIFCYLRIWVLVLQVRRRVKPDNKPKLKPQDFRNFVTMFVVFVLFAICWAPLNLIGLIVASDPATMVPRIPEWLFVASYYLAYFNSCLNAIIYGLLNQNFRKEYKKIIVSLCTAKMFFVESSNEEADKIKCKPSPLIPNNNLIKVDSV

SEQ ID NO: 656 - protein, 289 aa, Homo sapiens
MFGLFGLWRTFDSVVFYLTLIVGLGGPVGNGLVLWNLGFRIKKGPFSIYLLHLAAADFLFLSCRVGFSVAQAALGAQDTLYFVLTFLWFAVGLWLLAAFSVERCLSDLFPACYQGCRPRHASAVLCALVWTPTLPAVPLPANACGLLRNSACPLVCPRYHVASVTWFLVLARVAWTAGVVLFVWVTCCSTRPRPRLYGIVLGALLLLFFCGLPSVFYWSLQPLLNFLLPVFSPLATLLACVNSSSKPLIYSGLGRQPGKREPLRSVLRRALGEGAELGARGQSLPMGLL

SEQ ID NO: 657 - protein, 289 aa, Mus musculus
MFSIFNIWGTFNKVLFFLSLTVSLAGLVGNALLLWHLGLHIKKGPFNTYLLHLAAADFLFLSCQVGFSIATIVSGHEDTLYFPVTFLWFAVGLWLLAAFSVDCCLAYMFPSFCSPNRRPRFTSVVLCLVIWALTMPAVLLPANACGLLKNGMSLLVCLKYHWTSVTWLAVLSGMACGASKFLLIFGNCCSSQPPPKFCKLAQCSGILLFFCRLPLVVYWCLRPVLKFLLPFFFPLATLLACIDSSAKPLLYYMKGRQLRKDPLQVALNRALGEESQSGLGGLSLPMHQV

SEQ ID NO: 658 - protein, 390 aa, Homo sapiens
MPSKSLSNLSVTTGANESGSVPEGWERDFLPASDGTTTELVIRCVIPSLYLLIITVGLLGNIMLVKIFITNSAMRSVPNIFISNLAAGDLLLLLTCVPVDASRYFFDEWMFGKVGCKLIPVIQLTSVGVSVFTLTALSADRYRAIVNPMDMQTSGALLRTCVKAMGIWVVSVLLAVPEAVFSEVARISSLDNSSFTACIPYPQTDELHPKIHSVLIFLVYFLIPLAIISIYYYHIAKTLIKSAHNLPGEYNEHTKKQMETRKRLAKIVLVFVGCFIFCWFPNHILYMYRSFNYNEIDPSLGHMIVTLVARVLSFGNSCVNPFALYLLSESFRRHFNSQLCCGRKSYQERGTSYLLSSSAVRMTSLKSNAKNMVTNSVLLNGHSMKQEMAM

SEQ ID NO: 659 - protein, 390 aa, Mus musculus
MPPRSLSNLSFPTEANESELVPEVWEKDFLPDSDGTTAELVIRCVIPSLYLIIISVGLLGNIMLVKIFLTNSAMRNVPNIFISNLAAGDLLLLLTCVPVDASRYFFDEWVFGKLGCKLIPAIQLTSVGVSVFTLTALSADRYRAIVNPMDMQTSGVLLWTSLKAVGIWVVSVLLAVPEAVFSEVARIGSLDNSSFTACIPYPQTDELHPKIHSVLIFLVYFLIPLVIISIYYYHIAKTLIKSAHNLPGEYNEHTKKQMETRKRLAKIVLVFVGCFVFCWFPNHVLYLYRSFNYKEIDPSLGHMIVTLVARVLSFSNSCVNPFALYLLSESFRKHFNSQLCCGRKSYPERSTSYLLSSSAVRMTSLKSNTKNVVTNSVLLNGHSTKQEIAL

SEQ ID NO: 660 - protein, 415 aa, Homo sapiens [sequence omitted]

SEQ ID NO: 661 - protein, 395 aa, Mus musculus
MGKLENASWIHDSLMKYLNSTEEYLAYLCGPKRSDLSLPVSVVYALIFVVGVIGNLLVCLVIARHQTLKTPTNYYLFSLAVSDLLVLLLGMPLEVYELWHNYPFLFGPVGCYFKTALFETVCFASILSVTTVSIERYVAIVHPFRAKLESTRRRALRILSLVWSFSVVFSLPNTSIHGIKFQQFPNGSSVPGSATCTVTKPMWVYNFIIQATSFLFYILPMTLISVLYYLMGLRLKRDESLEADKVTVNIHRPSRKSVTKMLFVLVLVFAICWTPFHVDRLFFSFVDEWTESLAAVFNLIHVVSGVFFYLSSAVNPIIYNLLSRRFRAAFRNVVSPSCKWCHPQHRPQGPPAQKVIFLTECHLVELTEDAGPQFPCQSSIHNTQLTTVPCVEEVP

SEQ ID NO: 662 - protein, 384 aa, Homo sapiens
MNSTLFSQVENHSVHSNFSEKNAQLLAFENDDCHLPLAMIFTLALAYGAVIILGVSGNLALIIIILKQKEMRNVTNILIVNLSFSDLLVAIMCLPFTFVYTLMDHWVFGEAMCKLNPFVQCVSITVSIFSLVLIAVERHQLIINPRGWRPNNRHAYVGIAVIWVLAVASSLPFLIYQVMTDEPFQNVTLDAYKDKYVCFDQFPSDSHRLSYTTLLLVLQYFGPLCFIFICYFKIYIRLKRRNNMMDKMRDNKYRSSETKRINIMLLSIVVAFAVCWLPLTIFNTVFDWNHQIIATCNHNLLFLLCHLTAMISTCVNPIFYGFLNKNFQRDLQFFFNFCDFRSRDDDYETIAMSTMHTDVSKTSLKQASPVAFKKINNNDDNEKI

SEQ ID NO: 663 - protein, 382 aa, Mus musculus
MNSTLFSKVENHSIHYNASENSPLLAFENDDCHLPLAVIFTLALAYGAVIILGVSGNLALIIIILKQKEMRNVTNILIVNLSFSDLLVAVMCLPFTFVYTLMDHWVFGETMCKLNPFVQCVSITVSIFSLVLIAVERHQLIINPRGWRPNNRHAYIGITVIWVLAVASSLPFVIYQILTDEPFQNVSLAAFKDKYVCFDKFPSDSHRLSYTTLLLVLQYFGPLCFIFICYFKIYIRLKRRNNMMDKIRDSKYRSSETKRINIMLLSIVVAFAVCWLPLTIFNTVFDWNHQIIATCNHNLLFLLCHLTAMISTCVNPIFYGFLNKNFQRDLQFFFNFCDFRSRDDDYETIAMSTMHTDVSKTSLKQASPVAFKKISMNDNEKV

SEQ ID NO: 664 - protein, 381 aa, Homo sapiens
MGPIGAEADENQTVEEMKVEQYGPQTTPRGELVPDPEPELIDSTKLIEVQVVLILAYCSIILLGVIGNSLVIHVVIKFKSMRTVTNFFIANLAVADLLVNTLCLPFTLTYTLMGEWKMGPVLCHLVPYAQGLAVQVSTITLTVIALDRHRCIVYHLESKISKRISFLIIGLAWGISALLASPLAIFREYSLIEIIPDFEIVACTEKWPGEEKSIYGTVYSLSSLLILYVLPLGIISFSYTRIWSKLKNHVSPGAANDHYHQRRQKTTKMLVCVVVVFAVSWLPLHAFQLAVDIDSQVLDLKEYKLIFTVFHIIAMCSTFANPLLYGWMNSNYRKAFLSAFRCEQRLDAIHSEVSVTFKAKKNLEVRKNSGPNDSFTEATNV

SEQ ID NO: 665 - protein, 385 aa, Mus musculus
MVLKMGPVGAEADENQTVEVKVEPYGPGHTTPRGELPPDPEPELIDSTKLVEVQVILILAYCSIILLGVVGNSLVIHVVIKFKSMRTVTNFFIANLAVADLLVNTLCLPFTLTYTLMGEWKMGPVLCHLVPYAQGLAVQVSTITLTVIALDRHRCIVYHLESKISKRISFLIIGLAWGISALLASPLAIFREYSLIEIIPDFEIVACTEKWPGEEKSVYGTVYSLSTLLILYVLPLGIISFSYTRIWSKLRNHVSPGAASDHYHQRRHKMTKMLVCVVVVFAVSWLPLHAFQLAVDIDSHVLDLKEYKLIFTVFHIIAMCSTFANPLLYGWMNSNYRKAFLSAFRCEQRLDAIHSEVSMTFKAKKNLEVKKNNGPTDSFSEATNV

SEQ ID NO: 666 - protein, 455 aa, Homo sapiens
MSFYSKQDYNMDLELDEYYNKTLATENNTAATRNSDFPVWDDYKSSVDDLQYFLIGLYTFVSLLGFMGNLLILMALMKKRNQKTTVNFLIGNLAFSDILVVLFCSPFTLTSVLLDQWMFGKVMCHIMPFLQCVSVLVSTLILISIAIVRYHMIKHPISNNLTANHGYFLIATVWTLGFAICSPLPVFHSLVELQETFGSALLSSRYLCVESWPSDSYRIAFTISLLLVQYILPLVCLTVSHTSVCRSISCGLSNKENRLEENEMINLTLHPSKKSGPQVKLSGSHKWSYSFIKKHRRRYSKKTACVLPAPERPSQENHSRILPENFGSVRSQLSSSSKFIPGVPTCFEIKPEENSDVHELRVKRSVTRIKKRSRSVFYRLTILILVFAVSWMPLHLFHVVTDFNDNLISNRHFKLVYCICHLLGMMSCCLNPILYGFLNNGIKADLVSLIHCLHM

SEQ ID NO: 667 - protein, 466 aa, Mus musculus
MEVKLEEHFNKTFVTENNTAASQNTASPAWEDYRGTENNTSAARNTAFPVWEDYRGSVDDLQYFLIGLYTFVSLLGFMGNLLILMAVMKKRNQKTTVNFLIGNLAFSDILVVLFCSPFTLTSVLLDQWMFGKAMCHIMPFLQCVSVLVSTLILISIAIVRYHMIKHPISNNLTANHGYFLIATVWTLGFAICSPLPVFHSLVELKETFGSALLSSKYLCVESWPSDSYRIAFTISLLLVQYILPLVCLTVSHTSVCRSISCGLSHKENRLEENEMINLTLHPSKKSRDQAKPPSTQKWSYSFIRKHRRRYSKKTACVLPAPAGPSQEKHLTVPENPGSVRSQLSPSSKVIPGVPICFEVKPEESSDAQEMRVKRSLTRIKKRSRSVFYRLTILILVFAVSWMPLHVFHVVTDFNDNLISNRHFKLVYCICHLLGMMSCCLNPILYGFLNNGIKADLRALIHCLHMS

SEQ ID NO: 668 - protein, 290 aa, Homo sapiens [sequence omitted]

SEQ ID NO: 669 - protein, 371 aa, Mus musculus
MEVLTNQPTPNKTSGKSNNSAFFYFESCQPPFLAILLLLIAYTVILIMGIFGNLSLIIIIFKKQREAQNVTNILIANLSLSDILVCVMCIPFTVIYTLMDHWVFGNTMCKLTSYVQSVSVSVSIFSLVLIAIERYQLIVNPRGWKPRVAHAYWGIILIWLISLTLSIPLFLSYHLTNEPFHNLSLPTDIYTHQVACVEIWPSKLNQLLFSTSLFMLQYFVPLGFILICYLKIVLCLRKRTRQVDRRKENKSRLNENKRVNVMLISIVVTFGACWLPLNIFNVIFDWYHEMLMSCHHDLVFVVCHLIAMVSTCINPLFYGFLNKNFQKDLMMLIHHCWCGEPQESYENIAMSTMHTDESKGSLKLAHIPTGI

SEQ ID NO: 670 - protein, 418 aa, Homo sapiens
MRLNSSAPGTPGTPAADPFQRAQAGLEEALLAPGFGNASGNASERVLAAPSSELDVNTDIYSKVLVTAVYLALFVVGTVGNTVTAFTLARKKSLQSLQSTVHYHLGSLALSDLLTLLLAMPVELYNFIWVHHPWAFGDAGCRGYYFLRDACTYATALNVASLSVERYLAICHPFKAKTLMSRSRTKKFISAIWLASALLTVPMLFTMGEQNRSADGQHAGGLVCTPTIHTATVKVVIQVNTFMSFIFPMVVISVLNTIIANKLTVMVRQAAEQGQVCTVGGEHSTFSMAIEPGRVQALRHGVRVLRAVVIAFVVCWLPYHVRRLMFCYISDEQWTPFLYDFYHYFYMVTNALFYVSSTINPILYNLVSANFRHIFLATLACLCPVWRRRRKRPAFSRKADSVSSNHTLSSNATRETLY

SEQ ID NO: 671 - protein, 424 aa, Mus musculus
MHLNSSVQQGAPSEPGAQPFPHPQFGLETMLLALSLSNGSGNSSESILEPNSNLDVNTDIYSKVLVTAVYLALFVVGTVGNSVTAFTLARKKSLQSLQSTVHYHLGSLALSDLLILLLAMPVELYNFIWVHHPWAFGDAGCRGYYFLRDACTYATALNVASLSVERYLAICHPFKAKTLMSRSRTKKFISAIWLASALLAVPMLFTMGLQNRSADGQHPGGLVCTPTVDTATVKVVIQVNTFMSFLFPMLIISILNTVIANKLTVMVHQAAEQGRGVCTVGTHNSLEHSTFNMSIEPGRVQALRHGVLVLRAVVIAFVVCWLPYHVRRLMFCYISDEQWTTFLFDFYHYFYMLTNALFYVSSAINPILYNLVSANFRQVFLSTLACLCPGWRRRRKKRPTFSRKPNSMSSNHAFSTSATRETLY

SEQ ID NO: 672 - protein, 410 aa, Homo sapiens
METSSPRPPRPSSNPGLSLDARLGVDTRLWAKVLFTALYALIWALGAAGNALSVHVVLKARAGRAGRLRHHVLSLALAGLLLLLVGVPVELYSFVWFHYPWVFGDLGCRGYYFVHELCAYATVLSVAGLSAERCLAVCQPLRARSLLTPRRTRWLVALSWAASLGLALPMAVIMGQKHELETADGEPEPASRVCTVLVSRTALQVFIQVNVLVSFVLPLALTAFLNGVTVSHLLALCSQVPSTSTPGSSTPSRLELLSEEGLLSFIVWKKTFIQGGQVSLVRHKDVRRIRSLQRSVQVLRAIVVMYVICWLPYHARRLMYCYVPDDAWTDPLYNFYHYFYMVTNTLFYVSSAVTPLLYNAVSSSFRKLFLEAVSSLCGEHHPMKRLPPKPQSPTLMDTASGFGDPPETRT

SEQ ID NO: 673 - protein, 417 aa, Mus musculus
METSSLWPPRPSPSAGLSLEARLGVDTRLWAKVLFTALYSLIFALGTAGNALSVHVVLKARTGRPGRLRYHVLSLALSALLLLLISVPMELYNFVWSHYPWVFGDLGCRGYYFVRELCAYATVLSVASLSAERCLAVCQPLRARRLLTPRRTCRLLSLVWVASLGLALPMAVIMGQKHEMERADGEPEPASRVCTVLVSRASSRSTFQVKRAGLLRSPLWELTAILNGITVNHLVALYSQVPSASAQVNSIPSRLELLSEEGLLGFITWRKTLSLGVQASLVRHKDASQIRSLQHSAQVLRAIVAVYVICWLPYHARRLMYCYIPDDGWTDELYDFYHYFYMVTNTLFYVSSAVTPVLYNAVSSSFRKLFLESLSSLCGEQRSVVPLPQEAPESTTSTYSFRLWGSPRNPSLGEIQV

SEQ ID NO: 674 - protein, 404 aa, Homo sapiens
MASPRLGTFCCPTRDAATQLVLSFQPRAFHALCLGSGGLRLALGLLQLLPGRRPAGPGSPATSPPASVRILRAAAACDLLGCLGMVIRSTVWLGFPNFVDSVSDMNHTEIWPAAFCVGSAMWIQLLYSACFWWLFCYAVDAYLVIRRSAGLSTILLYHIMAWGLATLLCVEGAAMLYYPSVSRCERGLDHAIPHYVTMYLPLLLVLVANPILFQKTVTAVASLLKGRQGIYTENERRMGAVIKIRFFKIMLVLIICWLSNIINESLLFYLEMQTDINGGSLKPVRTAAKTTWFIMGILNPAQGFLLSLAFYGWTGCSLGFQSPRKEIQWESLTTSAAEGAHPSPLMPHENPASGKVSQVGGQTSDEALSMLSEGSDASTIEIHTASESCNKNEGDPALPTHGDL

SEQ ID NO: 675 - protein, 405 aa, Mus musculus
MASPRLGIFCCPTWDAATQLVLSFQPRVFHALCLGSGTLRLVLGLLQLLSGRRSVGHRAPATSPAASVHILRAATACDLLGCLGIVIRSTVWIAYPEFIENISNVNATDIWPATFCVGSAMWIQLLYSACFWWLFCYAVDVYLVIRRSAGRSTILLYHIMAWGLAVLLCVEGAVMLYYPSVSRCERGLDHAIPHYVTTYLPLLLVLVANPILFHKTVTSVASLLKGRKGVYTENERLMGAVIKTRFFKIMLVLIACWLSNIINESLLFYLEMQPDIHGGSLKRIQNAARTTWFIMGILNPAQGLLLSLAFYGWTGCSLDVHPPKMVIQWETMTASAAEGTYQTPVRSCVPHQNPRKVVCVGGHTSDEVLSILSEDSDASTVEIHTATGSCNIKEVDSISQAQGEL

SEQ ID NO: 676 - protein, 364 aa, Homo sapiens
MAQQWSLQRLAGRHPQDSYEDSTQSSIFTYTNSNSTRGPFEGPNYHIAPRWVYHLTSVWMIFVVIASVFTNGLVLAATMKFKKLRHPLNWILVNLAVADLAETVIASTISVVNQVYGYFVLGHPMCVLEGYTVSLCGITGLWSLAIISWERWMVVCKPFGNVRFDAKLAIVGIAFSWIWAAVWTAPPIFGWSRYWPHGLKTSCGPDVFSGSSYPGVQSYMIVLMVTCCITPLSIIVLCYLQVWLAIRAVAKQQKESESTQKAEKEVTRMVVVMVLAFCFCWGPYAFFACFAAANPGYPFHPLMAALPAFFAKSATIYNPVIYVFMNRQFRNCILQLFGKKVDDGSELSSASKTEVSSVSSVSPA

SEQ ID NO: 677 - protein, 359 aa, Mus musculus
MAQRLTGEQTLDHYEDSTHASIFTYTNSNSTKGPFEGPNYHIAPRWVYHLTSTWMILVVVASVFTNGLVLAATMRFKKLRHPLNWILVNLAVADLAETIIASTISVVNQIYGYFVLGHPLCVIEGYIVSLCGITGLWSLAIISWERWLVVCKPFGNVRFDAKLATVGIVFSWVWAAIWTAPPIFGWSRYWPYGLKTSCGPDVFSGTSYPGVQSYMMVLMVTCCIFPLSIIVLCYLQVWLAIRAVAKQQKESESTQKAEKEVTRMVVVMVFAYCLCWGPYTFFACFATAHPGYAFHPLVASLPSYFAKSATIYNPIIYVFMNRQFRNCILHLFGKKVDDSSELSSTSKTEVSSVSSVSPA

SEQ ID NO: 678 - protein, 348 aa, Homo sapiens
MRKMSEEEFYLFKNISSVGPWDGPQYHIAPVWAFYLQAAFMGTVFLIGFPLNAMVLVATLRYKKLRQPLNYILVNVSFGGFLLCIFSVFPVFVASCNGYFVFGRHVCALEGFLGTVAGLVTGWSLAFLAFERYIVICKPFGNFRFSSKHALTVVLATWTIGIGVSIPPFFGWSRFIPEGLQCSCGPDWYTVGTKYRSESYTWFLFIFCFIVPLSLICFSYTQLLRALKAVAAQQQESATTQKAEREVSRMVVVMVGSFCVCYVPYAAFAMYMVNNRNHGLDLRLVTIPSFFSKSACIYNPIIYCFMNKQFQACIMKMVCGKAMTDESDTCSSQKTEVSTVSSTQVGPN

SEQ ID NO: 679 - protein, 346 aa, Mus musculus
MSGEDDFYLFQNISSVGPWDGPQYHLAPVWAFRLQAAFMGFVFFVGTPLNAIVLVATLHYKKLRQPLNYILVNVSLGGFLFCIFSVFTVFIASCHGYFLFGRHVCALEAFLGSVAGLVTGWSLAFLAFERYVVICKPFGSIRFNSKHALMVVLATWIIGIGVSIPPFFGWSRFIPEGLQCSCGPDWYTVGTKYRSEYYTWFLFIFCFIIPLSLICFSYSQLLRTLRAVAAQQQESATTQKAEREVSHMVVVMVGSFCLCYVPYAALAMYMVNNRNHGLDLRLVTIPAFFSKSSCVYNPIIYCFMNKQFRACILEMVCRKPMADESDVSGSQKTEVSTVSSSKVGPH

SEQ ID NO: 680 - protein, 403 aa, Homo sapiens
MYSGNRSGGHGYWDGGGAAGAEGPAPAGTLSPAPLFSPGTYERLALLLGSIGLLGVGNNLLVLVLYYKFQRLRTPTHLLLVNISLSDLLVSLFGVTFTFVSCLRNGWVWDTVGCVWDGFSGSLFGIVSIATLTVLAYERYIRVVHARVINFSWAWRAITYIWLYSLAWAGAPLLGWNRYILDVHGLGCTVDWKSKDANDSSFVLFLFLGCLVVPLGVIAHCYGHILYSIRMLRCVEDLQTIQVIKILKYEKKLAKMCFLMIFTFLVCWMPYIVICFLVVNGHGHLVTPTISIVSYLFAKSNTVYNPVIYVFMIRKFRRSLLQLLCLRLLRCQRPAKDLPAAGSEMQIRPIVMSQKDGDRPKKKVTFNSSSIIFIITSDESLSVDDSDKTIGVQSLMLIQVRPL

SEQ ID NO: 681 - protein, 400 aa, Mus musculus
MYSGNRSGDQGYWEDGAGAEGAAPAGTRSPAPLFSPTAYERLALLLGCLALLGVGGNLLVLLLYSKFPRLRTPTHLFLVNLSLGDLLVSLFGVTFTFASCLRNGWVWDAVGCAWDGFSGSLFGFVSITTLTVLAYERYIRVVHARVINFSWAWRAITYIWLYSLAWAGAPLLGWNRYILDIHGLGCTVDWRSKDANDSSFVLFLFLGCLVVPVGIIAHCYGHILYSVRMLRCVEDLQTIQVIKMLRYEKKVAKMCFLMAFVFLTCWMPYIVTRFLVVNGYGHLVTPTVSIVSYLFAKSSTVYNPVIYIFMNRKFRRSLLQLLCFRLLRCQRPAKNLPAAESEMHIRPIVMSQKDGDRPKKKVTFNSSSIIFIITSDESLSVEDSDRSSASKVDVIQVRPL

SEQ ID NO: 682 - protein, 478 aa, Homo sapiens
MNPPSGPRVPPSPTQEPSCMATPAPPSWWDSSQSSISSLGRLPSISPTAPGTWAAAWVPLPTVDVPDHAHYTLGTVILLVGLTGMLGNLTVIYTFCRSRSLRTPANMFIINLAVSDFLMSFTQAPVFFTSSLYKQWLFGETGCEFYAFCGALFGISSMITLTAIALDRYLVITRPLATFGVASKRRAAFVLLGVWLYALAWSLPPFFGWSAYVPEGLLTSCSWDYMSFTPAVRAYTMLLCCFVFFLPLLIIIYCYIFIFRAIRETGRALQTFGACKGNGESLWQRQRLQSECKMAKIMLLVILLFVLSWAPYSAVALVAFAGYAHVLTPYMSSVPAVIAKASAIHNPIIYAITHPKYRVAIAQHLPCLGVLLGVSRRHSRPYPSYRSTHRSTLTSHTSNLSWISIRRRQESLGSESEVGWTHMEAAAVWGAAQQANGRSLYGQGLEDLEAKAPPRPQGHEAETPGKTKGLIPSQDPRM

SEQ ID NO: 683 - protein, 521 aa, Mus musculus
MDSPSGPRVLSSLTQDPSFTTSPALQGIWNGTQNVSVRAQLLSVSPTTSAHQAAAWVPFPTVDVPDHAHYTLGTVILLVGLTGMLGNLTVIYTFCRNRGLRTPANMFIINLAVSDFLMSVTQAPVFFASSLYKKWLFGETGCEFYAFCGAVFGITSMITLTAIAMDRYLVITRPLATIGRGSKRRTALVLLGVWLYALAWSLPPFFGWSAYVPEGLLTSCSWDYMTFTPQVRAYTMLLFCFVFFLPLLIIIFCYIFIFRAIRETGRACEGCGESPLRQRRQWQRLQSEWKMAKVALIVILLFVLSWAPYSTVALVAFAGYSHILTPYMSSVPAVIAKASAIHNPIIYAITHPKYRVAIAQHLPCLGVLLGVSGQRSHPSLSYRSTHRSTLSSQSSDLSWISGRKRQESLGSESEVGWTDTETTAAWGAAQQASGQSFCSQNLEDGELKASSSPQVQRSKTPKVPGPSTCRPMKGQGARPSSLRGDQKGRLAVCTGLSECPHPHTSQFPLAFLEDDVTLRHL

SEQ ID NO: 684 - protein, 372 aa, Homo sapiens
MEPAPSAGAELQPPLFANASDAYPSAFPSAGANASGPPGPGSASSLALAIAITALYSAVCAVGLLGNVLVMFGIVRYTKMKTATNIYIFNLALADALATSTLPFQSAKYLMETWPFGELLCKAVLSIDYYNMFTSIFTLTMMSVDRYIAVCHPVKALDFRTPAKAKLINICIWVLASGVGVPIMVMAVTRPRDGAVVCMLQFPSPSWYWDTVTKICVFLFAFVVPILIITVCYGLMLLRLRSVRLLSGSKEKDRSLRRITRMVLVVVGAFVVCWAPIHIFVIVWTLVDIDRRDPLVVAALHLCIALGYANSSLNPVLYAFLDENFKRCFRQLCRKPCGRPDPSSFSRPREATARERVTACTPSDGPGGGRAA

SEQ ID NO: 685 - protein, 372 aa, Mus musculus
MELVPSARAELQSSPLVNLSDAFPSAFPSAGANASGSPGARSASSLALAIAITALYSAVCAVGLLGNVLVMFGIVRYTKLKTATNIYIFNLALADALATSTLPFQSAKYLMETWPFGELLCKAVLSIDYYNMFTSIFTLTMMSVDRYIAVCHPVKALDFRTPAKAKLINICIWVLASGVGVPIMVMAVTQPRDGAVVCMLQFPSPSWYWDTVTKICVFLFAFVVPILIITVCYGLMLLRLRSVRLLSGSKEKDRSLRRITRMVLVVVGAFVVCWAPIHIFVIVWTLVDINRRDPLVVAALHLCIALGYANSSLNPVLYAFLDENFKRCFRQLCRTPCGRQEPGSLRRPRQATTRERVTACTPSDGPGGGAAA

SEQ ID NO: 686 - protein, 380 aa, Homo sapiens
MESPIQIFRGEPGPTCAPSACLPPNSSAWFPGWAEPDSNGSAGSEDAQLEPAHISPAIPVIITAVYSVVFVVGLVGNSLVMFVIIRYTKMKTATNIYIFNLALADALVTTTMPFQSTVYLMNSWPFGDVLCKIVISIDYYNMFTSIFTLTMMSVDRYIAVCHPVKALDFRTPLKAKIINICIWLLSSSVGISAIVLGGTKVREDVDVIECSLQFPDDDYSWWDLFMKICVFIFAFVIPVLIIIVCYTLMILRLKSVRLLSGSREKDRNLRRITRLVLVVVAVFVVCWTPIHIFILVEALGSTSHSTAALSSYYFCIALGYTNSSLNPILYAFLDENFKRCFRDFCFPLKMRMERQSTSRVRNTVQDPAYLRDIDGMNKPV

SEQ ID NO: 687 - protein, 380 aa, Mus musculus
MESPIQIFRGDPGPTCSPSACLLPNSSSWFPNWAESDSNGSVGSEDQQLESAHISPAIPVIITAVYSVVFVVGLVGNSLVMFVIIRYTKMKTATNIYIFNLALADALVTTTMPFQSAVYLMNSWPFGDVLCKIVISIDYYNMFTSIFTLTMMSVDRYIAVCHPVKALDFRTPLKAKIINICIWLLASSVGISAIVLGGTKVREDVDVIECSLQFPDDEYSWWDLFMKICVFVFAFVIPVLIIIVCYTLMILRLKSVRLLSGSREKDRNLRRITKLVLVVVAVFIICWTPIHIFILVEALGSTSHSTAALSSYYFCIALGYTNSSLNPVLYAFLDENFKRCFRDFCFPIKMRMERQSTNRVRNTVQDPASMRDVGGMNKPV

SEQ ID NO: 688 - protein, 370 aa, Homo sapiens
MEPLFPAPFWEVIYGSHLQGNLSLLSPNHSLLPPHLLLNASHGAFLPLGLKVTIVGLYLAVCVGGLLGNCLVMYVILRHTKMKTATNIYIFNLALADTLVLLTLPFQGTDILLGFWPFGNALCKTVIAIDYYNMFTSTFTLTAMSVDRYVAICHPIRALDVRTSSKAQAVNVAIWALASVVGVPVAIMGSAQVEDEEIECLVEIPTPQDYWGPVFAICIFLFSFIVPVLVISVCYSLMIRRLRGVRLLSGSREKDRNLRRITRLVLVVVAVFVGCWTPVQVFVLAQGLGVQPSSETAVAILRFCTALGYVNSCLNPILYAFLDENFKACFRKFCCASALRRDVQVSDRVRSIAKDVALACKTSETVPRPA

SEQ ID NO: 689 - protein, 367 aa, Mus musculus
MESLFPAPFWEVLYGSHFQGNLSLLNETVPHHLLLNASHSAFLPLGLKVTIVGLYLAVCIGGLLGNCLVMYVILRHTKMKTATNIYIFNLALADTLVLLTLPFQGTDILLGFWPFGNALCKTVIAIDYYNMFTSTFTLTAMSVDRYVAICHPIRALDVRTSSKAQAVNVAIWALASVVGVPVAIMGSAQVEDEEIECLVEIPAPQDYWGPVFAICIFLFSFIIPVLIISVCYSLMIRRLRGVRLLSGSREKDRNLRRITRLVLVVVAVFVGCWTPVQVFVLVQGLGVQPGSETAVAILRFCTALGYVNSCLNPILYAFLDENFKACFRKFCCASALHREMQVSDRVRSIAKDVGLGCKTSETVPRPA

SEQ ID NO: 690 - protein, 400 aa, Homo sapiens
MDSSAAPTNASNCTDALAYSSCSPAPSPGSWVNLSHLDGNLSDPCGPNRTNLGGRDSLCPPTGSPSMITAITIMALYSIVCVVGLFGNFLVMYVIVRYTKMKTATNIYIFNLALADALATSTLPFQSVNYLMGTWPFGTILCKIVISIDYYNMFTSIFTLCTMSVDRYIAVCHPVKALDFRTPRNAKIINVCNWILSSAIGLPVMFMATTKYRQGSIDCTLTFSHPTWYWENLVKICVFIFAFIMPVLIITVCYGLMILRLKSVRMLSGSKEKDRNLRRITRMVLVVVAVFIVCWTPIHIYVIIKALVTIPETTFQTVSWHFCIALGYTNSCLNPVLYAFLDENFKRCFREFCIPTSSNIEQQNSTRIRQNTRDHPSTANTVDRTNHQLENLEAETAPLP

SEQ ID NO: 691 - protein, 398 aa, Mus musculus
MDSSAGPGNISDCSDPLAPASCSPAPGSWLNLSHVDGNQSDPCGPNRTGLGGSHSLCPQTGSPSMVTAITIMALYSIVCVVGLFGNFLVMYVIVRYTKMKTATNIYIFNLALADALATSTLPFQSVNYLMGTWPFGNILCKIVISIDYYNMFTSIFTLCTMSVDRYIAVCHPVKALDFRTPRNAKIVNVCNWILSSAIGLPVMFMATTKYRQGSIDCTLTFSHPTWYWENLLKICVFIFAFIMPVLIITVCYGLMILRLKSVRMLSGSKEKDRNLRRITRMVLVVVAVFIVCWTPIHIYVIIKALITIPETTFQTVSWHFCIALGYTNSCLNPVLYAFLDENFKRCFREFCIPTSSTIEQQNSARIRQNTREHPSTANTVDRTNHQLENLEAETAPLP

SEQ ID NO: 692 - protein, 389 aa, Homo sapiens [sequence omitted]

SEQ ID NO: 693 - protein, 388 aa, Mus musculus
MEGTPAANWSIELDLGSGVPPGAEGNLTAGPPRRNEALARVEVAVLCLILFLALSGNACVLLALRTTRHKHSRLFFFMKHLSIADLVVAVFQVLPQLLWDITFRFYGPDLLCRLVKYLQVVGMFASTYLLLLMSLDRCLAICQPLRSLRRRTDRLAVLATWLGCLVASVPQVHIFSLREVADGVFDCWAVFIQPWGPKAYVTWITLAVYIVPVIVLAACYGLISFKIWQNLRLKTAAAAAAAEGSDAAGGAGRAALARVSSVKLISKAKIRTVKMTFIIVLAFIVCWTPFFFVQMWSVWDVNAPKEASAFIIAMLLASLNSCCNPWIYMLFTGHLFHELVQRFLCCSARYLKGSRPGETSISKKSNSSTFVLSRCSSSQRSCSQPSSA

SEQ ID NO: 694 - protein, 373 aa, Homo sapiens
MTEVLWPAVPNGTDAAFLAGPGSSWGNSTVASTAAVSSSFKCALTKTGFQFYYLPAVYILVFIIGFLGNSVAIWMFVFHMKPWSGISVYMFNLALADFLYVLTLPALIFYYFNKTDWIFGDAMCKLQRFIFHVNLYGSILFLTCISAHRYSGVVYPLKSLGRLKKKNAICISVLVWLIVVVAISPILFYSGTGVRKNKTITCYDTTSDEYLRSYFIYSMCTTVAMFCVPLVLILGCYGLIVRALIYKDLDNSPLRRKSIYLVIIVLTVFAVSYIPFHVMKTMNLRARLDFQTPAMCAFNDRVYATYQVTRGLASLNSCVDPILYFLAGDTFRRRLSRATRKASRRSEANLQSKSEDMTLNILPEFKQNGDTSL

SEQ ID NO: 695 - protein, 373 aa, Mus musculus
MTEVPWSVVPNGTDAAFLAGLGSLWGNSTVASTAAVSSSFQCALTKTGFQFYYLPAVYILVFIIGFLGNSVAIWMFVFHMKPWSGISVYMFNLALADFLYVLTLPALIFYYFNKTDWIFGDAMCKLQRFIFHVNLYGSILFLTCISAHRYSGVVYPLKSLGRLKKKNAIYVSVLVWLIVVVAISPILFYSGTGTRKNKTVTCYDTTSNDYLRSYFIYSMCTTVAMFCIPLVLILGCYGLIVKALIYNDLDNSPLRRKSIYLVIIVLTVFAVSYIPFHVMKTMNLRARLDFQTPEMCDFNDRVYATYQVTRGLASLNSCVDPILYFLAGDTFRRRLSRATRKASRRSEANLQSKSEEMTLNILSEFKQNGDTSL

SEQ ID NO: 696 - protein, 342 aa, Homo sapiens
MQAVDNLTSAPGNTSLCTRDYKITQVLFPLLYTVLFFVGLITNGLAMRIFFQIRSKSNFIIFLKNTVISDLLMILTFPFKILSDAKLGTGPLRTFVCQVTSVIFYFTMYISISFLGLITIDRYQKTTRPFKTSNPKNLLGAKILSVVIWAFMFLLSLPNMILTNRQPRDKNVKKCSFLKSEFGLVWHEIVNYICQVIFWINFLIVIVCYTLITKELYRSYVRTRGVGKVPRKKVNVKVFIIIAVFFICFVPFHFARIPYTLSQTRDVFDCTAENTLFYVKESTLWLTSLNACLDPFIYFFLCKSFRNSLISMLKCPNSATSLSQDNRKKEQDGGDPNEETPM

SEQ ID NO: 697 - protein, 347 aa, Mus musculus
MDVPGVNTTSANTTFSPGTSTLCVRDYKITQVLFPLLYTVLFFAGLITNSLAMRIFFQIRSKSNFIIFLKNTVISDLLMILTFPFKILSDAKLGAGPLRTLVCQVTSVTFYFTMYISISFLGLITIDRYLKTTRPFKTSSPSNLLGAKILSVVIWAFMFLISLPNMILTNRRPKDKDVTKCSFLKSEFGLVWHEIVNYICQVIFWINFLIVIVCYSLITKELYRSYVRTRGSAKVPKKKVNVKVFIIIAVFFICFVPFHFARIPYTLSQTRAVFDCSAENTLFYVKESTLWLTSLNACLDPFIYFFLCKSFRNSLTSMLRCSNSTSTSGTNKKKGQEGGEPSEETPM

SEQ ID NO: 698 - protein, 377 aa, Homo sapiens [sequence omitted]

SEQ ID NO: 699 - protein, 373 aa, Mus musculus
MAADLEPWNSTINGTWEGDELGYKCRFNEDFKYVLLPVSYGVVCVLGLCLNVVALYIFLCRLKTWNASTTYMFHLAVSDSLYAASLPLLVYYYARGDHWPFSTVLCKLVRFLFYTNLYCSILFLTCISVHRCLGVLRPLHSLRWGRARYARRVAAVVWVLVLACQAPVLYFVTTSVRGTRITCHDTSARELFSHFVAYSSVMLGLLFAVPFSVILVCYVLMARRLLKPAYGTTGGLPRAKRKSVRTIALVLAVFALCFLPFHVTRTLYYSFRSLDLSCHTLNAINMAYKITRPLASANSCLDPVLYFLAGQRLVRFARDAKPPTEPTPSPQARRKLGLHRPNRTVRKDLSVSSDDSRRTESTPAGSETKDIRL

SEQ ID NO: 700 - protein, 365 aa, Homo sapiens
MASTESSLLRSLGLSPGPGSSEVELDCWFDEDFKFILLPVSYAVVFVLGLGLNAPTLWLFIFRLRPWDATATYMFHLALSDTLYVLSLPTLIYYYAAHNHWPFGTEICKFVRFLFYWNLYCSVLFLTCISVHRYLGICHPLRALRWGRPRLAGLLCLAVWLVVAGCLVPNLFFVTTSNKGTTVLCHDTTRPEEFDHYVHFSSAVMGLLFGVPCLVTLVCYGLMARRLYQPLPGSAQSSSRLRSLRTIAVVLTVFAVCFVPFHITRTIYYLARLLEADCRVLNIVNVVYKVTRPLASANSCLDPVLYLLTGDKYRRQLRQLCGGGKPQPRTAASSLALVSLPEDSSCRWAATPQDSSCSTPRADRL

SEQ ID NO: 701 - protein, 361 aa, Mus musculus
MTSADSLLFTSLGPSPSSGDGDCKFNEEFKFILLPLSYAVVFVLGLALNAPTLWLFLFRLRPWDATATYMFHLALSDTLYVLSLPTLVYYYAARNHWPFGTGFCKFVRFLFYWNLYCSVLFLTCISVHRYMGICHPLRAIRWGRPRFAGLLCLGVWLVVAGCLVPNLFFVTTNANGTTILCHDTTLPEEFDHYVYFSSTIMVLLFGFPFLITLVCYGLMARRLYRPLPGAGQSSSRLRSLRTIAVVLTVFAVCFVPFHITRTIYYLARLLNAECRVLNIVNVVYKVTRPLASANSCLDPVLYLFTGDKYRNQLQQLCRGSTPKRRTTASSLALVTLHEESISRWADIHQDSIFPAYEGDRL

SEQ ID NO: 702 - protein, 328 aa, Homo sapiens
MEWDNGTGQALGLPPTTCVYRENFKQLLLPPVYSAVLAAGLPLNICVITQICTSRRALTRTAVYTLNLALADLLYACSLPLLIYNYAQGDHWPFGDFACRLVRFLFYANLHGSILFLTCISFQRYLGICHPLAPWHKRGGRRAAWLVCVAVWLAVTTQCLPTAIFAATGIQRNRTVCYDLSPPALATHYMPYGMALTVIGFLLPFAALLACYCLLACRLCRQDGPAEPVAQERRGKAARMAVVVAAAFAISFLPFHITKTAYLAVRSTPGVPCTVLEAFAAAYKGTRPFASANSVLDPILFYFTQKKFRRRPHELLQKLTAKWQRQGR

SEQ ID NO: 703 - protein, 328 aa, Mus musculus
MEQDNGTIQAPGLPPTTCVYREDFKRLLLTPVYSVVLVVGLPLNICVIAQICASRRTLTRSAVYTLNLALADLMYACSLPLLIYNYARGDHWPFGDLACRFVRFLFYANLHGSILFLTCISFQRYLGICHPLASWHKRGGRRAAWVVCGVVWLAVTAQCLPTAVFAATGIQRNRTVCYDLSPPILSTRYLPYGMALTVIGFLLPFIALLACYCRMARRLCRQDGPAGPVAQERRSKAARMAVVVAAVFAISFLPFHITKTAYLAVRSTPGVSCPVLETFAAAYKGTRPFASVNSVLDPILFYFTQQKFRRQPHDLLQRLTAKWQRQRV

SEQ ID NO: 704 - protein, 339 aa, Homo sapiens
MANLDKYTETFKMGSNSTSTAEIYCNVTNVKFQYSLYATTYILIFIPGLLANSAALWVLCRFISKKNKAIIFMINLSVADLAHVLSLPLRIYYYISHHWPFQRALCLLCFYLKYLNMYASICFLTCISLQRCFFLLKPFRARDWKRRYDVGISAAIWIVVGTACLPFPILRSTDLNNNKSCFADLGYKQMNAVALVGMITVAELAGFVIPVIIIAWCTWKTTISLRQPPMAFQGISERQKALRMVFMCAAVFFICFTPYHINFIFYTMVKETIISSCPVVRIALYFHPFCLCLASLCCLLDPILYYFMASEFRDQLSRHGSSVTRSRLMSKESGSSMIG

SEQ ID NO: 705 - protein, 328 aa, Mus musculus
MGSNSTSSAESNCNATYLPFQYSLYATTYIFIFIPGLLANSAALWVLCRFISKKNKAIIFMINLSVADLAHILSLPLRIYYYINRHWPFQRALCLLCFYLKYLNMYASIFFLTCISLQRCLFLLKPFRARNWKRRYDVGISAVIWIVVGTACLPFPILRNAGLANSTDSCFADLGYKQMDAVVLVTMVVIAELAGFVIPVITIACCTWKTTVSLKHPPIAFQGISERKKALRMVFMCAAVFVICFTPYHINFIFYTMVKESIITSCPTVKSTLYFHPFSLCLASLCCLLDPILYYFMASEFRDQLSRHGSSVTRSRLMSRESGSSMVN

SEQ ID NO: 706 - protein, 344 aa, Homo sapiens
MVSVNSSHCFYNDSFKYTLYGCMFSMVFVLGLVSNCVAIYIFICVLKVRNETTTYMINLAMSDLLFVFTLPFRIFYFTTRNWPFGDLLCKISVMLFYTNMYGSILFLTCISVDRFLAIVYPFKSKTLRTKRNAKIVCTGVWLTVIGGSAPAVFVQSTHSQGNNASEACFENFPEATWKTYLSRIVIFIEIVGFFIPLILNVTCSSMVLKTLTKPVTLSRSKINKTKVLKMIFVHLIIFCFCFVPYNINLILYSLVRTQTFVNCSVVAAVRTMYPITLCIAVSNCCFDPIVYYFTSDTIQNSIKMKNWSVRRSDFRFSEVHGAENFIQHNLQTLKSKIFDNESAA

SEQ ID NO: 707 - protein, 344 aa, Mus musculus
MVSSNGSQCPYDDSFKYTLYGCMFSMVFVLGLISNCVAIYIFICALKVRNETTTYMINLAMSDLLFVFTLPFRIFYFATRNWPFGDLLCKISVMLFYTNMYGSILFLTCISVDRFLAIVYPFKSKTLRTKRNAKIVCIAVWFTVMGGSAPAVFFQSTHSQGNNTSEACFENFPAATWKTYLSRIVIFIEIVGFFIPLILNVTCSSMVLRTLNKPVTLSRSKMNKTKVLKMIFVHLVIFCFCFVPYNINLILYSLMRTQTFVNCSVVAAVRTMYPITLCIAVSNCCFDPIVYYFTSDTIQNSIKMKNWSVRRSDSRFSEVQGTENFIQHNLQTLKNKIFDNESAI

SEQ ID NO: 708 - protein, 333 aa, Homo sapiens
MWSCSWFNGTGLVEELPACQDLQLGLSLLSLLGLVVGVPVGLCYNALLVLANLHSKASMTMPDVYFVNMAVAGLVLSALAPVHLLGPPSSRWALWSVGGEVHVALQIPFNVSSLVAMYSTALLSLDHYIERALPRTYMASVYNTRHVCGFVWGGALLTSFSSLLFYICSHVSTRALECAKMQNAEAADATLVFIGYVVPALATLYALVLLSRVRREDTPLDRDTGRLEPSAHRLLVATVCTQFGLWTPHYLILLGHTVIISRGKPVDAHYLGLLHFVKDFSKLLAFSSSFVTPLLYRYMNQSFPSKLQRLMKKLPCGDRHCSPDHMGVQQVLA

SEQ ID NO: 709 - protein, 333 aa, Mus musculus
MWSCGPLNSTAWAEEPLCRNLRLGLWVLSLLYLGAGVPVSLGYNALLVLANLASKNTMTMPDVYFVNMAVAGLVLTALAPAYLLGPAHSRWALWSLSSEAHVTLLILFNVASLVTMYSTALLSLDYYIERALPRTYMASVYNTRHVCGFVWGGAVLTSFSSLLFYICSHVSSRIAECARMQNTEAADAILVVIGYVVPGLAVLYALALISRIGKEDTPLDQDTSRLDPSVHRLLVATVCTQFGLWTPYYLSLGHTVLTSRGRTVEGHYLGILQVAKDLAKFLAFSSSSVTPLLYRYINKAFPGKLRRLMKKMHCGRRHCSPDPSGIQQVMAQA

SEQ ID NO: 710 - protein, 337 aa, Homo sapiens
MRAVFIQGAEEHPAAFCYQVNGSCPRTVHTLGIQLVIYLTCAAGMLIIVLGNVFVAFAVSYFKALHTPTNFLLLSLALADMFLGLLVLPLSTIRSVESCWFFGDFLCRLHTYLDTLFCLTSIFHLCFISIDRHCAICDPLLYPSKFTVRVALRYILAGWGVPAAYTSLFLYTDVVETRLSQWLEEMPCVGSCQLLLNKFWGWLNFPLFFVPCLIMISLYVKIFVVATRQAQQITTLSKSLAGAAKHERKAAKTLGIVVGIYLLCWLPFTIDTMVDSLLHFITPPLVFDIFIWFAYFNSACNPIIYVFSYQWFRKALKLTLSQKVFSPQTRTVDLYQE

SEQ ID NO: 711 - protein, 337 aa, Mus musculus
MRAVLLPGSGEQPTAFCYQVNGSCPRTVHPLAIQVVIYLACAVGVLITVLGNLFVVFAVSYFKVLHTPTNFLLLSLALADMLLGLLVLPLSTVRSVESCWFFGDFLCRLHTYLDTLFCLTSIFHLCFISIDRHCAICDPLLYPSKFTVRTALRYIVAGWGIPAAYTAFFLYTDVVERALSQWLEEMPCVGSCQLLFNKFWGWLNFPAFFVPCLIMISLYLKIFVVATRQAQQIRTLSQSLAGAVKRERKAAKTLGIAVGIYLVCWLPFTVDTLVDSLLNFITPPLVFDIFIWFAYFNSACNPIIYVFSYRWFRKALKLLLSREIFSPRTPTVDLYHD

SEQ ID NO: 712 - protein, 375 aa, Homo sapiens
MNTSHLLALLLPKSPQGENRSKPLGTPYNFSEHCQDSVDVMVFIVTSYSIETVVGVLGNLCLMCVTVRQKEKANVTNLLIANLAFSDFLMCLLCQPLTAVYTIMDYWIFGETLCKMSAFIQCMSVTVSILSLVLVALERHQLIINPTGWKPSISQAYLGIVLIWVIACVLSLPFLANSILENVFHKNHSKALEFLADKVVCTESWPLAHHRTIYTTFLLLFQYCLPLGFILVCYARIYRRLQRQGRVFHKGTYSLRAGHMKQVNVVLVVMVVAFAVLWLPLHVFNSLEDWHHEAIPICHGNLIFLVCHLLAMASTCVNPFIYGFLNTNFKKEIKALVLTCQQSAPLEESEHLPLSTVHTEVSKGSLRLSGRSNPI

SEQ ID NO: 713 - protein, 375 aa, Mus musculus
MNTSHFLAPLFPGSLQGKNGTNPLDSPYNFSDGCQDSAELLAFIITTYSIETILGVLGNLCLIFVTTRQKEKSNVTNLLIANLAFSDFLMCLICQPLTVTYTIMDYWIFGEVLCKMLTFIQCMSVTVSILSLVLVALERHQLIINPTGWKPSIFQAYLGIVVIWFISCFLSLPFLANSTLNDLFHYNHSKVVEFLEDKVVCFVSWSSDHHRLIYTTFLLLFQYCIPLAFILVCYIRIYQRLQRQKHVFHAHACSSRAGQMKRINSMLMTMVTAFAVLWLPLHVFNTLEDWYQEAIPACHGNLIFLMCHLLAMASTCVNPFIYGFLNINFKKDIKALVLTCHCRSPQGESEHLPLSTVHTDLSKGSMRMGSKSNFI

SEQ ID NO: 714 - protein, 342 aa, Homo sapiens
MEPHDSSHMDSEFRYTLFPIVYSIIFVLGVIANGYVLWVFARLYPCKKFNEIKIFMVNLTMADMLFLITLPLWIVYYQNQGNWILPKFLCNVAGCLFFINTYCSVAFLGVITYNRFQAVTRPIKTAQANTRKRGISLSLVIWVAIVGAASYFLILDSTNTVPDSAGSGNVTRCFEHYEKGSVPVLIIHIFIVFSFFLVFLIILFCNLVIIRTLLMQPVQQQRNAEVKRRALWMVCTVLAVFIICFVPHHVVQLPWTLAELGFQDSKFHQAINDAHQVTLCLLSTNCVLDPVIYCFLTKKFRKHLTEKFYSMRSSRKCSRATTDTVTEVVVPFNQIPGNSLKN

SEQ ID NO: 715 - protein, 341 aa, Mus musculus
MEHNGSFRVDSEFRYTLFPIVYSVIFILGVVANGYVLWVFANLYPSKKLNEIKIFMVNLTMADLLFLITLPLWIVYYYNEGDWILPNFLCNVAGCLFFINTYCSVAFLGVITYNRYQAVAYPIKTAQATTRKRGISLSLIIWVSIVATASYFLATDSTNLVPNKDGSGNITRCFEHYEPYSVPILVVHVFIAFCFFLVFFLIFYCNLVIIHTLLTQPMRQQRKAGVKRRALWMVCTVLAVFIICFVPHHVVQLPWTLAELGYQTNFHQAINDAHQITLCLLSTNCVLDPVIYCFLTKKFRKHLSEKFYSMRSSRKCSRATSDTCTEVIVPANQTPIVSLKN

SEQ ID NO: 716 - protein, 359 aa, Homo sapiens
MKSPFYRCQNTTSVEKGNSAVMGGVLFSTGLLGNLLALGLLARSGLGWCSRRPLRPLPSVFYMLVCGLTVTDLLGKCLLSPVVLAAYAQNRSLRVLAPALDNSLCQAFAFFMSFFGLSSTLQLLAMALECWLSLGHPFFYRRHITLRLGALVAPVVSAFSLAFCALPFMGFGKFVQYCPGTWCFIQMVHEEGSLSVLGYSVLYSSLMALLVLATVLCNLGAMRNLYAMHRRLQRHPRSCTRDCAEPRADGREASPQPLEELDHLLLLALMTVLFTMCSLPVIYRAYYGAFKDVKEKNRTSEEAEDLRALRFLSVISIVDPWIFIIFRSPVFRIFFHKIFIRPLRYRSRCSNSTNMESSL

SEQ ID NO: 717 - protein, 357 aa, Mus musculus
MNESYRCQTSTWVERGSSATMGAVLFGAGLLGNLLALVLLARSGLGSCRPGPLHPPPSVFYVLVCGLTVTDLLGKCLISPMVLAAYAQNQSLKELLPASGNQLCETFAFLMSFFGLASTLQLLAMAVECWLSLGHPFFYQRHVTLRRGVLVAPVVAAFCLAFCALPFAGFGKFVQYCPGTWCFIQMIHKERSFSVIGFSVLYSSLMALLVLATVVCNLGAMYNLYDMHRRQRHYPHRCSRDRAQSGSDYRHGSLHPLEELDHFVLLALMTVLFTMCSLPLIYRAYYGAFKLENKAEGDSEDLQALRFLSVISIVDPWIFIIFRTSVFRMLFHKVFTRPLIYRNWSSHSQQSNVESTL

SEQ ID NO: 718 - protein, 402 aa, Homo sapiens
MSPCGPLNLSLAGEATTCAAPWVPNTSAVPPSGASPALPIFSMTLGAVSNLLALALLAQAAGRLRRRRSATTFLLFVASLLATDLAGHVIPGALVLRLYTAGRAPAGGACHFLGGCMVFFGLCPLLLGCGMAVERCVGVTRPLLHAARVSVARARLALAAVAAVALAVALLPLARVGRYELQYPGTWCFIGLGPPGGWRQALLAGLFASLGLVALLAALVCNTLSGLALHRARWRRRSRRPPPASGPDSRRRWGAHGPRSASASSASSIASASTFFGGSRSSGSARRARAHDVEMVGQLVGIMVVSCICWSPMLVLVALAVGGWSSTSLQRPLFLAVRLASWNQILDPWVYILLRQAVLRQLLRLLPPRAGAKGGPAGLGLTPSAWEASSLRSSRHSGLSHF

SEQ ID NO: 719 - protein, 405 aa, Mus musculus
MSPCGLNLSLADEAATCATPRLPNTSVVLPTGDNGTSPALPIFSMTLGAVSNVLALALLAQVAGRMRRRRSAATFLLFVASLLAIDLAGHVIPGALVLRLYTAGRAPAGGACHFLGGCMVFFGLCPLLLGCGMAVERCVGVTQPLIHAARVSVARARLALAVLAAMALAVALLPLVHVGRYELQYPGTWCFISLGPRGGWRQALLAGLFAGLGLAALLAALVCNTLSGLALLRARWRRRRSRRFRKTAGPDDRRRWGSRGPRLASASSASSITSATATLRSSRGGGSARRVHAHDVEMVGQLVGIMVVSCICWSPLLVLVVLAIGGWNSNSLQRPLFLAVRLASWNQILDPWVYILLRQAMLRQLLRLLPLRVSAKGGPTELGLTKSAWEASSLRSSRHSGFSHL

SEQ ID NO: 720 - protein, 358 aa, Homo sapiens
MGNASNDSQSEDCETRQWLPPGESPAISSVMFSAGVLGNLIALALLARRWRGDVGCSAGRRSSLSLFHVLVTELVFTDLLGTCLISPVVLASYARNQTLVALAPESRACTYFAFAMTFFSLATMLMLFAMALERYLSIGHPYFYQRRVSASGGLAVLPVIYAVSLLFCSLPLLDYGQYVQYCPGTWCFIRHGRTAYLQLYATLLLLLIVSVLACNFSVILNLIRMHRRSRRSRCGPSLGSGRGGPGARRRGERVSMAEETDHLILLAIMTITFAVCSLPFTIFAYMNETSSRKEKWDLQALRFLSINSIIDPWVFAILRPPVLRLMRSVLCCRISLRTQDATQTSCSTQSDASKQADL

SEQ ID NO: 721 - protein, 362 aa, Mus musculus
MDNFLNDSKLMEDCKSRQWLLSGESPAISSVMFSAGVLGNLIALALLARRWRGDTGCSAGSRTSISLFHVLVTELVLTDLLGTCLISPVVLASYSRNQTLVALAPESHACTYFAFTMTFFSLATMLMLFAMALERYLSIGYPYFYRRHLSRRGGLAVLPVIYGASLLFCSLPLLNYGEYVQYCPGTWCFIRHGRTAYLQLYATMLLLLIVAVLACNISVILNLIRMHRRSRRSRCGLSGSSLRGPGSRRRGERTSMAEETDHLILLAIMTITFAICSLPFTIFAYMDETSSLKEKWDLRALRFLSVNSIIDPWVFAILRPPVLRLMRSVLCCRTSLRTQEAQQTSCSTQSSASKQTDLCGQL

SEQ ID NO: 722 - protein, 402 aa, Homo sapiens
MKETRGYGGDAPFCTRLNHSYTGMWAPERSAEARGNLTRPPGSGEDCGSVSVAFPITMLLTGFVGNALAMLLVSRSYRRRESKRKKSFLLCIGWLALTDLVGQLLTTPVVIVVYLSKQRWEHIDPSGRLCTFFGLTMTVFGLSSLFIASAMAVERALAIRAPHWYASHMKTRATRAVLLGVWLAVLAFALLPVLGVGQYTVQWPGTWCFISTGRGGNGTSSSHNWGNLFFASAFAFLGLLALTVTFSCNLATIKALVSRCRAKATASQSSAQWGRITTETAIQLMGIMCVLSVCWSPLLIMMLKMIFNQTSVEHCKTHTEKQKECNFFLIAVRLASLNQILDPWVYLLLRKILLRKFCQMRKRRLREQEMGPDGRCFCHAWRQVPRTWCSSHDREPCSVQLS

SEQ ID NO: 723 - protein, 365 aa, Mus musculus
MASMWAPEHSAEAHSNLSSTTDDCGSVSVAFPITMMVTGFVGNALAMLLVSRSYRRRESKRKKSFLLCIGWLALTDLVGQLLTSPVVILVYLSQRRWEQLDPSGRLCTFFGLTMTVFGLSSLLVASAMAVERALAIRAPHWYASHMKTRATPVLLGVWLSVLAFALLPVLGVGRYSVQWPGTWCFISTGPAGNETDPAREPGSVAFASAFACLGLLALVVTFACNLATIKALVSRCRAKAAVSQSSAQWGRITTETAIQLMGIMCVLSVCWSPLLIMMLKMIFNQMSVEQCKTQMGKEKECNSFLIAVRLASLNQILDPWVYLLLRKILLRKFCQIRDHTNYASSSTSLPCPGSSALMWSDQLER

SEQ ID NO: 724 - protein, 488 aa, Homo sapiens
MSTPGVNSSASLSPDRLNSPVTIPAVMFIFGVVGNLVAIVVLCKSRKEQKETTFYTLVCGLAVTDLLGTLLVSPVTIATYMKGQWPGGQPLCEYSTFILLFFSLSGLSIICAMSVERYLAINHAYFYSHYVDKRLAGLTLFAVYASNVLFCALPNMGLGSSRLQYPDTWCFIDWTTNVTAHAAYSYMYAGFSSFLILATVLCNVLVCGALLRMHRQFMRRTSLGTEQHHAAAAASVASRGHPAASPALPRLSDFRRRRSFRRIAGAEIQMVILLIATSLVVLICSIPLVVRVFVNQLYQPSLEREVSKNPDLQAIRIASVNPILDPWIYILLRKTVLSKAIEKIKCLFCRIGGSRRERSGQHCSDSQRTSSAMSGHSRSFISRELKEISSTSQTLLPDLSLPDLSENGLGGRNLLPGVPGMGLAQEDTTSLRTLRISETSDSSQGQDSESVLLVDEAGGSGRAGPAPKGSSLQVTFPSETLNLSEKCI

SEQ ID NO: 725 - protein, 513 aa, Mus musculus
MAEVGGTIPRSNRELQRCVLLTTTIMSIPGVNASFSSTPERLNSPVTIPAVMFIFGVVGNLVAIVVLCKSRKEQKETTFYTLVCGLAVTDLLGTLLVSPVTIATYMKGQWPGDQALCDYSTFILLFFGLSGLSIICAMSIERYLAINHAYFYSHYVDKRLAGLTLFAIYASNVLFCALPNMGLGRSERQYPGTWCFIDWTTNVTAYAAFSYMYAGFSSFLILATVLCNVLVCGALLRMHRQFMRRTSLGTEQHHAAAAAAVASVACRGHAGASPALQRLSDFRRRRSFRRIAGAEIQMVILLIATSLVVLICSIPLVVRVFINQLYQPNVVKDISRNPDLQAIRIASVNPILDPWIYILLRKTVLSKAIEKIKCLFCRIGGSGRDSSAQHCSESRRTSSAMSGHSRSFLARELKEISSTSQTLLYLPDLTESSLGGRNLLPGSHGMGLTQADTTSLRTLRISETSDSSQGQDSESVLLVDEVSGSHREEPASKGNSLQVTFPSETLKLSEKCI

SEQ ID NO: 726 - protein, 359 aa, Homo sapiens
MSMNNSKQLVSPAAALLSNTTCQTENRLSVFFSVIFMTVGILSNSLAIAILMKAYQRFRQKSKASFLLLASGLVITDFFGHLINGAIAVFVYASDKEWIRFDQSNVLCSIFGICMVFSGLCPLLLGSVMAIERCIGVTKPIFHSTKITSKHVKMMLSGVCLFAVFIALLPILGHRDYKIQASRTWCFYNTEDIKDWEDRFYLLLFSFLGLLALGVSLLCNAITGITLLRVKFKSQQHRQGRSHHLEMVIQLLAIMCVSCICWSPFLVTMANIGINGNHSLETCETTLFALRMATWNQILDPWVYILLRKAVLKNLYKLASQCCGVHVISLHIWELSSIKNSLKVAAISESPVAEKSAST

SEQ ID NO: 727 - protein, 366 aa, Mus musculus
MSMNSSKQPVSPAAGLIANTTCQTENRLSVFFSIIFMTVGILSNSLAIAILMKAYQRFRQKSKASFLLLASGLVITDFFGHLINGGIAVFVYASDKDWIRFDQSNILCSIFGISMVFSGLCPLFLGSAMAIERCIGVTNPIFHSTKITSKHVKMILSGVCMFAVFVAVLPILGHRDYQIQASRTWCFYNTEHIEDWEDRFYLLFFSFLGLLALGVSFSCNAVTGVTLLRVKFRSQQHRQGRSHHLEMIIQLLAIMCVSCVCWSPFLVTMANIAINGNNSPVTCETTLFALRMATWNQILDPWVYILLRKAVLRNLYKLASRCCGVNIISLHIWELSSIKNSLKVAAISESPAAEKESQQASSEAGL

SEQ ID NO: 728 - protein, 386 aa, Homo sapiens [sequence omitted]

SEQ ID NO: 729 - protein, 415 aa, Mus musculus
MMASDGHPGPPSVTPGSPLSAGGREWQGMAGSCWNITYVQDSVGPATSTLMFVAGVVGNGLALGILGARRRSHPSAFAVLVTGLAVTDLLGTCFLSPAVFVAYARNSSLLGLAHGGTMLCDTFAFAMTFFGLASTLILFAMAVERCLALSHPYLYAQLDGPRCARFALPSIYAFCCLFCSLPLLGLGEHQQYCPGSWCFIRMRSAQPGGCAFSLAYASLMALLVTSIFFCNGSVTLSLYHMYRQQRRHHGSFVPTSRAREDEVYHLILLALMTVIMAVCSLPLMIRGFTQAIAPDSREMGDLLAFRFNAFNPILDPWVFILFRKAVFQRLKFWLCCLCARSVHGDLQAPLSRPASGRRDPPAPTSLQAKEGSWVPLSSWGTGQVAPLTAVPLTGGDGCSVGMPSKSEAIAACSLC

SEQ ID NO: 730 - protein, 593 aa, Homo sapiens
MGTARIAPGLALLLCCPVLSSAYALVDADDVMTKEEQIFLLHRAQAQCEKRLKEVLQRPASIMESDKGWTSASTSGKPRKDKASGKLYPESEEDKEAPTGSRYRGRPCLPEWDHILCWPLGAPGEVVAVPCPDYIYDFNHKGHAYRRCDRNGSWELVPGHNRTWANYSECVKFLTNETREREVFDRLGMIYTVGYSVSLASLTVAVLILAYFRRLHCTRNYIHMHLFLSFMLRAVSIFVKDAVLYSGATLDEAERLTEEELRAIAQAPPPPATAAAGYAGCRVAVTFFLYFLATNYYWILVEGLYLHSLIFMAFFSEKKYLWGFTVFGWGLPAVFVAVWVSVRATLANTGCWDLSSGNKKWIIQVPILASIVLNFILFINIVRVLATKLRETNAGRCDTRQQYRKLLKSTLVLMPLFGVHYIVFMATPYTEVSGTLWQVQMHYEMLFNSFQGFFVAIIYCFCNGEVQAEIKKSWSRWTLALDFKRKARSGSSSYSYGPMVSHTSVTNVGPRVGLGLPLSPRLLPTATTNGHPQLPGHAKPGTPALETLETTPPAMAAPKDDGFLNGSCSGLDEEASGPERPPALLQEEWETVM

SEQ ID NO: 731 - protein, 591 aa, Mus musculus
MGTARIAPSLALLLCCPVLSSAYALVDADDVFTKEEQIFLLHRAQAQCDKLLKEVLHTAANIMESDKGWTPASTSGKPRKEKAPGKFYPESKENKDVPTGSRRRGRPCLPEWDNIVCWPLGAPGEVVAVPCPDYIYDFNHKGHAYRRCDRNGSWEVVPGHNRTWANYSECLKFMTNETREREVFDRLGMIYTVGYSMSLASLTVAVLILAYFRRLHCTRNYIHMHMFLSFMLRAASIFVKDAVLYSGFTLDEAERLTEEELHIIAQVPPPPAAAAVGYAGCRVAVTFFLYFLATNYYWILVEGLYLHSLIFMAFFSEKKYLWGFTIFGWGLPAVFVAVWVGVRATLANTGCWDLSSGHKKWIIQVPILASVVLNFILFINIIRVLATKLRETNAGRCDTRQQYRKLLRSTLVLVPLFGVHYTVFMALPYTEVSGTLWQIQMHYEMLFNSFQGFFVAIIYCFCNGEVQAEIRKSWSRWTLALDFKRKARSGSSSYSYGPMGAHTSVTNVGPRAGLSLPLSPRLLPATTNGHSQLPGHAKPGAPAIENETIPVTMTVPKDDGFLNGSCSGLDEEASGSARPPPLLQEEWETVM

SEQ ID NO: 732 - protein, 550 aa, Homo sapiens
MAGLGASLHVWGWLMLGSCLLARAQLDSDGTITIEEQIVLVLKAKVQCELNITAQLQEGEGNCFPEWDGLICWPRGTVGKISAVPCPPYIYDFNHKGVAFRHCNPNGTWDFMHSLNKTWANYSDCLRFLQPDISIGKQEFFERLYVMYTVGYSISFGSLAVAILIIGYFRRLHCTRNYIHMHLFVSFMLRATSIFVKDRVVHAHIGVKELESLIMQDDPQNSIEATSVDKSQYIGCKIAVVMFIYFLATNYYWILVEGLYLHNLIFVAFFSDTKYLWGFILIGWGFPAAFVAAWAVARATLADARCWELSAGDIKWIYQAPILAAIGLNFILFLNTVRVLATKIWETNAVGHDTRKQYRKLAKSTLVLVLVFGVHYIVFVCLPHSFTGLGWEIRMHCELFFNSFQGFFVSIIYCYCNGEVQAEVKKMWSRWNLSVDWKRTPPCGSRRCGSVLTTVTHSTSSQSQVAASTRMVLISGKAAKIASRQPDSHITLPGYVWSNSEQDCLPHSFHEETKEDSGRQGDDILMEKPSRPMESNPDTEGCQGETEDVL

SEQ ID NO: 733 - protein, 546 aa, Mus musculus
MAWLETFTYICGWLILSSCLLVRAQLDSDGTITIEEQIVLVMKAKMQCELNITAQLQEGEGNCFPEWDGIICWPRGTVGKMSAVPCPPYVYDFNHKGVAFRHCTPNGTWDSIHGSNKTWANYSDCFLQPDINIGKQEFFESLYILYTVGYSISFGSLAVAILIIGYFRRLHCTRNYIHLHLFVSFMLRAMSIFVKDRVAQAHLGVEALQSLVMQGDLQNFIGGPSVDKSQYVGCKIAVVMFIYFLATNYYWILVEGLYLHNLIFVSFFSDTKYLWGFISIGWGFPAVFVVAWAVARATLADTRCWELSAGDRWIYQAPILAAIGLNFILFLNTVRVLATKIWETNAVGHDMRKQYRKLAKSTLVLVLVFGVHYIVFVCQPHSFSGLWWEIRMHCELFFNSFQGFFVSIVYCYCNGEVQAEVKKMWTRWNLSIDWKRAPPCGGQRYGSVLTTVTHSTSSQSQMGASTRLVLISGKPTKNACRQIDSHVTLPGYVWSSSEQDCQTHSPPEETKEGHRRQGDDSPVMESSRPVAFTLDTEGCKGETHPI

SEQ ID NO: 734 - protein, 357 aa, Homo sapiens
MATTVPDGCRNGLKSKYYRLCDKAEAWGIVLETVATAGVVTSVAFMLTLPILVCKVQDSNRRKMLPTQFLFLLGVLGIFGLTFAFIIGLDGSTGPTRFFLFGILFSICFSCLLAHAVSLTKLVRGRKPLSLLVILGLAVGFSLVQDVIAIEYIVLTMNRTNVNVFSELSAPRRNEDFVLLLTYVLFLMALTFLMSSFTFCGSFTGWKRHGAHIYLTMLLSIAIWVAWITLLMLPDFDRRWDDTILSSALAANGWVFLLAYVSPEFWLLTKQRNPMDYPVEDAFCKPQLVKKSYGVENRAYSQEEITQGFEETGDTLYAPYSTHFQLQNQPPQKEFSIPRAHAWPSPYKDYEVKKEGS

SEQ ID NO: 735 - protein, 356 aa, Mus musculus
MTTPRAAPSGCRSDLDSRYHRLCDLAEGWGIALETLAAVGAVATVACMFALVFLICKVQDSNKRKMLPAQFLFLLGVLGVFGLTFAFIIKLDGATGPTRFFLFGVLFAICFSCLLAHAFNLIKLVRGRKPLSWLVILSLAVGFSLVQDVIAIEYLVLTMNRTNVNVFSELPAPRRNEDFVMLLIYVLVLMVLTFFASFLVFCGSFSGWKRHGFHICFTSFLSIAIWVAWIVLLLIPDIDRKWDDTILSTALVANGWVFLAFYILPEFRQLPRQRSPTDYPVEDAFCKPQLMKQSYGVENRAYSQEEITQGLEMGDTLYAPYSTHFQLQNHQKDFSIPRAQAPASPYNDYEGRKGDS

SEQ ID NO: 736 - protein, 362 aa, Homo sapiens
MDLHLFDYAEPGNFSDISWPCNSSDCIVVDTVMCPNMPNKSVLLYTLSFIYIFIFVIGMIANSVVVWVNIQAKTTGYDTHCYILNLAIADLWVVLTIPVWVVSLVQHNQWPMGELTCKVTHLIFSINLFSGIFFLTCMSVDRYLSITYFTNTPSSRKKMVRRVVCILVWLLAFCVSLPDTYYLKTVTSASNNETYCRSFYPEHSIKEWLIGMELVSVVLGFAVPFSIIAVFYFLLARAISASSDQEKHSSRKIIFSYVVVFLVCWLPYHVAVLLDIFSILHYIPFTCRLEHALFTALHVTQCLSLVHCCVNPVLYSFINRNYRYELMKAFIFKYSAKTGLTKLIDASRVSETEYSALEQNAK

SEQ ID NO: 737 - protein, 362 aa, Mus musculus
MDVHLFDYAEPGNYSDINWPCNSSDCIVVDTVQCPTMPNKNVLLYTLSFIYIFIFVIGMIANSVVVWVNIQAKTTGYDTHCYILNLAIADLWVVITTPVWVVSLVQHNQWPMGELTCKITHLIFSINLFGSIFFLACMSVDRYLSITYFTGTSSYKKKMVRRVVCILVWLLAFFVSLPDTYYLKAVTSASNNETYCRSFYPEHSIKEWLIGMELVSVILGFAVPFTIIAIFYFLLARAMSASGDQEKHSSRKIIFSYVVVFLVCWLPYHFVVLLDIFSILHYIPFTCQLENVLFTALHVTQCLSLVHCCVNPVLYSFINRNYRYELMKAFIFKYSAKTGLTKLIDASRVSETEYSALEQNTK

SEQ ID NO: 738 - protein, 291 aa, Homo sapiens
MAETSALPTGFGELEVLAVGMVLLVEALSGLSLNTLTIFSFCKTPELRTPCHLLVLSLALADSGISLNALVAATSSLLRRWPYGSDGCQAHGFQGFVTALASICSSAAIAWGRYHHYCTRSQLAWNSAVSLVLFVWLSSAFWAALPLLGWGHYDYEPLGTCCTLDYSKGDRNFTSFLFTMSFFNFAMPLFITITSYSLMEQKLGKSGHLQVNTTLPARTLLLGWGPYAILYLYAVIADVTSISPKLQMVPALIAKMVPTINAINYALGNEMVCRGIWQCLSPQKREKDRTK

SEQ ID NO: 739 - protein, 291 aa, Mus musculus
MAATRALPAGLGELEVLAVGTVLLMEALSGISLNGLTIFSFCKTPDLRTPSNLLVLSLALADTGISLNALVAAVSSLLRRWPHGSEGCQVHGFQGFATALASICGSAAVAWGRYHHYCTRRQLAWDTAIPLVLFVWMSSAFWASLPLMGWGHYDYEPVGTCCTLDYSRGDRNFISFLFTMAFFNFLVPLFITHTSYRFMEQKFSRSGHLPVNTTLPGRMLLLGWGPYALLYLYAAIADVSFISPKLQMVPALIAKTMPTINAINYALHREMVCRGTWQCLSPQKSKKDRTQ

SEQ ID NO: 740 - protein, 348 aa, Homo sapiens [sequence omitted]

SEQ ID NO: 741 - protein, 348 aa, Mus musculus
MNGTEGPNFYVPFSNVTGVVRSPFEQPQYYLAEPWQFSMLAAYMFLLIVLGFPINFLTLYVTVQHKKLRTPLNYILLNLAVADLFMVFGGFTTTLYTSLHGYFVFGPTGCNLEGFFATLGGEIALWSLVVLAIERYVVVCKPMSNFRFGENHAIMGVVFTWIMALACAAPPLVGWSRYIPEGMQCSCGIDYYTLKPEVNNESFVIYMFVVHFTIPMIVIFFCYGQLVFTVKEAAAQQQESATTQKAEKEVTRMVIIMVIFFLICWLPYASVAFYIFTHQGSNFGPIFMTLPAFFAKSSSIYNPVIYIMLNKQFRNCMLTTLCCGKNPLGDDDASATASKTETSQVAPA

SEQ ID NO: 742 - protein, 337 aa, Homo sapiens
MLRNNLGNSSDSKNEDGSVFSQTEHNIVATYLIMAGMISIISNIIVLGIFIKYKELRTPTNAIIINLAVTDIGVSSIGYPMSAASDLYGSWKFGYAGCQVYAGLNIFFGMASIGLLTVVAVDRYLTICLPDVGRRMTTNTYIGLILGAWINGLFWALMPIIGWASYAPDPTGATCTINWRKNDRSFVSYTMTVIAINFIVPLTVMFYCYYHVTLSIKHHTTSDCTESLNRDWSDQIDVTKMSVIMICMFLVAWSPYSIVCLWASFGDPKKIPPPMAIIAPLFAKSSTFYNPCIYVVANKKFRRAMLAMFKCQTHQTMPVTSILPMDVSQNPLASGRI

SEQ ID NO: 743 - protein, 337 aa, Mus musculus
MLSEASDFNSSGSRSEGSVFSRTEHSVIAAYLIVAGITSILSNVVVLGIFIKYKELRTPTNAVIINLAFTDIGVSSIGYPMSAASDLHGSWKFGHAGCQIYAGLNIFFGMVSIGLLTVVAMDRYLTISCPDVGRRMTTNTYLSMILGAWINGLFWALMPIIGWASYAPDPTGATCTINWRNNDTSFVSYTMMVIVVNFIVPLTVMFYCYYHVSRSLRLYAASDCTAHLHRDWADQADVTKMSVIMILMFLLAWSPYSIVCLWACFGNPKKIPPSMAIIAPLFAKSSTFYNPCIYVAAHKKFRKAMLAMFKCQPHLAVPEPSTLPMDMPQSSLAPVRI

SEQ ID NO: 744 - protein, 469 aa, Homo sapiens
MQMADAATIATMNKAAGGDKLAELFSLVPDLLEAANTSGNASLQLPDLWWELGLELPDGAPPGHPPGSGGAESADTEARVRILISVVYWVVCALGLAGNLLVLYLMKSMQGWRKSSINLFVTNLALTDFQFVLTLPFWAVENALDFKWPFGKAMCKIVSMVTSMNMYASVFFLTAMSVTRYHSVASALKSHRTRGHGRGDCCGRSLGDSCCFSAKALCVWIWALAALASLPSAIFSTTVKVMGEELCLVRFPDKLLGRDRQFWLGLYHSQKVLLGFVLPLGIIILCYLLLVRFIADRRAAGTKGGAAVAGGRPTGASARRLSKVTKSVTIVVLSFFLCWLPNQALTTWSILIKFNAVPFSQEYFLCQVYAFPVSVCLAHSNSCLNPVLYCLVRREFRKALKSLLWRIASPSITSMRPFTATTKPEHEDQGLQAPAPPHAAAEPDLLYYPPGVVVYSGGRYDLLPSSSAY

SEQ ID NO: 745 - protein, 472 aa, Mus musculus
MQVASATPAATVRKAAAGDELSEFFALTPDLLEVANASGNASLQLQDLWWELGLELPDGAAPGHPPGGGGAESTDTEARVRILISAVYWVVCALGLAGNLLVLYLMKSKQGWRKSSINLFVTNLALTDFQFVLTLPFWAVENALDFKWPFGKAMCKIVSMVTSMNMYASVFFLTAMSVARYHSVASALKSHRTRGRGRGDCCGQSLRESCCFSAKVLCGLIWASAALASLPNAIFSTTIRVLGEELCLMHFPDKLLGWDRQFWLGLYHLQKVLLGFLLPLSIISLCYLLLVRFISDRRVVGTTDAVGAAAAPGGGLSTASARRRSKVTKSVTIVVLSFFLCWLPNQALTTWSILIKFNAVPFSQEYFQCQVYAFPVSVCLAHSNSCLNPILYCLVRREFRKALKNLLWRIASPSLTNMRPFTATTKPEPEDHGLQALAPLNAAAEPDLIYYPPGVVVYSGGRYDLLPSSSAY

SEQ ID NO: 746 - protein, 787 aa, Homo sapiens
MAAARPARGPELPLLGLLLLLLLGDPGRGAASSGNATGPGPRSAGGSARRSAAVTGPPPPLSHCGRAAPCEPLRYNVCLGSVLPYGATSTLLAGDSDSQEEAHGKLVLWSGLRNAPRCWAVIQPLLCAVYMPKCENDRVELPSRTLCQATRGPCAIVERERGWPDFLRCTPDRFPEGCTNEVQNIKFNSSGQCEVPLVRTDNPKSWYEDVEGCGIQCQNPLFTEAEHQDMHSYIAAFGAVTGLCTLFTLATFVADWRNSNRYPAVILFYVNACFFVGSIGWLAQFMDGARREIVCRADGTMRLGEPTSNETLSCVIIFVIVYYALMAGVVWFVVLTYAWHTSFKALGTTYQPLSGKTSYFHLLTWSLPFVLTVAILAVAQVDGDSVSGICFVGYKNYRYRAGFVLAPIGLVLIVGGYFLIRGVMTLFSIKSNHPGLLSEKAASKINETMLRLGIFGFLAFGFVLITFSCHFYDFFNQAEWERSFRDYVLCQANVTIGLPTKQPIPDCEIKNRPSLLVEKINLFAMFGTGIAMSTWVWTKATLLIWRRTWCRLTGQSDDEPKRIKKSKMIAKAFSKRHELLQNPGQELSFSMHTVSHDGPVAGLAFDLNEPSADVSSAWAQHVTKMVARRGAILPQDISVTPVATPVPPEEQANLWLVEAEISPELQKRLGRKKKRRKRKKEVCPLAPPPELHPPAPAPSTIPRLPQLPRQKCLVAAGAWGAGDSCRQGAWTLVSNPFCPEPSPPQDPFLPSAPAPVAWAHGRRQGLGPIHSRTNLMDTELMDADSDF

SEQ ID NO: 747 - protein, 793 aa, Mus musculus
MAAGRPVRGPELAPRRLLQLLLLVLLGGPGRGAALSGNVTGPGPHSASGSSRRNVPVTSPPPPLLSHCGRAAHCEPLRYNVCLGSALPYGATTTLLAGDSDSQEEAHGKLVLWSGLRNAPRCWAVIQPLLCAVYMPKCENDRVELPSRTLCQATRGPCAIVERERGWPDFLRCTPDHFPEGCPNEVQNIKFNSSGQCEAPLVRTDNPKSWYEDVEGCGIQCQNPLFTEAEHQDMHSYIAAFGAVTGLCTLFTLATFVADWRNSNRLPAVILFYVNACFFVGSIGWLAQFMDGARREIVCRADGTMRFGEPTSSETLSCVIIFVIVYYALMAGVVWFVVLTYAWHTSFKALGTTYQPLSGKTSYFHLLTWSLPFVLTVAILAVAQVDGDSVSGICFVGYKNYRYRAGFVLAPIGLVLIVGGYFLIRGVMTLFSIKSNHPGLLSEKAASKINETMLRLGIFGFLAFGFVLITFSCHFYDFFNQAEWERSFRDYVLCQANVTIGLPTKKPIPDCEIKNRPSLLVEKINLFAMFGTGIAMSTWVWTKATLLIWRRTWCRLTGHSDDEPKRIKKSKMIAKAFSKRRELLQNPGQELSFSMHTVSHDGPVAGLAFDLNEPSADVSSAWAQHVTKMVARRGAILPQDVSVTPVATPVPPEEQANMWLVEAEISPELEKRLGRKKKRRKRKKEVCPLGPAPELHHSAPVPATSAVPRLPQLPRQKCLVAANAWGTGESCRQGAWTLVSNPFCPEPSPHQDPFLPGASAPRVWAQGRLQGLGSIHSRTNLMEAEILDADSDF

SEQ ID NO: 748 - protein, 391 aa, Homo sapiens
MFPNGTASSPSSSPSPSPGSCGEGGGSRGPGAGAADGMEEPGRNASQNGTLSEGQGSAILISFIYSVVCLVGLCGNSMVIYVILRYAKMKTATNIYILNLAIADELLMLSVPFLVTSTLLRHWPFGALLCRLVLSVDAVNMFTSIYCLTVLSVDRYVAVVHPIKAARYRRPTVAKVVNLGVWVLSLLVILPIVVFSRTAANSDGTVACNMLMPEPAQRWLVGFVLYTFLMGFLLPVGAICLCYVLIIAKMRMVALKAGWQQRKRSERKITLMVMMVVMVFVICWMPFYVVQLVNVFAEQDDATVSQLSVILGYANSCANPILYGFLSDNFKRSFQRILCLSWMDNAAEEPVDYYATALKSRAYSVEDFQPENLESGGVFRNGTCTSRITTL

SEQ ID NO: 749 - protein, 391 aa, Mus musculus
MFPNGTASSPSSSPSPSPGSCGEGACSRGPGSGAADGMEEPGRNASQNGTLSEGQGSAILISFIYSVVCLVGLCGNSMVIYVILRYAKMKTATNIYILNLAIADELLMLSVPFLVTSTLLRHWPFGALLCRLVLSVDAVNMFTSIYCLTVLSVDRYVAVVHPIKAARYRRPTVAKVVNLGVWVLSLLVILPIVVFSRTAANSDGTVACNMLMPEPAQRWLVGFVLYTFLMGFLLPVGAICLCYVLIIAKMRMVALKAGWQQRKRSERKITLMVMMVVMVFVICWMPFYVVQLVNVFAEQDDATVSQLSVILGYANSCANPILYGFLSDNFKRSFQRILCLSWMDNAAEEPVDYYATALKSRAYSVEDFQPENLESGGVFRNGTCASRISTL

SEQ ID NO: 750 - protein, 369 aa, Homo sapiens
MDMADEPLNGSHTWLSIPFDLNGSVVSTNTSNQTEPYYDLTSNAVLTFIYFVVCIIGLCGNTLVIYVILRYAKMKTITNIYILNLAIADELFMLGLPFLAMQVALVHWPFGKAICRVVMTVDGINQFTSIFCLTVMSIDRYLAVVHPIKSAKWRRPRTAKMITMAVWGVSLLVILPIMIYAGLRSNQWGRSSCTINWPGESGAWYTGFIIYTFILGFLVPLTIICLCYLFIIIKVKSSGIRVGSSKRKKSEKKVTRMVSIVVAVFIFCWLPFYIFNVSSVSMAISPTPALKGMFDFVVVLTYANSCANPILYAFLSDNFKKSFQNVLCLVKVSGTDDGERSDSKQDKSRLNETTETQRTLLNGDLQTSI

SEQ ID NO: 751 - protein, 369 aa, Mus musculus
MEMSSEQLNGSQVWVSSPFDLNGSLGPSNGSNQTEPYYDMTSNAVLTFIYFVVCVVGLCGNTLVIYVILRYAKMKTITNIYILNLAIADELFMLGLPFLAMQVALVHWPFGKAICRVVMTVDGINQFTSIFCLTVMSIDRYLAVVHPIKSAKWRRPRTAKMINVAVWCVSLLVILPIMIYAGLRSNQWGRSSCTINWPGESGAWYTGFIIYAFILGFLVPLTIICLCYLFIIIKVKSSGIRVGSSKRKKSEKKVTRMVSIVVAVFIFCWLPFYIFNVSSVSVAISPTPALKGMFDFVVILTYANSCANPILYAFLSDNFKKSFQNVLCLVKVSGTEDGERSDSKQDKSRLNETTETQRTLLNGDLQTSI

SEQ ID NO: 752 - protein, 418 aa, Homo sapiens
MDMLHPSSVSTTSEPENASSAWPPDATLGNVSAGPSPAGLAVSGVLIPLVYLVVCVVGLLGNSLVIYVVLRHTASPSVTNVYILNLALADELFMLGLPFLAAQNALSYWPFGSLMCRLVMAVDGINQFTSIFCLTVMSVDRYLAVVHPTRSARWRTAPVARTVSAAVWVASAVVVLPVVVFSGVPRGMSTCHMQWPEPAAAWRAGFIIYTAALGFFGPLLVICLCYLLIVVKVRSAGRRVWAPSCQRRRRSERRVTRMVVAVVALFVLCWMPFYVLNIVNVVCPLPEEPAFFGLYFLVVALPYANSCANPILYGFLSYRFKQGFRRVLLRPSRRVRSQEPTVGPPEKTEEEDEEEEDGEESREGGKGKEMNGRVSQITQPGTSGQERPPSRVASKEQQLLPQEASTGEKSSTMRISYL

SEQ ID NO: 753 - protein, 428 aa, Mus musculus
MATVTYPSSEPMTLDPGNTSSTWPLDTTLGNTSAGASLTGLAVSGILISLVYLVVCVVGLLGNSLVIYVVLRHTSSPSVTSVYILNLALADELFMLGLPFLAAQNALSYWPFGSLMCRLVMAVDGINQFTSIFCLTVMSVDRYLAVVHPTRSARWRTAPVARTVSRAVWVASAVVVLPVVVFSGVPRGMSTCHMQWPEPAAAWRTAFIIYMAALGFFGPLLVICLCYLLIVVKVRSTTRRVRAPSCQWVQAPACQRRRRSERRVTRMVVAVVALFVLCWMPFYLLNIVNVVCPLPEEPAFFGLYFLVVALPYANSCANPILYGFLSYRFKQGFRRILLRPSRRIRSQEPGSGPPEKTEEEEDEEEEERREEEERRMQRGQEMNGRLSQIAQAGTSGQQPRPCTGTAKEQQLLPQEATAGDKASTLSHL

SEQ ID NO: 754 - protein, 388 aa, Homo sapiens [sequence omitted]

SEQ ID NO: 755 - protein, 384 aa, Mus musculus
MNAPATLLRGVEDTTWTPGINASWAPEQEEDAMGSDGTGTAGMVTIQCIYALVCLVGLVGNALVIFVILRYAKMKTATNIYLLNLAVADELFMLSVPFVRSAAALRHWPFGAVLCRAVLSVDGLNMFTSVFCLTVLSVDRYVAVVHPLRTATYRRPSVAKLINLGVWLASLLVTLPIAVFADTRPARGGEAVACNLHWPHPAWSAVFVIYTFLLGFLPPVLAIGLCYLLIVGKMRAVALRGGWQQRRRSEKKITRLVLMVVTVFVLCWMPFYVVQLLNLFVTSLDATVNHVSLILSYANSCANPILYGFLSDNFRRSFQRVLCLRCCLLETTGGAEEEPLDYYATALKSRGGAGCICPPLPCQQEPVQAEPGCKQVPFTKTTTF

SEQ ID NO: 756 - protein, 364 aa, Homo sapiens
MEPLFPASTPSWNASSPGAASGGGDNRTLVGPAPSAGARAVLVPVLYLLVCAAGLGGNTLVIYVVLRFAKMKTVTNIYILNLAVADVLYMLGLPFLATQNAASFWPFGPVLCRLVMTLDGVNQFTSVFCLTVMSVDRYLAVVHPLSSARWRRPRVAKLASAAAWVLSLCMSLPLLVFADVQEGGTCNASWPEPVGLWGAVFIIYTAVLGFFAPLLVICLCYLLIVVKVRAAGVRVGCVRRRSERKVTRMVLVVVLVFAGCWLPFFTVNIVNLAVALPQEPASAGLYFFVVILSYANSCANPVLYGFLSDNFRQSFQKVLCLRKGSGAKDADATEPRPDRIRQQQEATPPAHRAAANGLMQTSKL

SEQ ID NO: 757 - protein, 385 aa, Mus musculus
MCPLVTPSSLAEIHVLWHPEPDSMEPLSLASTPSWNASAASSGSHNWSLVDPVSPMGARAVLVPVLYLLVCTVGLGGNTLVIYVVLRYAKMKTVTNVYILNLAVADVLFMLGLPFLATQNAVSYWPFGSFLCRLVMTLDGINQFTSIFCLMVMSVDRYLAVVHPLRSARWRRPRVAKLASAAVWVFSLLMSLPLLVFADVQEGWGTCNLSWPEPVGLWGAAFITYTSVLGFFGPLLVICLCYLLIVVKVKAAGMRVGSSRRRRSERKVTRMVVVVVLVFVGCWLPFFIVNIVNLAFTLPEEPTSAGLYFFVVVLSYANSCANPLLYGFLSDNFRQSFRKALCLRRGYGVEDADAIEPRPDKSGRPQTTLPTRSCEANGLMQTSRL

SEQ ID NO: 758 - protein, 407 aa, Homo sapiens
MDNVLPVDSDLSPNISTNTSEPNQFVQPAWQIVLWAAAYTVIVVTSVVGNVVVMWIILAHKRMRTVTNYFLVNLAFAEASMAAFNTVVNFTYAVHNEWYYGLFYCKFHNFFPIAAVFASIYSMTAVAFDRYMAIIHPLQPRLSATATKVVICVIWVLALLLAFPQGYYSTTETMPSRVVCMIEWPEHPNKIYEKVYHICVTVLIYFLPLLVIGYAYTVVGITLWASEIPGDSSDRYHEQVSAKRKVVKMMIVVVCTFAICWLPFHIFFLLPYINPDLYLKKFIQQVYLAIMWLAMSSTMYNPIIYCCLNDRFRLGFKHAFRCCPFISAGDYEGLEMKSTRYLQTQGSVYKVSRLETTISTVVGAHEEEPEDGPKATPSSLDLTSNCSSRSDSKTMTESFSFSSNVLS

SEQ ID NO: 759 - protein, 407 aa, Mus musculus
MDNVLPVDSDLFPNTSTNTSESNQFVQPTWQIVLWAAAYTVIVVTSVVGNVVVIWIILAHKRMRTVTNYFLVNLAFAEACMAAFNTVVNFTYAVHNVWYYGLFYCKFHNFFPIAALFASIYSMTAVAFDRYMAIIHPLQPRLSATATKVVIFVIWVLALLLAFPQGYYSTTETMPSRVVCMIEWPEHPNRTYEKAYHICVTVLIYFLPLLVIGYAYTVVGITLWASEIPGDSSDRYHEQVSAKRKVVKMMIVVVCTFAICWLPFHIFFLLPYINPDLYLKKFIQQVYLASMWLAMSSTMYNPIIYCCLNDRFRLGFKHAFRCCPFISAGDYEGLEMKSTRYLQTQSSVYKVSRLETTISTVVGAHEDEPEEGPKATPSSLDLTSNGSSRSNSKTMTESSSFYSNILA

SEQ ID NO: 760 - protein, 398 aa, Homo sapiens [sequence omitted]

SEQ ID NO: 761 - protein, 384 aa, Mus musculus
MGAHASVTDTNILSGLESNATGVTAFSMPGWQLALWATAYLALVLVAVTGNATVIWIILAHERMRTVTNYFIINLALADLCMAAFNATFNFIYASHNIWYFGSTFCYFQNLFPVTAMFVSIYSMTAIAADRYMAIVHPFQPRLSAPSTKAVIAVIWLVALALASPQCFYSTITVDQGATKCVVAWPNDNGGKMLLLYHLVVFVLIYFLPLVVMFAAYSVIGLTLWKRAVPRHQAHGANLRHLQAKKKFVKAMVLVVVTFAICWLPYHLYFILGTFQEDIYYRKFIQQVYLALFWLAMSSTMYNPIIYCCLNHRFRSGFRLAFRCCPWGTPTEEDRLELTHTPSISRRVNRCHTKETLFMTGDMTHSEATNGQVGGPQDGEPAGP

SEQ ID NO: 762 - protein, 465 aa, Homo sapiens
MATLPAAETWIDGGGGVGADAVNLTASLAAGAATGAVETGWLQLLDQAGNLSSSPSALGLPVASPAPSQPWANLTNQFVQPSWRIALWSLAYGVVVAVAVLGNLIVIWIILAHKRMRTVTNYFLVNLAFSDASMAAFNTLVNFIYALHSEWYFGANYCRFQNFFPITAVFASIYSMTAIAVDRYMAIIDPLKPRLSATATKIVIGSIWILAFLLAFPQCLYSKTKVMPGRTLCFVQWPEGPKQHFTYHIIVIILVYCFPLLIMGITYTIVGITLWGGEIPGDTCDKYHEQLKAKRKVVKMMIIVVMTFAICWLPYHIYFILTAIYQQLNRWKYIQQVYLASFWLAMSSTMYNPIIYCCLNKRFRAGFKRAFRWCPFIKVSSYDELELKTTRFHPNRQSSMYTVTRMESMTVVFDPNDADTTRSSRKKRATPRDPSFNGCSRRNSKSASATSSFISSPYTSVDEYS

SEQ ID NO: 763 - protein, 452 aa, Mus musculus
MASVPTGENWTDGTAGVGSHTGNLSAALGITEWLALQAGNFSSALGLPVTSQAPSQVRANLTNQFVQPSWRIALWSLAYGLVVAVAVFGNLIVIWIILAHKRMRTVTNYFLVNLAFSDASVAAFNTLVNFIYGVHSEWYFGANYCRFQNFFPITAVFASIYSMTAIAVDRYMAIIDPLKPRLSATATKIVIGSIWILAFLLAFPQCLYSKIKVMPGRTLCYVQWPEGPKQHFTYHIIVIILVYCFPLLIMGVTYTIVGITLWGGEIPGDTCDKYHEQLKAKRKVVKMMIIVVVTFAICWLPYHVYFILTAIYQQLNRWKYIQQVYLASFWLAMSSTMYNPIIYCCLNKRFRAGFKRAFRWCPFIQVSSYDELELKTTRFHPTRQSSLYTVSRMESVTVLYDPSEGDPAKSSRKKRAVPRDPSANGCSHREFKSASTTSSFISSPYTSVDEYS

SEQ ID NO: 764 - protein, 339 aa, Homo sapiens
MMPFCHNIINISCVKNNWSNDVRASLYSLMVLIILTTLVGNLIVIVSISHFKQLHTPTNWLIHSMATVDFLLGCLVMPYSMVRSAEHCWYFGEVFCKIHTSTDIMLSSASIFHLSFISIDRYYAVCDPLRYKAKMNILVICVMIFISWSVPAVFAFGMIFLELNFKGAEEIYYKHVHCRGGCSVFFSKISGVLTFMTSFYIPGSIMLCVYYRIYLIAKEQARLISDANQKLQIGLEMKNGISQSKERKAVKTLGIVMGVFLICWCPFFICTVMDPFLHYIIPPTLNDVLIWFGYLNSTFNPMVYAFFYPWFRKALKMMLFGKIFQKDSSRCKLFLELSS

SEQ ID NO: 765 - protein, 332 aa, Mus musculus
MHLCHAITNISHRNSDWSREVQASLYSLMSLIILATLVGNLIVIISISHFKQLHTPTNWLLHSMAIVDFLLGCLIMPCSMVRTVERCWYFGEILCKVHTSTDIMLSSASIFHLAFISIDRYCAVCDPLRYKAKINISTILVMILVSWSLPAVYAFGMIFLELNLKGVEELYRSQVSDLGGCSPFFSKVSGVLAFMTSFYIPGSVMLFVYYRIYFIAKGQARSINRTNVQVGLEGKSQAPQSKETKAAKTLGIMVGVFLVCWCPFFLCTVLDPFLGYVIPPSLNDALYWFGYLNSALNPMVYAFFYPWFRRALKMVLLGKIFQKDSSRSKLFL

SEQ ID NO: 766 - protein, 345 aa, Homo sapiens
MSSNSSLLVAVQLCYANVNGSCVKIPFSPGSRVILYIVFGFGAVLAVFGNLLVMISILHFKQLHSPTNFLVASLACADFLVGVTVMPFSMVRTVESCWYFGRSFCTFHTCCDVAFCYSSLFHLCFISIDRYIAVTDPLVYPTKFTVSVSGICISVSWILPLMYSGAVFYTGVYDDGLEELSDALNCIGGCQTVVNQNWVLTDFLSFFIPTFIMIILYGNIFLVARRQAKKIENTGSKTESSSESYKARVARRERKAAKTLGVTVVAFMISWLPYSIDSLIDAFMGFITPACIYEICCWCAYYNSAMNPLIYALFYPWFRKAIKVIVTGQVLKNSSATMNLFSEHI

SEQ ID NO: 767 - protein, 345 aa, Mus musculus
MGSNSSPPTVLQLCYENVTGSCVKTPYSPGSRVILYAVFGFGAVLAVFGNLMVMISILHFKQLHSPTNFLIASLACADFGVGISVMPFSMVRSIESCWYFGRSFCTFHTCCDVAFCYSSLFHLSFISIDRYIAVTDPLVYPTKFTVSVSGICIGVSWILPLVYSGAVFYTGVYDDGLEELSSALNCVGGCQVVVNQNWVLIDFLSFLIPTLVMIILYGNIFLVARQQAKKIENIGSKTESSSESYKARVARRERKAAKTLGITVVAFMISWLPYSIDSLVDAFMGFITPAYIYEICVWCAYYNSAMNPLIYALFYPWFKKAIKVIMSGQVFKNSSATMNLFSEQI

SEQ ID NO: 768 - protein, 343 aa, Homo sapiens
MWPNGSSLGPCFRPTNITLEERRLIASPWFAASFCVVGLASNLLALSVLAGARQGGSHTRSSFLTFLCGLVLTDFLGLLVTGTIVVSQHAALFEWHAVDPGCRLCRFMGVVMIFFGLSPLLLGAAMASERYLGITRPFSRPAVASQRRAWATVGLVWAAALALGLLPLLGVGRYTVQYPGSWCFLTLGAESGDVAFGLLFSMLGGLSVGLSFLLNTVSVATLCHVYHGQEAAQQRPRDSEVEMMAQLLGIMVVASVCWLPLLVFIAQTVLRNPPAMSPAGQLSRTTEKELLIYLRVATWNQILDPWVYILFRRAVLRRLQPRLSTRPRSLSLQPQLTQRSGLQ

SEQ ID NO: 769 - protein, 341 aa, Mus musculus
MWPNGTSLGACFRPVNITLQERRAIASPWFAASFCALGLGSNLLALSVLAGARPGAGPRSSFLALLCGLVLTDFLGLLVTGAIVASQHAALLDWRATDPSCRLCYFMGVAMVFFGLCPLLLGAAMASERFVGITRPFSRPTATSRRAWATVGLVWVAAGALGLLPLLGLGRYSVQYPGSWCFLTLGTQRGDVVFGLIFALLGSASVGLSLLLNTVSVATLCRVYHTREATQRPRDCEVEMMVQLVGIMVVATVCWMPLLVFIMQTLLQTPPVMSFSGQLLRATEHQLLIYLRVATWNQILDPWVYILFRRSVLRRLHPRFSSQLQAVSLRRPPAQAMLSGP

SEQ ID NO: 770 - protein, 1331 aa, Homo sapiens
MRGAPARLLLPLLPWLLLLLAPEARGAPGCPLSIRSCKCSGERPKGLSGGVPGPARRRVVCSGGDLPEPPEPGLLPNGTVTLLLSNNKITGLRNGSFLGLSLLEKLDLRNNIISTVQPGAFLGLGELKRLDLSNNRIGCLTSETFQGLPRLLRLNISGNIFSSLQPGVFDELPALKVVDLGTEFLTCDCHLRWLLPWAQNRSLQLSEHTLCAYPSALHAQALGSLQEAQLCCEGALELHTHHLIPSLRQVVFQGDRLPFQCSASYLGNDTRIRWYHNRAPVEGDEQAGILLAESLIHDCTFITSELTLSHIGVWASGEWECTVSMAQGNASKKVEIVVLETSASYCPAERVANNRGDFRWPRTLAGITAYQSCLQYPFTSVPLGGGAPGTRASRRCDRAGRWEPGDYSHCLYTNDITRVLYTFVLMPINASNALTLAHQLRVYTAEAASFSDMMDVVYVAQMIQKFLGYVDQIKELVEVMVDMASNLMLVDEHLLWLAQREDKACSRIVGALERIGGAALSPHAQHISVNARNVALEAYLIKPHSYVGLTCTAFQRREGGVPGTRPGSPGQNPPPEPEPPADQQLRFRCTTGRPNVSLSSFHIKNSVALASIQLPPSLFSSLPAALAPPVPPDCTLQLLVFRNGRLFHSHSNTSRPGAAGPGKRRGVATPVIFAGTSGCGVGNLTEPVAVSLRHWAEGAEPVAAWWSQEGPGEAGGWTSEGCQLRSSQPNVSALHCQHLGNVAVLMELSAFPREVGGAGAGLHPVVYPCTALLLLCLFATIITYILNHSSIRVSRKGWHMLLNLCFHIAMTSAVFAGGITLTNYQMVCQAVGITLHYSSLSTLLWMGVKARVLHKELTWRAPPPQEGDPALPTPSPMLRFYLIAGGIPLIICGITAAVNIHNYRDHSPYCWLVWRPSLGAFYIPVALILLITWIYFLCAGLRLRGPLAQNPKAGNSRASLEAGEELRGSTRLRGSGPLLSDSGSLLATGSARVGTPGPPEDGDSLYSPGVQLGALVTTHFLYLAMWACGALAVSQRWLPRVVCSCLYGVAASALGLFVFTHHCARRRDVRASWRACCPPASPAAPHAPPRALPAAAEDGSPVFGEGPPSLKSSPSGSSGHPLALGPCKLTNLQLAQSQVCEAGAAAGGEGEPEPAGTRGNLAHRHPNNVHHGRRAHKSRAKGHRAGEACGKNRLKALRGGAAGALELLSSESGSLHNSPTDSYLGSSRNSPGAGLQLEGEPMLTPSEGSDTSAAPLSEAGRAGQRRSASRDSLKGGGALEKESHRRSYPLNAASLNGAPKGGKYDDVTLMGAEVASGGCMKTGLWKSETTV

SEQ ID NO: 771 - protein, 1329 aa, Mus musculus
MPVPPARLLLLPLLPCLLLLAPGTRGAPGCPVPIRGCKCSGERPKGLSGGAHNPARRRVVCGGGDLPEPPDPGLLPNGTITLLLSNNKITGLRNGSFLGLSLLEKLDLRSNVISTVQPGAFLGLGELKRLDLSNNRIGCLTSETFQGLPRLLRLNISGNIYSSLQPGVFDELPALKIVDFGTEFLTCDCRLRWLLPWARNHSLQLSERTLCAYPSALHAHALSSLQESQLRCEGALELHTHYLIPSLRQVVFQGDRLPFQCSASYLGNDTRIHWYHNGAPMESDEQAGIVLAENLIHDCTFITSELTLSHIGVWASGEWECSVSTVQGNTSKKVEIVVLETSASYCPAERVTNNRGDFRWPRTLAGITAYQSCLQYPFTSVPLSGGAPGTRASRRCDRAGRWEPGDYSHCLYTNDITRVLYTFVLMPINASNALTLAHQLRVYTAEAASFSDMMDVVYVAQMIQKFLGYVDQIKELVEVMVDMASNLMLVDEHLLWLAQREDKACSGIVGALERIGGAALSPHAQHISVNSRNVALEAYLIKPHSYVGLTCTAFQRREVGVSGAQPSSVGQDAPVEPEPLADQQLRFRCTTGRPNISLSSFHIKNSVALASIQLPPSLFSTLPAALAPPVPPDCTLQLLVFRNGRLFRSHGNNTSRPGAAGPGKRRGVATPVIFAGTSGCGVGNLTEPVAVSLRHWAEGADPMAAWWNQDGPGGWSSEGCRLRYSQPNVSSLYCQHLGNVAVLMELNAFPREAGGSGAGLHPVVYPCTALLLLCLFSTIITYILNHSSIHVSRKGWHMLLNLCFHMAMTSAVFVGGVTLTNYQMVCQAVGITLHYSSLSSLLWMGVKARVLHKELSWRAPPLEEGEAAPPGPRPMLRFYLIAGGIPLIICGITAAVNIHNYRDHSPYCWLVWRPSLGAFYIPVALILPITWIYFLCAGLHLRSHVAQNPKQGNRISLEPGEELRGSTRLRSSGVLLNDSGSLLATVSAGVGTPAPPEDGDGVYSPGVQLGALMTTHFLYLAMWACGALAVSQRWLPRVVCSCLYGVAASALGLFVFTHHCARRRDVRASWRACCPPASPSASHVPARALPTATEDGSPVLGEGPASLKSSPSGSSGRAPPPPCKLTNLQVAQSQVCEASVAARGDGEPEPTGSRGSLAPRHHNNLHHGRRVHKSRAKGHRAGETGGKSRLKALRAGTSPGAPELLSSESGSLHNSPSDSYPGSSRNSPGDGLPLEGEPMLTPSEGSDTSAAPIAETGRPGQRRSASRDNLKGSGSALERESKRRSYPLNTTSLNGAPKGGKYEDASVTGAEAIAGGSMKTGLWKSETTV

SEQ ID NO: 772 - protein, 399 aa, Homo sapiens
MRPERPRPRGSAPGPMETPPWDPARNDSLPPTLTPAVPPYVKLGLTVVYTVFYALLFVFIYVQLWLVLRYRHKRLSYQSVFLFLCLFWASLRTVLFSFYFKDFVAANSLSPFVFWLLYCFPVCLQFFTLTLMNLYFTQVIFKAKSKYSPELLKYRLPLYLASLFISLVFLLVNLTCAVLVKTGNWERKVIVSVRVAINDTLFVLCAVSLSICLYKISKMSLANIYLESKGSSVCQVTAIGVTVILLYTSRACYNLFILSFSQNKSVHSFDYDWYNVSDQADLKNQLGDAGYVLFGVVLFVWELLPTTLVVYFFRVRNPTKDLTNPGMVPSHGFSPRSYFFDNPRRYDSDDDLAWNIAPQGLQGGFAPDYYDWGQQTNSFLAQAGTLQDSTLDPDKPSLG

SEQ ID NO: 773 - protein, 385 aa, Mus musculus
MEAPPWEPVRNDSLPPTLSPAVPPYVKLGLTAVYTVFYALLFVFIYAQLWLVLRYRHKRLSYQSVFLFLCLFWASLRTVLFSFYFRDFVAANSFSPFVFWLLYCFPVCLQFFTLTLMNLYFTQVIFKAKSKYSPELLKYRLPLYLASLFISLVFLLVNLTCAVLVKTGDWDRKVIVSVRVAINDTLFVLCAISLSICLYKISKMSLANIYLESKGSSVCQVTAIGVTVILLYASRACYNLFILSFSQIKNVHSFDYDWYNVSDQADLKSQLGDAGYVVFGVVLFVWELLPTTLVVYFFRVRNPTKDLTNPGMVPSHGFSPRSYFFDNPRRYDSDDDLAWNIAPQGLQGSFAPDYCDWGQQNNSFLAQAGTLHQDSTLDPDKASQG

SEQ ID NO: 774 - protein, 417 aa, Homo sapiens
MESNLSGLVPAAGLVPALPPAVTLGLTAAYTTLYALLFFSVYAQLWLVLLYGHKRLSYQTVFLALCLLWAALRTTLFSFYFRDTPRANRLGPLPFWLLYCCPVCLQFFTLTLMNLYFAQVVFKAKVKRRPEMSRGLLAVRGAFVGASLLFLLVNVLCAVLSHRRRAQPWALLLVRVLVSDSLFVICALSLAACLCLVARRAPSTSIYLEAKGTSVCQAAAMGGAMVLLYASRACYNLTALALAPQSRLDTFDYGWYNVSDQADLVNDLGNKGYLVFGLILFVWELLPTTLLVGFFRVHRPPQDLSTSHILNGQVFASRSYFFDRAGHCEDEGCSWEHSRGESTRCQDQAATTTVSTPPHRRDPPPSPTEYPGPSPPHPRPLCQVCLPLLAQDPGGRGYPLLWPAPCCSCHSELVPSP

SEQ ID NO: 775 - protein, 473 aa, Mus musculus
MESNLSGLVPAAGLVPALPPTVTLGLTAAYTALYALLFFSVYAQLWLVLLYGHKRLSYQTVFLALCLLWAALRTTLFSFYFRDTPRANRLGPLPFWLLYCCPVCLQFFTLTLMNLYFVQVVFKAKAKRRPEMSRGLLAVRGAFVGASLLFLLVNVLCAVLSRQRQAQPWVLLLVRVLVSDSLFVICALSLAACLCLVARRAPSTSIYLEAKGTSVCQAAAIGGAMVLLYASRACYNLAALALAPRSRLDAFDYDWYNVSDQADLVNDLGNKGYLVFGLILFVWELLPTTLLVGFFRVHRPPQDLSTSRILNGQVFGSRSYFFDRAGHCEDEGCSWEHSRSESTRCQDLVVTTTASILHHRRDLLLLPLEYPGPSSPDPWPLCQVRLLLLAQVARRLWLLLSSGRLLAAPIVVSLCHPPKMETRPQDTRCPQCPGMTCHLCFHTGAGYLSCAYHSINRGCALSSLLSLVCSFSP

SEQ ID NO: 776 - protein, 570 aa, Homo sapiens
MGFLQLLVVAVLASEHRVAGAAEVFGNSSEGLIEFSVGKFRYFELNRPFPEEAILHDISSNVTFLIFQIHSQYQNTTVSFSPTLLSNSSETGTASGLVFILRPEQSTCTWYLGTSGIQPVQNMAILLSYSERDPVPGGCNLEFDLDIDPNIYLEYNFFETTIKFAPANLGYARGVDPPPCDAGTDQDSRWRLQYDVYQYFLPENDLTEEMLLKHLQRMVSVPQVKASALKVVTLTANDKTSVSFSSLPGQGVIYNVIVWDPFLNTSAAYIPAHTYACSFEAGEGSCASLGRVSSKVFFTLFALLGFFICFFGHRFWKTELFFIGFIIMGFFFYILITRLTPIKYDVNLILTAVTGSVGGMFLVAVWWRFGILSICMLCVGLVLGFLISSVTFFTPLGNLKIFHDDGVFWVTFSCIAILIPVVFMGCLRILNILTCGVIGSYSVVLAIDSYWSTSLSYITLNVLKRALNKDFHRAFTNVPFQTNDFIILAVWGMLAVSGITLQIRRERGRPFFPPHPYKLWKQERERRVTNILDPSYHIPPLRERLYGRLTQIKGLFQKEQPAGERTPLLL

SEQ ID NO: 777 - protein, 565 aa, Mus musculus
MWRLRLLVLAVLAAGSAEAQANSSDGFLEFSVGKFTYFVLSKSSPQEAVLRHISSNVTFLLFQIHSQYQNTTVSFTKTLLPSTSGTGNDRGLVFILRPEQAVCTWYLETGDTKPVQSVALTLSYSERDPIPGGCNLEFDLDIDPNLYLDYNFFETTIKFAPANIGYARATEPPPCDVSTSRESRWRLRYDVYQYFLPEGDLTEASLLHHLQRMAQVAQVKASAIKVATLTADDKTAVSFSSLPGQGVIYNVIVWDPSLNTSAAYVPVHTYACSFESVDGNCAFPGRVSTKVFSTLVALLGLFVCFFGHRFWKTDLFFIGFIFLGFFFYILITRLTPLQYDVRLALTAVAGSFGGLLLVASWWRFGILTLCMLCVGLVLGFLVSSGTFFTPLGNLNVFHDDGVFWVTFSCIALLVPVIFMGCLRILNILACGVVGSYSVVLAVNSYMFTSLSYITLNVLRRALNTDFRGAVIRVPFQTNDYIILAVWGMLAVSGITLQIRRERGQPPFPPHPYKLWKQERERRVTNILDPSHHIPPLRERLYGRVARIKELFQKEQPAGERTPLLL

SEQ ID NO: 778 - protein, 373 aa, Homo sapiens
MDTLEEVTWANGSTALPPPLAPNISVPHRCLLLLYEDIGTSRVRYWDLLLLIPNVLFLIFLLWKLPSARAKIRITSSPIFITFYILVFVVALVGIARAVVSMTVSTSNAATVADKILWEITRFFLLAIELSVIILGLAFGTWESKSSIKRVLAITTVLSLAYSVTQGTLEILYPDAHLSAEDFNIYGHGGRQFWLVSSCFFFLVYSLVVILPKTPLKERISLPSRRSFYVYAGILALLNLLQGLGSVLLCFDIIEGLCCVDATTFLYFSFFAPLIYVAFLRGFFGSEPKILFSYKCQVDETEEPDVHLPQPYAVARREGLEAAGAAGASAASYSSTQFDSAGGVAYLDDIASMPCHTGSINSTDSERWKAINA

SEQ ID NO: 779 - protein, 369 aa, Mus musculus
MASLQEANGSTAWPPPTASNISEPHQCLLLLYEDIGSSRVRYWDLLLLIPNVLFFIFLLWKLPLARAKIRVTSSPIFITFYILVFVVALVGIARAVVSMTVSASDAATVADKILWEITRFFLLAIELSVIILGLAFGHLESKSSIKRVLAITTVLSLAYSVTQGTLEILYPDSHLSAEDFNIYGHGGRQFWLVSSCFFFLVYSLVVILPKTPLKERVSLPSRRSFYVYAGILATLNLLQGLGSALLCANIIVGLCCVDATTFLYFSFFAPLIYVAFLRGFFGSEPKILFSYKCQVDEAEEPDMHLPQPYAVARREGIESAGPACASAANYSSTQFDSAGVAYLDDIASMPCHTGSINSTDSERWKAINA

SEQ ID NO: 780 - protein, 398 aa, Homo sapiens
MENETVSELNQTQLQPRAVVALEYQVVTILLVLIICGLGIVGNIMVVLVVMRTKHMRTPTNCYLVSLAVADLMVLVAAGLPNITDSIYGSWVYGYVGCLCITYLQYLGINASSCSITAFTIERYIAICHPIKAQFLCTFSRAKKIIIFVWAFTSLYCMLWFFLLDLNISTYKDAIVISCGYKISRNYYSPIYLMDFGVFYVVPMILATVLYGFIARILFLNPIPSDPKENSKTWKNDSTHQNTNLNVNTSNRCFNSTVSSRKQVTKMLAVVVILFALLWMPYRTLVVVNSFLSSPFQENWFLLFCRICIYLNSAINPVIYNLMSQKFRAAFRKLCNCKQKPTEKPANYSVALNYSVIKESDHFSTELDDITVTDTYLSATKVSFDDTCLASEVSFSQS

SEQ ID NO: 781 - protein, 393 aa, Mus musculus
MENDTVSEMNQTELQPQAAVALEYQVVTILLVVIICGLGIVGNIMVVLVVMRTKHMRTPTNCYLVSLAVADLMVLVAAGLPNITDSIYGSWVYGYVGCLCITYLQYLGINASSCSITAFTIERYIAICHPIKAQFLCTFSRAKKIIIFVWAFTSIYCMLWFFLLDLNISTYKNAVVVSCGYKISRNYYSPIYLMDFGVFYVVPMILATVLYGFIARILFLNPIPSDPKENSKMWKNDSIHQNKNLNLNATNRCFNSTVSSRKQVTKMLAVVVILFALLWMPYRTLVVVNSFLSSPFQENWFLLFCRICIYLNSAINPVIYNLMSQKFRAAFRKLCNCKQKPTEKAANYSVALNYSVIKESDRFSTELEDITVTDTYVSTTKVSFDDTCLASEN

SEQ ID NO: 782 - protein, 764 aa, Homo sapiens
MRPADLLQLVLLLDLPRDLGGMGCSSPPCECHQEEDFRVTCKDIQRIPSLPPSTQTLKLIETHLRTIPSHAFSNLPNISRIYVSIDVTLQQLESHSFYNLSKVTHIEIRNTRNLTYIDPDALKELPLLKFLGIFNTGLKMFPDLTKVYSTDIFFILEITDNPYMTSIPVNAFQGLCNETLTLKLYNNGFTSVQGYAFNGTKLDAVYLNKNKYLTVIDKDAFGGVYSGPSLLDVSQTSVTALPSKGLEHLKELIARNTWTLKKLPLSLSFLHLTRADLSYPSHCCAFKNQKKIRGILESLMCNESSMQSLRQRKSVNALNSPLHQEYEENLGDSIVGYKEKSKFQDTHNNAHYYVFFEEQEDEIIGFGQELKNPQEETLQAFDSHYDYTICGDSEDMVCTPKSDEFNPCEDIMGYKFLRIVVWFVSLLALLGNVFVLLILLTSHYKLNVPRFLMCNLAFADFCMGMYLLLIASVDLYTHSEYYNHAIDWQTGPGCNTAGFFTVFASELSVYTLTVITLERWYAITFAMRLDRKIRLRHACAIMVGGWVCCFLLALLPLVGISSYAKVSICLPMDTETPLALAYIVFVLTLNIVAFVIVCCCHVKIYITVRNPQYNPGDKDTKIAKRMAVLIFTDFICMAPISFYALSAILNKPLITVSNSKILLVLFYPLNSCANPFLYAIFTKAFQRDVFILLSKFGICKRQAQAYRGQRVPPKNSTDIQVQKVTHDMRQGLHNMEDVYELIENSHLTPKKQGQISEEYMQTVL

SEQ ID NO: 783 - protein, 764 aa, Mus musculus
MRPGSLLLLVLLLALSRSLRGKECASPPCECHQEDDFRVTCKELHRIPSLPPSTQTLKLIETHLKTIPSLAFSSLPNISRIYLSIDATLQRLEPHSFYNLSKMTHIEIRNTRSLTYIDPDALTELPLLKFLGIFNTGLRIFPDLTKIYSTDIFFILEITDNPYMTSVPENAFQGLCNETLTLKLYNNGFTSVQGHAFNGTKLDAVYLNKNKYLTAIDNDAFGGVYSGPTLLDVSSTSVTALPSKGLEHLKELIAKDTWTLKKLPLSLSFLHLTRADLSYPSHCCAFKNQKKIRGILESLMCNESSIRNLRQRKSVNILRGPIYQEYEEDPGDNSVGYKQNSKFQESPSNSHYYVFFEEQEDEVVGFGQELKNPQEETLQAFESHYDYTVCGDNEDMVCTPKSDEFNPCEDIMGYRFLRIVVWFVSLLALLGNIFVLLILLTSHYKLTVPRFLMCNLAFADFCMGVYLLLIASVDLYTHSEYYNHAIDWQTGPGCNTAGFFTVFASELSVYTLTVITLERWYAITFAMRLDRKIRLRHAYTIMAGGWVSCFLLALLPMVGISSYAKVSICLPMDTDTPLALAYIVLVLLLNVVAFVVVCSCYVKIYITVRNPQYNPRDKDTKIAKRMAVLIFTDFMCMAPISFYALSALMNKPLITVTNSKILLVLFYPLNSCANPFLYAIFTKAFQRDVFILLSKFGICKRQAQAYQGQRVCPNNSTGIQIQKIPQDTRQSLPNMQDTYELLGNSQLAPKLQGQISEEYKQTAL

SEQ ID NO: 784 - protein, 457 aa, Homo sapiens
MRPPSPLPARWLCVLAGALAWALGPAGGQAARLQEECDYVQMIEVQHKQCLEEAQLENETIGCSKMWDNLTCWPATPRGQVVVLACPLIFKLFSSIQGRNVSRSCTDEGWTHLEPGPYPIACGLDDKAASLDEQQTMFYGSVKTGYTIGYGLSLATLLVATAILSLFRKLHCTRNYIHMHLFISFILRAAAVFIKDLALFDSGESDQCSEGSVGCKAAMVFFQYCVMANFFWLLVEGLYLYTLLAVSFFSERKYFWGYILIGWGVPSTFTMVWTIARIHFEDYGCWDTINSSLWWIIKGPILTSILVNFILFICIIRILLQKLRPPDIRKSDSSPYSRLARSTLLLIPLFGVHYIMFAFFPDNFKPEVKMVFELVVGSFQGFVVAILYCFLNGEVQAELRRKWRRWHLQGVLGWNPKYRHPSGGSNGATCSTQVSMLTRVSPGARRSSSFQAEVSLV

SEQ ID NO: 785 - protein, 459 aa, Mus musculus
MRPPSLPPARWLCVLAGALACALGPAGSRAASPHQECEYLQMIEKQRQQCLEEAQLENETTGCSKMWDNLTCWPTTPWGQVVVLDCPLIFQLFSPIHGYNISRNCTEEGWSQLEPGPYHIACGLNDRASSMDEQQQTEFYDAVKTGYTIGYSLSLASLLVAMAILSLFRKLHCTRNYIHMHLFMSFILRATAVFIKDMALFNNGETDHCSEASVSCKAAVVFFQYCVMANFFWLLVEGLYLHTLLAVSFFSERKYFWGYILIGWGVPSVFIMIWTIVRIHFEDFGCWDTIINSSLWWIIKGPILISILVNFILFICIIRILVQKLRPPDIGKNDSSPYSRLAKSTLLLIPLFGVHYVMFAFFPDNFKAQVKMVFELVVGSFQGFVVAILYCFLNGEVQAELRRKWRRWHLQGVLGWSSKSQHPWGGSNGVSCSTQVSMLTRVSPSARRSSSFQAEVSLV

SEQ ID NO: 786 - protein, 438 aa, Homo sapiens
MRTLLPPALLTCWLLAPVNSIHPECRFHLEIQEEETKCAELLRSQTEKHKACSGVWDNITCWRPANVGETVTVPCPKVFSNFYSKAGNISKNCTSDGWSETFPDFVDACGYSDPEDESKITFYILVKAIYTLGYSVSLMSLATGSIILCLFRKLHCTRNYIHLNLFLSFILRAISVLVKDDVLYSSSGTLHCPDQPSSWVGCKLSLVFLQYCIMANFFWLLVEGLYLHTLLVAMLPPRRCFLAYLLIGWGLPTVCIGAWTAARLYLEDTGCWDTNDHSVPWWVIRIPILISIIVNFVLFISIIRILLQKLTSPDVGGNDQSQYKRLAKSTLLLIPLFGVHYMVFAVFPISISSKYQILFELCLGSFQGLVVAVLYCFLNSEVQCELKRKWRSRCPTPSASRDYRVCGSSFSRNGSEGALQFHRGSRAQSFLQTETSVI

SEQ ID NO: 787 - protein, 437 aa, Mus musculus
MRASVVLTCYCWLLVRVSSIHPECRFHLEIQEEETKCAELLSSQTENQRACSGVWDNITCWRPADVGETVTVPCPKVFSNFYSRPGNISKNCTSDGWSETFPDFIDACGYNDPEDESKISFYILVKAIYTLGYSVSLMSLTTGSIIICLFRKLHCTRNYIHLNLFLSFMLRAISVLVKDSVLYSSSGLLRCHDQPASWVGCKLSLVFFQYCIMANFYWLLVEGLYLHTLLVAILPPSRCFLAYLLIGWGIPSVCIGAWTATRLSLEDTGCWDTNDHSIPWWVIRMPILISIVVNFALFISIVRILLQKLTSPDVGGNDQSQYKRLAKSTLLLIPLFGVHYMVFAAFPIGISSTYQILFELCVGSFQGLVVAVLYCFLNSEVQCELKRRWRGLCLTQAGSRDYRLHSWSMSRNGSESALQIHRGSRTQSFLQSETSVI

SEQ ID NO: 788 - protein, 6307 aa, Homo sapiens
MSVFLGPGMPSASLLVNLLSALLILFVFGETEIRFTGQTEFVVNETSTTVIRLIIERIGEPANVTAIVSLYGEDAGDFFDTYAAAFIPAGETNRTVYIAVCDDDLPGPDETFIFHLTLQKPSANVKLGWPRTVTVTILSNDNAFGIISFNMLPSIAVSEPKGRNESMPLTLIREKGTYGMVMVTFEVEGGPNPPDEDLSPVKGNITFPPGRATVIYNLAVLDDEVPENDEIFLIQLKSVEGGAEINTSRNSIEIIIEKNDSPVRFLQSIYLVPEEDHILIIPVVRGKDNNGNLIGSDEYEVSISYAVTTGNSTAHAQQNLDFIDLQPNTTVVFPPFIHESHLKFQIVDDTIPEIAESFHIMLLKDTLQGDAVLISPSVVQVTIKPNDKPYGVLSFNSVLFERTVIIDEDRISRYEEITVVRNGGTHGNVSANWVVTPNSTDPSPVTADIRPSSGVLHFAQGQMLATIPLTGGDDDLPEEAEAYLLQILPHTIRGGAEVSEPAELLFYIQDSDDVYGLITFFPMENQKIESSPGGRYLSLSFTRLGGTKGDVRLLYSVLYIPAGAVDPLQAKEGILNISRRNDLIFPEQKTQVTTKLPIRNDAFLQNGAHFLVQLETVELLNIIPLIPPISPRFGEICNISLLVTPAIANGEIGFLSNLPIILHEPEDFAAEVVYIPLHRDGTDGQATVYWSLKPSGFNSKAVTPDDIGPFNGSVLFLSGQSDTTINITIKGDDIPEMNETVTLSLDWVNVENQVLKSGYTSRDLIILENDDPGGVFEFSPASRGPYVIKEGESVELHIIRSRGSLVKQFLHYRVEPRDSNEFYGNTGVLEFKPGEREIVITLLARLDGIPELDEHYWVVLSSHGERESKLGSATIVNITILKNDDPHGIIEFVSDGLIVMINESKGDAIYSAVYDVVRNRGNFGDVSVSWVVSPDFTQDVFPVQGTVVFGDQEFSKNITIYSLPDEIPEEMEEFTVILLNGTGGAKVGNRTTATLRIRRNDDPIYFAEPRVVRVQEGETANFTVLRNGSVDVTCMVQYATKDGKATARERDFIPVEKGETLIFEVGSRQQSISIFVNEDGIPETDEPFYIILLNSPGDPVVYQYGVATVIIEANDDPNGIFSLEPIDKAVEEGKTNAFWILRHRGYFGSVSVSWQLFQNDSALQPGQEFYETSGTVNFMDGEEAKPIILHAFPDKIPEFNEFYFLKLVNISGGSPGPGGQLAETNLQVTVMAPFNDDPFGVFILDPECLEREVAEDVLSEDDMSYITNFTILRQQGVFGDVQLGWEILSSEFPAGLPPMIDFLLVGIFPTTVHLQQHMRGHHSGTDALYFTGLEGAFGTGNSKYHPFRNNTIANFTFSAWVMPNANTNGFIIAKDDGNGSIYYGVKIQTNESHVTLSLHYKTLGSNATYIAKTTVMKYLEESVWLHLLIILEDGIIEFYLDGNAMPRGIKSLKGEAITDGPGILRIGAGINGNDRFTGLMQDVRSYERKLTLEEIYELHAMPAKSDLHPISGYLEFRQGETNKSFIISARDDNDEEGEELFILKLVSVYGGARISEENTTARLTIQKSDNANGLFGFTGACIPEIAEEGSTISCVVERTRGALDYVHVFYTISQIETDGINYLVDDFANASGTITFLPWQRSEVLNIYVLDDDIPELNEYFRVTLVSAIPGDGKLGSTPTSGASIDPEKETTDITIKASDHPYGLLQFSTGLPPQPKDAMTLPASSVPHITVEEEDGEIRLLVIRAQGLLGRVTAEFRTVSLTAFSPEDYQNVAGTLEFQPGERYKYIFINITDNSIPELEKSFKVELLNLEGGVAELFRVDGSGSGDGDMEFFLPTIHKRASLGVASQILVTIAASDHAHGVFEFSPESLFVSGTEPEDGYSTVTLNVIRHHGTLSPVTLHWNIDSDPDGDLAFTSGNITFEIGQTSANITVEILPDEDPELDKAFSVSVLSVSSGSLGAHINATLTVLASDDPYGIFIFSEKNRPVKVEEATQNITLSIIRLKGLMGKVLVSYATLDDMEKPPYFPPNLARATQGRDYIPASGFALFGANQSEATIAISILDDDEPERSESVFIELLNSTLVAKVQSRSIPNSPRLGPKVETIAQLIIIANDDAFGTLQLSAPIVRVAENHVGPIINVTRTGGAFADVSVKFKAVPITAIAGEDYSIASSDVVLLEGETSKAVPIYVINDIYPELEESFLVQLMNETTGGARLGALTEAVIIIEASDDPYGLFGFQITKLIVEEPEFNSVKVNLPIIRNSGTLGNVTVQWVATINGQLATGDLRVVSGNVTFAPGETIQTLLLEVLADDVPEIEEVIQVQLTDASGGGTIGLDRIANIIIPANDDPYGTVAFAQMVYRVQEPLERSSCANITVRRSGGHFGRLLLFYSTSDIDVVALAMEEGQDLLSYYESPIQGVPDPLWRTWMNVSAVGEPLYTCATLCLKEQACSAFSFFSASEGPQCFWMTSWISPAVNNSDFWTYRKNMTRVASLFSGQAVAGSDYEPVTRQWAIMQEGDEFANLTVSILPDDFPEMDESFLISLLEVHLMNISASLKNQPTIGQPNISTVVIALNGDAFGVFVIYNISPNTSEDGLFVEVQEQPQTLVELMIHRTGGSLGQVAVEWRVVGGTATEGLDFIGAGEILTFAEGETKKTVILTILDDSEPEDDESIIVSLVYTEGGSRILPSSDTVRVNILANDNVAGIVSFQTASRSVIGHEGEILQFHVIRTFPGRGNVTVNWKIIGQNLELNFANFSGQLFFPEGSLNTTLFVHLLDDNIPEEKEVYQVILYDVRTQGVPPAGIALLDAQGYAAVLTVEASDEPHGVLNFALSSRFVLLQEANITIQLFINREFGSLGAINVTYTTVPGMLSLKNQTVGNLAEPEVDFVPIIGFLILEEGETAAAINITILEDDVPELEEYFLVNLTYVGLTMAASTSFPPRLDSEGLTAQVIIDANDGARGVIEWQQSRFEVNETHGSLTLVAQRSREPLGHVSLFVYAQNLEAQVGLDYIFTPMILHFADGERYKNVNIMILDDDIPEGDEKFQLILTNPSPGLELGKNTIALIIVLANDDGPGVLSFNNSEHFFLREPTALYVQESVAVLYIVREPAQGLFGTVTVQFIVTEVNSSNESKDLTPSKGYIVLEEGVRFKALQISAILDTEPEMDEYFVCTLFNPTGGARLGVHVQTLITVLQNQAPLGLFSISAVENRATSIDIEEANRTVYLNVSRTNDIDLAVSVQWETVSETAFGMRGMDVVFSVFQSFLDESASGWCFFTLENLIYGIMLRKSSVTVYRWQGIFIPVEDLNIENPKTCEAFNIGFSPYFVITHEERNEEKPSLNSVFTFTSGFKLFLVQTIIILESSQVRYFTSDSQDYLIIASQRDDSELTQVFRWNGGSFVLHQKLPVRGVLTVALFNKGGSVFLAISQANARLNSLLFRWSGSGFINFQEVPVSGTTEVEALSSANDIYLIFAENVFLGDQNSIDIFIWEMGQSSFRYFQSVDFAAVNRIHSFTPASGIAHILLIGPRYVYSFTAGNSERNQFSFVLEVPSAYDVVSVTVKSLNSSKNLIALVGAHSHIYELAYISSHSDFIPSSGELIFEPGEREATIAVNILDDTVPEKEESFKVQLKNPKGGAEIGINDSVTITILSNDDAYGIVAFAQNSLYKQVEEMEQDSLVTLNVERLKGTYGRITIAWEADGSISDIFPTSGVILFTEGQVLSTITLTILADNIPELSEVVIVTLTRITTEGVEDSYKGATIDQDRSKSVITTLPNDSPFGLVGWRAASVFIRVAEPKENTTTLQLQIARDKGLLGDIAIHLRAQPNFLLHVDNQATENEDYVLQETIIIMKENIKEAHAEVSILPDDLPELEEGFIVTITEVNLVNSDFSTGQPSVRRPGMEIAEIMIEENDDPRGIFMFHVTRGAGEVITAYEVPPPLNVLQVPVVRLAGSFGAVNVYWKASPDSAGLEDFKPSHGILEFADKQVTAMIEITIIDDAEFELTETFNISLISVAGGGRLGDDVVVTVVIPQNDSPFGVFGFEEKTVMIDESLSSDDPDSYVTLTVVRSPGGKGTVRLEWTIDEKAKHNLSPLNGTLHFDETESQKTIVLHTLQDTVLEEDRRFTIQLISIDEVEISPVKGSASIIIRGDKRASGEVGIAPSSRHILIGEPSAKYNGTAIISLVRGPGILGEVTVFWRIFPPSVGEFAETSGKLTMRDEQSAVIVVIQALNDDIPEEKSFYEFQLTAVSGGGVLSESSSTANITVVASDSPYGRFAFSHEQLRVSEAQRVNITIIRSSGDFGHVRLWYKTMSGTAEAGLDFVPAAGELLFEAGEMRKSLHVEILDDDYPEGPEEFSLTITKVELQGRGYDFTIQENGLQIDQPPEIGNISIVRIIIMKNDNAEGIIEFDPKYTAFEVEEDVGLIMIPVVRLHGTYGYVTADFISQSSSASPGGVDYILHGSTVTFQHGQNLSFINISIIDDNESEFEEPIEILLTGATGGAVLGRHLVSRIIIAKSDSPFGVIRFLNQSKISIANPNSTMILSLVLERTGGLLGEIQVNWETVGPNSQEALLPQNRDIADPVSGLFYFGEGEGGVRTIILTIYPHEEIEVEETFIIKLHLVKGEAKLDSRAKDVTLTIQEFGDPNGVVQFAPETLSKKTYSEPLALEGPLLITFFVRRVKGTFGEIMVYWELSSEFDITEDFLSTSGFFTIADGESEASFDVHLLPDEVPEIEEDYVIQLVSVEGGAELDLEKSITWFSVYANDDPHGVFALYSDRQSILIGQNLIRSIQINITRLAGTFGDVAVGLRISSDHKEQPIVTENAERQLVVKDGATYKVDVVPIKNQVFLSLGSNFTLQLVTVMLVGGRFYGMPTILQEAKSAVLPVSEKAANSQVGFESTAFQLMNITAGTSHVMISRRGTYGALSVAWTTGYAPGLEIPEFIVVGNMTPTLGSLSFSHGEQRKGVFLWTFPSPGWPEAFVLHLSGVQSSAPGGAQLRSGFIVAEIEPMGVFQFSTSSRNIIVSEDTQMIRLHVQRLFGFHSDLIKVSYQTTAGSAKPLEDFEPVQNGELFFQKFQTEVDFEITIINDQLSEIEEFFYINLTSVEIRGLQKFDVNWSPRLNLDFSVAVITILDNDDLAGMDISFPETTVAVAVDTTLIPVETESTTYLSTSKTTTILQPTNVVAIVTEATGVSAIPEKLVTLHGTPAVSEKPDVATVTANVSIHGTFSLGPSIVYIEEEMKNGTFNTAEVLIRRTGGFTGNVSITVKTFGERCAQMEPNALPFRGIYGISNLTWAVEEEDFEEQTLTLIFLDGERERKVSVQILDDDEPEGQEFFYVFLTNPQGGAQIVEGKDDTGFAAFAMVIITGSDLHNGIIGFSEESQSGLELREGAVMRRLHLIVTRQPNRAFEDVKVFWRVTLNKTVVVLQKDGVNLMEELQSVSGTTTCTMGQTKCFISIELKPEKVPQVEVYFFVELYEATAGAAINNSARFAQIKILESDESQSLVYFSVGSRLAVAHKKATLISLQVARDSGTGLMMSVNFSTQELRSAETIGRTIISPAISGKDFVITEGTLVFEPGQRSTVLDVILTPETGSLNSFPKRFQIVLFDPKGGARIDKVYGTANITLVSDADSQAIWGLADQLHQPVNDDILNRVLHTISMKVATENTDEQLSAMMHLIEKITTEGKIQAFSVASRTLFYEILCSLINPKRKDTRGFSHFAEVTENFAFSLLTNVTCGSPGEKSKTILDSCPYLSILALHWYPQQINGHKFEGKEGDYIRIPERLLDVQDAEIMAGKSTCKLVQFTEYSSQQWFISGNNLPTLKNKVLSLSVKGQSSQLLTNDNEVLYRIYAAEPRIIPQTSLCLLWNQAAASWLSDSQFCKVIEETADYVECACSHMSVYAVYARTDNLSSYNEAFFTSGFICISGLCLAVLSHIFCARYSMFAAKLLTHMMAASLGTQILFLASAYASPQLAEESCSAMAAVTHYLYLCQFSWMLIQSVNFWYVLVMNDEHTERRYLLFFLLSWGLPAFVVILLIVILKGIYHQSMSQIYGLIHGDLCFIPNVYAALFTAALVPLTCLVVVFVVFIHAYQVKPQWKAYDDVFRGRTNAAEIPLILYLFALISVTWLWGGLHMAYRHFWMLVLFVIFNSLQGLYVFMVYFILHNQMCCPMKASYTVEMNGHPGPSTAFFTPGSGMPPAGGEISKSTQNLIGAMEEVPPDWERASFQQGSQASPDLKPSPQNGATFPSSGGYGQGSLIADEESQEFDDLIFALKTGAGLSVSDNESGQGSQEGGTLTDSQIVELRRIPIADTHL

SEQ ID NO: 789 - protein, 6298 aa, Mus musculus
MSVTSEPGMISSFLLVYLSTLFISFVFGEAEIRFTGQTEFFVNETSTTVIRLVIERIGEPANVTAIVSLSGEDTGDFFDTYAAAFIPARGTNRTVYIAVCDDDLPEPDETFTFHLTLQKPSANVKLGWPRAASVTILSNDNAFGIISFSTPSSISVIEPRSRNASVPLTLIREKGTYGMVTVTFDVSGGPNPPEEDLNPVRGNITFPPGRATVIYNVTVLDDEVPENDELFLIQLRSVEGGAEINASRSSVEIIVKKNDSPVNFMQSVYVVPEDDHVLTIPVLRGKDSDGNLIGSDETQVSIRYKVMTWDSTAHAQQNVDFIDLQPDTTLVFPPFVHESHLKFQIIDDLIPEIAESFHIMLLKNTLQGDAVLMGPSTVQVTIKPNDKPYGVLSFNSILFERPVIIDEDTASSSRFEEIAVVRNGGTHGNVSVSWVLTRNSSDPSPVTADITPASGTLQFAQGQMLAPISLVVFDDDLPEEAEAYLLTILPHTIQGGAEVSEPAQLLFYIQDSDNVYGEIAFFPGESQKIESSPSERSLSLSLARRGGSKGDVRVIYSALYIPAGAMDPLRAKDGILNTSRRSSLLFPEQNQQVSIKLPIRNDAFLQNGAHFLVQLEAVVLVNIFPPIPPVSPRFGEIRNISLLVTPAIANGEIGFLSNLPIILHEPKDSSAEVVSIPLHRDGTDGQATVYWSLRPSGFNSKAVTLDDAGPFNGSVVFLSGQNETSINITVKGDDIPELNETVTLSLDRVSVDSDVLKSGYTSRDLIILENDDPGGIFEFSYDSRGPYVIKEGDAVELRITRSRGSLVKQFLRFHVEPRESNEFYGNMGVLEFTPGEREVVITLLTRLDGTPELDEHFWVILSSHGERESKLGRATLVNITILKNDYPHGIIEFVSDGLSASIKESKGEDIYHAVYGVIRTRGNFGAVNVSWMVSPDFTQDVFPVQGTVCFGDQEFFKNITVYSLVDEIPEEMEEFTIILLNATGGAQTGIRTTASLRILRNDDPVYFAEPCVLRVQEGETANFTVLRNGSVDGACTVQYATVDGKASGEEGDFAPVEKGETLVFEVGSREQSISVHVKDDGIPETDEPFYIVLFNSTGDTVVYEYGVATVIIEANDDPNGVFSLEPIDKAVEEGKTNAFWILRHRGHFGNVSVAWQLFQNASLQPGQEFYETSGTVNFTDGEETKPVILRAFPDRIPEFNEFYILRLVNISGPGGQLAETNFQVTVMIPFNDDPFGIFILDPECLEREVAEDVLSEDDMSYITSFTILRQQGVFGDVRVGWEVLSREFTAGLPPMIDFILLGSFPSTVPLQPHMRRHHSGTDVLYFSGLEGAFGTVDPKYQPFRNNTIANFTFSAWVMPNANTNGFLIAKDDSHGSIYYGVKIQTNETHVTLSLHYKTFGSNVTYIAKSTVMKYLEEGVWLHVLIILDDGIIEFYLDGKAMPRGIKSLKGEAITDGPGILRIGAGMDGGARFTGWMQDVRTYERKLTPEEIYELHAVPARTDLHPISGYLEFRQGESNKSFIVAARDDSEEEGEELFLLKLVSVDGGAQISKENTTARLRIQKSDNANGLFGFTGACIPEMTEEGSTVSCVVERTRGALGYVHVFYTISQIESEGINYLVDDFANASGTITFLPWQRSEVLNLYVLDEDMPELNEYFRVTLVSAVPGDGKLGSTPISGASIDPEKETTGITVKASDHPYGLMQFSTGLPPQPEDSMSLPASSVPHITVQEEDGEIRLLVIRAQGLLGRVTVGFRTVSLTAFSPEDYQSTAGTLEFQSGERYKYIFVNITDNSIPELEKSFKVELLNLDGGVSDLFRVDGSGSGEADTDFFLPPVLPHASLGVASQILVTIAASDHAHGVFEFSPESLFVSGTEPEDGYSTVVLNVTRTRGALSAVTLQWKVDSDLDGDLAITSGNITFETGQRIASITVEILSDEEPELDKALTVSILNVSSGSLGVLTNATLTILASDDPYGVFIFPNKTRPLSVEEATQNVALSIIRLKGLMGEVAVSYATIDDMEKPPYFPPNLARATQGGDYISASGLALFRVNQTEATITISILDDAEPERSESVFIELFNSSLVDKVQNRPIPHSPRLGPKVETVAHLVIVANDDAFGTVQLSATSVHVAENHVGPIINVTRTGGTFADVSVKFKAVPITAAAGEDYSIASSDVVLLEGETTKAVPIYIINDIYPELEETFLVQLLNETTGGATLGPLREAVITIEASDDPYGLFGFQNTKFIVEEPEFNSVRVNVPIIRNSGTLGNVTVQWVAIINGQFATGDLRVVSGNVTFAPGETIQTLLLEVLADDVPEIEEVVQVQLAAASGGGTIGLDRVANIVIPANDNPYGSVAFVQSVFRVQEPLERSSYANITVRRSGGHFGRLLLCYGTSDIDVVARAVEEGEDVLSYYESPTQGVPDPLWRTWVNVSAVEETQYTCATLCLKERACSAFSVVSGAEGPRCFWMTSWVSGTVNSSDFQTYKKNMTRVASLFSGQAVAGSDYEPVTRQWAVILEGDEFANLTVSVLPDDAPEMDESFLISLLEVHLMNISDSFKNQPTIGHPNTSAVVIGLNGDAFGVFIIYSVSPNTSEDGLCVEVQEQPQTSVELVIYRTGGSLGQVMVEWRVVGGTATEGLDFMGAGDILTFAEGETKKMAILTILDDSEPEDNESILVRLGATEGGSRILPSSDTVTVNILANDNVAGIVSFQTASRSVIGHEGEMLQFHVVRTPPGRGNVTVNWKVVGQNLEVNFANFTGQLFFSEGTLNKTIFVHLLDDNIPEEKEVYQVVLYDVKTQGVSPAGVALLDAQGYAAVLTVEASDEPHGVLNFALSSRFVVLQEANVTIQLFVNREFGSLGAINVTYATVPGIVSLKNNTEGNLAEPESDFIPVVGSLVLEEGETTAAISITVLEDDIPELKEYFLVNLTHVDLIMAPLTSSPPRLDSEGLTAQIVIDANDGAQGMIEWQRNRFEVNETDGVVTLVAQRSRAALGQVSLFMYAQNLEAQAGLDYMRTPQILHFTDGERFKHVDVMILDDDMPEGDERFQLLLTNPSPGLELGKNTIALITVLANDDGPGVLSFNNSGHIFLREPTSLYVQESVAVLVIVREPAQGLFGTVAVQFVVTEVNSSTESKDLSPSKGFIVLEEGVRSKTLRISAILDTEPEMDEHFVCTLFNPTGGARLGAHVQTLITIFQNQAPLGLFSISAVENSATSIDVEESNRSVYLNVSRTNGLDLTASVQWETVSETAFGMRGMDVVFSIFQSFFDKTALDWCFFTVEGSVYGVMLRKSSLVVYRWQGTFVPVEDLKVESPKTCEAFNIGVSPYLVITHGERSGEKPSINSVYMLTAGFRLVLIQTIIISGSCQVRHFTSDSQDYFIIASRRNDSELTQVFRWNGNNFAWHQTLPVRGVLGMALFSRGGSVFLAISQANIRQTSLLFTWSGTQFINFQELPISGITQVEALSSGDDVYLCFAKNTFLGNQNAIDIFVWEMGHSSLRYFQSLDFAAVKRIRSFTPASGIVHILLTAQDGSALYCWNSELNAFSFVLEAPAAHDAAFVTVKSLNSSKTLIALVGATDSHLYELTYVSSQSDFIPSLGELIFEPGDKEAIIAVNVLDDTVPEKEESFRVQLKSPRGGAEIGINSSVRVTVLANDGAYGVVAFAQNSLHKQLEELERDSLVTLNVERLRGTHGRITVAWEAAGSVSDVFPTSGVISFTEDQAMSMITLTVLADDLPELSEAVVVTLTQIVTEGVEDPLKGATIDQSRSRSVLTILPSDSPYGAVRWHTESLFNRVPEPTENITVVQLHIVRDKGLFGDISIHLIAKPNFLLHINNQATEDEDFVLQDSVIIMKENIKETHAEVAILPDEVPELDEGLIVTIAAVNLVNPNFPAEQPRVQRPRMESAEILIEENDDPRGIFNFHVVRDVGGVIIAHEGPPPLNVLQVPVVRMAGTFETVNVYWKATPDSAGLEDFQPSHGMLQFADGQVIAPILVTIIDDSEFELLETFTISLVSVTGGGRLGDDVSVNVVIAPNDSPFGIFGFEKKTVMVDGPLLSDDPDSYVTLTVVRSPGGKGAVRLHWAIEEKAKDDLSPLNGTLYFDETESQKSVILHTLKDGMVGEDRRFIIELTAADEVEISPVKGSASVIIRGDKSISEVGIASSSRHIIIGEPSATYNGTAIIDLVRGPGVSGEITVNWKILPPSRGEFVETSGQLTMLDGQTAATVVIQVLNDDIPEEKCHYEFQLTEISEGRMLHEASVSARITMVASDAPYGRFSFSHEQLHVSKAAQRVNVTVVRSGGSFGRARVLYETGSRTAEAGWDFVPASGELLFEAREKMKSLYIDILDDDLPEGPEEFVLAITRVDLQGRGYDFTIQENGLQIDQPPEIGNISIVRIIIMKNDNAEGIIEFDPKYTDISVEEDAGVITLPVLRLHGTYGHVSADFSSRGFSAVPGGYVLRGSSVTFQHGQNLSFINVSIIDDNGSEFEKQFEILLIGATGGAILGRHLVSKITIAKSDSPFGIIRFLNQSKISLPNPSSTMALHLVLERTGGLLGEIQVSWEVVGPDAEEPLPPHNGDFADPVSGTVSFGDGEGGVRSIILRVCPHEETEAEETFIVQLKPLREAKLDPRAKAVTLTIQKFGDPNGVIHFAPESLSKRRFSEPPPSDGPLLVSFLVTRSKGTSGDIKVHWELSSEFDITRDFLSTRGFFTIADGESDANFDVHLLPDDVPEIEEEYAVQLVSVEGGAELDLGKCTARFSVSANDDPHGVFALYSDRQSVLIGQNLDRSIQINITRLAGAFGAVAVRVQILSDNKEDPVATENEERQLVITDGARYKVGLVPLKNQVFLSLGSNFTLQLVSVRLLSGPFYGIPTILQEAKNAILSVPEEAANSQVGFESAAFQLMDIKAGTSQVMVSRKGTYGRLSVAWTTGYAPGSEIPEPIVIGNMTPTLGSLSFVHGEERKGVLLWTFPSPGRPEAFVLHLSGLRSSAAGGAQLRSGFTTAEIEPMGVFQFSPSSRNITVSEDAQTIRICVQRLFGFHGDLIKVSYETTAGSAKPPEDFEAVQKGEVFFQRFQPEIDFEITIINDQLPEIEETYYINLTSVETRGLGKGGVNWRPRLNPDLSVAVVTIVDNDDLTGAAVSVPVTAGTVAVDSTLLAMETGSTTHPNKSKITTIPYTTEVFAPVTETVTVSAIPEKLATAHSVISVKPDVVPGTVVASVYGTLSIGPPIVYVSEEMKNGTLSTADILIQRMGGFAGNVTITVKTFGGRCAQKEPSVWPFQDVYGVGNLTTWAVEEEDFEEQLLTLTFLYGERERKIAVQILDDDDAEGQEFFYVFLTDPQGGAEIVRGKDSTGFSAFAVIIISGSDLHNGIIGFSEESQRGLELREGADKNSQRLVVTRQPNRAFEEVQIFWRVTLNQTVTILQEKGANLTDELRFVAGVTTCTGGQTRCFIHLELNPKKVHQVEMPFFVELYDVTAGAAINNSARFAPIKLSKSGAPQSLVSFSVGSRLAVAHKKSTLISLQVARDSGTGIMMSVNFITQELRSAETVGRVLISPAVSGKDFVRTEGTLVFEPGQKSAVLDVVLTPEAGSLNKFPKRFQIVLFDPKGGARIDKVYGTANITLISDADSQAVWGLEDLLHRPLHEDILNRVLHNLNLRVATESTDEQLSAVMLIMEKITMEGRNQAFSIKSRTLLYELLCVLINPKRKDTRGFSHFVEVAEHFAFSLLTDVTCGSPGEKSKTILDSCPYLSILALHWNPQQINGHKFEGKEGDYIQIPERLLDVPEAEMLDGKNACTLVQFVEYSSQQWFIAGDNLPALKDKVLSLNVKGQSAQPLPNNNEVLYRIHAAEPRVVPHTSRCLLWNQAAASWLSDSQFCKVVEDASDYVECACSHMSVYAVYAQTDNSSSYNEAFFSAGLICISGLCLAVVSHMFCARHSMFAAKLLTHMMVASLGTQILFLASAYASPHLSEESCSAVAAVAHYLYLCQFSWMLIQSVNFWYVLVVSDEHTERRCLLFCLLSWGLPSFVVILLILILRGIYHRSMPQIYGLIHGDLCFIPNIYAALFTAALVPLMCLVVVFVVFIHAYQLKPQWKGYDDVFRGRTNAAEIPLILYLFALISMTWLWGGLHMAYGHFWMLVLFVIFNSLQGLYVFVVYFILHNQTCCPMKASYTVEMNGHPGPSTAFFTPGSGIPPAGEINKSTQNLINAMEEVPSDWERSSFQQTSQASPDLKTSPQNGASFPSSGGYGPGSLIADEESQEFDDLIFALKTGAGLSVSDNESGQGSQEGGTLTDSQIVELRRIPIADTHL

SEQ ID NO: 790 - protein, 344 aa, Homo sapiens
MANYTLAPEDEYDVLIEGELESDEAEQCDKYDAQALSAQLVPSLCSAVFVIGVLDNLLVVLILVKYKGLKRVENIYLLNLAVSNLCFLLTLPFWAHAGGDPMCKILIGLYFVGLYSETFFNCLLTVQRYLVFLHKGNFFSARRRVPCGIITSVLAWVTAILATLPEYVVYKPQMEDQKYKCAFSRTPFLPADETFWKHFLTLKMNISVLVLPLFIFTFLYVQMRKTLRFREQRYSLFKLVFAIMVVFLLMWAPYNIAFFLSTFKEHFSLSDCKSSYNLDKSVHITKLIATTHCCINPLLYAFLDGTFSKYLCRCFHLRSNTPLQPRGQSAQGTSREEPDHSTEV

SEQ ID NO: 791 - protein, 823 aa, Homo sapiens [sequence omitted]

SEQ ID NO: 792 - protein, 652 aa, Homo sapiens
MQGPLLLPGLCFLLSLFGAVTQKTKTSCAKCPPNASCVNNTHCTCNHGYTSGSGQKLFTFPLETCNDINECTPPYSVYCGFNAVCYNVEGSFYCQCVPGYRLHSGNEQFSNSNENTCQDTTSSKTTEGRKELQKIVDKFESLLTNQTLWRTEGRQEISSTATTILRDVESKVLETALKDPEQKVLKIQNDSVAIETQAITDNCSEERKTFNLNVQMNSMDIRCSDIIQGDTQGPSAIAFISYSSLGNIINATFFEEMDKKDQVYLNSQVVSAAIGPKRNVSLSKSVTLTFQHVKMTPSTKKVFCVYWKSTGQGSQWSRDGCFLIHVNKSHTMCNCSHLSSFAVLMALTSQEEDPVLTVITYVGLSVSLLCLLLAALTFLLCKAIQNTSTSLHLQLSLCLFLAHLLFLVGIDRTEPKVLCSIIAGALHYLYLAAFTWMLLEGVHLFLTARNLTVVNYSSINRLMKWIMFPVGYGVPAVTVAISAASWPHLYGTADRCWLHLDQGFMWSFLGPVCAIFSANLVLFILVFWILKRKLSSLNSEVSTIQNTRMLAFKATAQLFILGCTWCLGLLQVGPAAQVMAYLFTIINSLQGFFIFLVYCLLSQQVQKQYQKWFREIVKSKSESETYTLSSKMGPDSKPSEGDVFPGQVKRKY

SEQ ID NO: 793 - protein, 351 aa, Homo sapiens
METNFSTPLNEYEEVSYESAGYTVLRILPLVVLGVTFVLGVLGNGLVIWVAGFRMTRTVTTICYLNLALADFSFTATLPFLIVSMAMGEKWPFGWFLCKLIHIVVDINLFGSVFLIGFIALDRCICVLHPVWAQNHRTVSLAMKVIVGPWILALVLTLPVFLFLTTVTIPNGDTYCTFNFASWGGTPEERLKVAITMLTARGIIRFVIGFSLPMSIVAICYGLIAAKIHKKGMIKSSRPLRVLTAVVASFFICWFPFQLVALLGTVWLKEMLFYGKYKIIDILVNPTSSLAFFNSCLNPMLYVFVGQDFRERLIHSLPTSLERALSEDSAPTNDTAANSASPPAETELQAM

SEQ ID NO: 794 - protein, 353 aa, Homo sapiens
METNFSIPLNETEEVLPEPAGHTVLWIFSLLVHGVTFVFGVLGNGLVIWVAGFRMTRTVNTICYLNLALADFSFSAILPFRMVSVAMREKWPFASFLCKLVHVMIDINLFVSVYLITIIALDRCICVLHPAWAQNHRTMSLAKRVMTGLWIFTIVLTLPNFIFWTTISTTNGDTYCIFNFAFWGDTAVERLNVFITMAKVFLILHFIIGFTVPMSIITVCYGIIAAKIHRNHMIKSSRPLRVFAAVVASFFICWFPYELIGILMAVWLKEMLLNGKYKIILVLINPTSSLAFFNSCLNPILYVFMGRNFQERLIRSLPTSLERALTEVPDSAQTSNTHTTSASPPEETELQAM

SEQ ID NO: 795 - protein, 648 aa, Homo sapiens [sequence omitted]

SEQ ID NO: 796 - protein, 292 aa, Homo sapiens
  misc_feature (92)..(92): Xaa can be any naturally occurring amino acid
MSAGNGTPWDATWNITVQWLAVDIACRTLMFLKLMATYSAAFLPVVIGLDRQAAVLNPLGSRSGVRKLLGAAWGLSFLLAFPQLFLFHTVHXAGPDPFTQCVTKGSFKAQWQETTYNLFTFCCLFLLPLTAMAICYSRIVLSVSRPQTRKGSHAPAGEFALPRSFDNCPRVRLRALRLALLILLTFILCWTPYYLLGMWYWFSPTMLTEVPPSLSHILFLLGLLNAPLDPLLYGAFTLGCRRGHQELSIDSSKEGSGRMLQEEIHAFRQLEVQKTVTSRRAGETKGISITSI

SEQ ID NO: 797 - protein, 319 aa, Homo sapiens
MPFPNCSAPSTVVATAVGVLLGLECGLGLLGNAVALWTFLFRVRVWKPYAVYLLNLALADLLLAACLPFLAAFYLSLQAWHLGRVGCWALRFLLDLSRSVGMAFLAAVALDRYLRVVHPRLKVNLLSPQAALGVSGLVWLLMVALTCPGLLISEAAQNSTRCHSFYSRADGSFSIIWQEALSCLQFVLPFGLIVFCNAGIIRALQKRLREPEKQPKLQRAQALVTLVVVLFALCFLPCFLARVLMHIFQNLGSCRALCAVAHTSDVTGSLTYLHSVVNPVVYCFSSPTFRSSYRRVFHTLRGKGQAAEPPDFNPRDSYS

SEQ ID NO: 798 - protein, 356 aa, Homo sapiens
MNGVSEGTRGCSDRQPGVLTRDRSCSRKMNSSGCLSEEVGSLRPLTVVILSASIVVGVLGNGLVLWMTVFRMARTVSTVCFFHLALADFMLSLSLPIAMYYIVSRQWLLGEWACKLYITFVFLSYFASNCLLVFISVDRCISVLYPVWALNHRTVQRASWLAFGVWLLAAALCSAHLKFRTTRKWNGCTHCYLAFNSDNETAQIWIEGVVEGHIIGTIGHFLLGFLGPLAIIGTCAHLIRAKLLREGWVHANRPKRLLLVLVSAFFIFWSPFNVVLLVHLWRRVMLKEIYHPRMLLILQASFALGCVNSSLNPFLYVFVGRDFQEKFFQSLTSALARAFGEEEFLSSCPRGNAPRE

SEQ ID NO: 799 - protein, 412 aa, Homo sapiens
MGSPWNGSDGPEGAREPPWPALPPCDERRCSPFPLGALVPVTAVCLCLFVVGVSGNVVTVMLIGRYRDMRTTTNLYLGSMAVSDLLILLGLPFDLYRLWRSRPWVFGPLLCRLSLYVGEGCTYATLLHMTALSVERYLAICRPLRARVLVTRRRVRALIAVLWAVALLSAGPFLFLVGVEQDPGISVVPGLNGTARIASSPLASSPPLWLSRAPPPSPPSGPETAEAAALFSRECRPSPAQLGALRVMLWVTTAYFFLPFLCLSILYGLIGRELWSSRRPLRGPAASGRERGHRQTVRVLLVVVLAFIICWLPFHVGRIIYINTEDSRMMYFSQYFNIVALQLFYLSASINPILYNLISKKYRAAAFKLLLARKSRPRGFHRSRDTAGEVAGDTGGDTVGYTETSANVKTMG

SEQ ID NO: 800 - protein, 361 aa, Homo sapiens
MNESRWTEWRILNMSSGIVNASERHSCPLGFGHYSVVDVCIFETVVIVLLTFLIIAGNLTVIFAFHCAPLLHHYTTSYFIQTMAYADLFVGVSCLVPTLSLLHYSTGVHESLTCRVFGYIISVLKSVSMACLACISVDRYLAITKPLSYNQLVTPCRLRICIILIWIYSCLIFLPSFFGWGKPGYHGDIFEWCATSWLTSAYFTGFIVCLLYAPAAFVVCFTYFHIFKICRQHTKEINDRRARFPSHEVDSSRETGHSPDRRYAMVLFRITSVFYMLWLPYIIYFLLESSRVLDNPTLSFLTTWLAVSNSFCNCVIYSLSNGVFRLGLRRLFETMCTSCMCVKDQEAQEPKPRKRANSCSI

SEQ ID NO: 801 - protein, 363 aa, Homo sapiens
MGPGEALLAGLLVMVLAVALLSNALVLLCCAYSAELRTRASGVLLVNLSLGHLLLAALDMPFTLLGVMRGRTPSAPGACQVIGFLDTFLASNAALSVAALSADQWLAVGFPLRYAGRLRPRYAGLLLGCAWGQSLAFSGAALGCSWLGYSSAFASCSLRLPPEPERPRFAAFTATLHAVGFVLPLAVLCLTSLQVHRVARRHCQRMDTVTMKALAVLADLHPSVRHGCLIQQKRRRHRATRKIGIAIATFLICFAPYVMTRLAELVPFVTVNAQWGILSKCLTYSKAVADPFTYSLLRRPFRQVLAGMVHRLLKRTPRPASTHDSSLDVAGMVHQLLKRTPRPASTHNGSVDTENDSCLQQTH

SEQ ID NO: 802 - protein, 333 aa, Homo sapiens [sequence omitted]

SEQ ID NO: 803 - protein, 365 aa, Homo sapiens
MNITNCTTEASMAIRPKTITEKMLICMTLVVITTLTTLLNLAVIMAIGTTKKLHQPANYLICSLAVTDLLVAVLVMPLSIIYIVMDRWKLGYFLCEVWLSVDMTCCTCSILHLCVIALDRYWAITNAIEYARKRTAKRAALMILTVWTISIFISMPPLFWRSHRRLSPPPSQCTIQHDHVIYTIYSTLGAFYIPLTLILILYYRIYHAAKSLYQKRGSSRHLSNRSTDSQNSFASCKLTQTFCVSDFSTSDPTTEFEKFHASIRIPPFDNDLDHPGERQQISSTRERKAARILGLILGAFILSWLPFFIKELIVGLSIYTVSSEVADFLTWLGYVNSLINPLLYTSFNEDFKLAFKKLIRCREHT

SEQ ID NO: 804 - protein, 378 aa, Homo sapiens
MVWGKICWFSQRAGWTVFAESQISLSCSLCLHSGDQEAQNPNLVSQLCGVFLQNETNETIHMQMSMAVGQQALPLNIIAPKAVLVSLCGVLLNGTVFWLLCCGATNPYMVYILHLVAADVIYLCCSAVGFLQVTLLTYHGVVFFIPDFLAILSPFSFEVCLCLLVAISTERCVCVLFPIWYRCHRPKYTSNVVCTLIWGLPFCINIVKSLFLTYWKHVKACVIFLKLSGLFHAILSLVMCVSSLTLLIRFLCCSQQQKATRVYAVVQISAPMFLLWALPLSVAPLITDFKMFVTTSYLISLFLIINSSANPIIYFFVGSLRKKRLKESLRVILQRALADKPEVGRNKKAAGIDPMEQPHSTQHVENLLPREHRVDVET

SEQ ID NO: 805 - protein, 322 aa, Homo sapiens
MDPTISTLDTELTPINGTEETLCYKQTLSLTVLTCIVSLVGLTGNAVVLWLLGCRMRRNAFSIYILNLAAADFLFLSGRLIYSLLSFISIPHTISKILYPVMMFSYFAGLSFLSAVSTERCLSVLWPIWYRCHRPTHLSAVVCVLLWALSLLRSILEWMLCGFLFSGADSAWCQTSDFITVAWLIFLCVVLCGSSLVLLIRILCGSRKIPLTRLYVTILLTVLVFLLCGLPFGIQFFLFLWIHVDREVLFCHVHLVSIFLSALNSSANPIIYFFVGSFRQRQNRQNLKLVLQRALQDASEVDEGGGQLPEEILELSGSRLEQ

SEQ ID NO: 806 - protein, 330 aa, Homo sapiens
MDPTTPAWGTESTTVNGNDQALLLLCGKETLIPVFLILFIALVGLVGNGFVLWLLGFRMRRNAFSVYVLSLAGADFLFLCFQIINCLVYLSNFFCSISINFPSFFTTVMTCAYLAGLSMLSTVSTERCLSVLWPIWYRCRRPRHLSAVVCVLLWALSLLLSILEGKFCGFLFSDGDSGWCQTFDFITAAWLIFLFMVLCGSSLALLVRILCGSRGLPLTRLYLTILLTVLVFLLCGLPFGIQWFLILWIWKDSDVLFCHIHPVSVVLSSLNSSANPIIYFFVGSFRKQWRLQQPILKLALQRALQDIAEVDHSEGCFRQGTPEMSRSSLV

SEQ ID NO: 807 - protein, 322 aa, Homo sapiens
MDSTIPVLGTELTPINGREETPCYKQTLSFTGLTCIVSLVALTGNAVVLWLLGCRMRRNAVSIYILNLVAADFLFLSGHIICSPLRLINIRHPISKILSPVMTFPYFIGLSMLSAISTERCLSILWPIWYHCRRPRYLSSVMCVLLWALSLLRSILEWMFCDFLFSGADSVWCETSDFITIAWLVFLCVVLCGSSLVLLVRILCGSRKMPLTRLYVTILLTVLVFLLCGLPFGIQWALFSRIHLDWKVLFCHVHLVSIFLSALNSSANPIIYFFVGSFRQRQNRQNLKLVLQRALQDTPEVDEGGGWLPQETLELSGSRLEQ

SEQ ID NO: 808 - protein, 322 aa, Homo sapiens
MDPTVPVFGTKLTPINGREETPCYNQTLSFTVLTCIISLVGLTGNAVVLWLLGYRMRRNAVSIYILNLAAADFLFLSFQIIRSPLRLINISHLIRKILVSVMTFPYFTGLSMLSAISTERCLSVLWPIWYRCRRPTHLSAVVCVLLWGLSLLFSMLEWRFCDFLFSGADSSWCETSDFIPVAWLIFLCVVLCVSSLVLLVRILCGSRKMPLTRLYVTILLTVLVFLLCGLPFGILGALIYRMHLNLEVLYCHVYLVCMSLSSLNSSANPIIYFFVGSFRQRQNRQNLKLVLQRALQDKPEVDKGEGQLPEESLELSGSRLGP

SEQ ID NO: 809 - protein, 364 aa, Homo sapiens
MAQQWSLQRLAGRHPQDSYEDSTQSSIFTYTNSNSTRGPFEGPNYHIAPRWVYHLTSVWMIFVVTASVFTNGLVLAATMKFKKLRHPLNWILVNLAVADLAETVIASTISIVNQVSGYFVLGHPMCVLEGYTVSLCGITGLWSLAIISWERWLVVCKPFGNVRFDAKLAIVGIAFSWIWSAVWTAPPIFGWSRYWPHGLKTSCGPDVFSGSSYPGVQSYMIVLMVTCCIIPLAIIMLCYLQVWLAIRAVAKQQKESESTQKAEKEVTRMVVVMIFAYCVCWGPYTFFACFAAANPGYAFHPLMAALPAYFAKSATIYNPVIYVFMNRQFRNCILQLFGKKVDDGSELSSASKTEVSSVSSVSPA

SEQ ID NO: 810 - protein, 371 aa, Homo sapiens
MDRGAKSCPANFLAAADDKLSGFQGDFLWPILVVEFLVAVASNGLALYRFSIRKQRPWHPAVVFSVQLAVSDLLCALTLPPLAAYLYPPKHWRYGEAACRLERFLFTCNLLGSVIFITCISLNRYLGIVHPFFARSHLRPKHAWAVSAAGWVLAALLAMPTLSFSHLKRPQQGAGNCSVARPEACIKCLGTADHGLAAYRAYSLVLAGLGCGLPLLLTLAAYGALGRAVLRSPGMTVAEKLRVAALVASGVALYASSYVPYHIMRVLNVDARRRWSTRCPSFADIAQATAALELGPYVGYQVMRGLMPLAFCVHPLLYMAAVPSLGCCCRHCPGYRDSWNPEDAKSTGQALPLNATAAPKPSEPQSRELSQ

SEQ ID NO: 811 - protein, 340 aa, Homo sapiens
  misc_feature (245)..(245): Xaa can be any naturally occurring amino acid
MNPFHASCWNTSAELLNKSWNKEFAYQTASVVDTVILPSMIGIICSTGLVGNILIVFTIIRSRKKTVPDIYICNLAVADLVHIVGMPFLIHQWARGGEWVFGGPLCTIITSLDTCNQFACSAIMTVMSVDRYFALVQPFRLTRWRTRYKTIRINLGLWAASFILALPVWVYSKVIKFKDGVESCAFDLTSPDDVLWYTLYLTITTFFFPLPLILVCYILILCYTWEMYQQNKDARCCNPSVPKQXVMKLTKMVLVLVVVFILSAAPYHVIQLVNLQMEQPTLAFYVGYYLSICLSYASSSINPFLYILLSGNFQKRLPQIQRRATEKEINNMGNTLKSHF

SEQ ID NO: 812 - protein, 423 aa, Homo sapiens
MLCHRGGQLIVPIIPLCPEHSCRGRRLQNLLSGPWPKQPMELHNLSSPSPSLSSSVLPPSFSPSPSSAPSAFTTVGGSSGGPCHPTSSSLVSAFLAPILALEFVLGLVGNSLALFIFCIHTRPWTSNTVFLVSLVAADFLLISNLPLRVDYYLLHETWRFGAAACKVNLFMLSTNRTASVVFLTAIALNRYLKVVQPHHVLSRASVGAAARVAGGLWVGILLLNGHLLLSTFSGPSCLSYRVGTKPSASLRWHQALYLLEFFLPLALILFAIVSIGLTIRNRGLGGQAGPQRAMRVLAMVVAVYTICFLPSIIFGMASMVAFWLSACRSLDLCTQLFHGSLAFTYLNSVLDPVLYCFSSPNFLHQSRALLGLTRGRQGPVSDESSYQPSRQWRYREASRKAEAIGKLKVQGEVSLEKEGSSQG

SEQ ID NO: 813 - protein, 356 aa, Mus musculus
MEIPAVTEPSYNTVAKNDFMSGFLCFSINVRAFGITVPTPLYSLVFIIGVIGHVLVVLVLIQHKRLRNMTSIYLFNLAISDLVFLSTLPFWVDYIMKGDWIFGNAMCKFVSGFYYLGLYSDMFFITLLTIDRYLAVVHVVFALRARTVTFGIISSIITWVLAALVSIPCLYVFKSQMEFTYHTCRAILPRKSLIRFLRFQALTMNILGLILPLLAMIICYTRIINVLHRRPNKKKAKVMRLIFVITLLFFLLLAPYYLAAFVSAFEDVLFTPSCLRSQQVDLSLMITEALAYTHCCVNPVIYVFVGKRFRKYLWQLFRRHTAITLPQWLPFLSEDRAQRASARLPSTVEIETSADL

SEQ ID NO: 814 - protein, 360 aa, Mus musculus
MDNYTVAPDDEYDVLILDDYLDNSGPDQVPAPEFLSPQQVLQFCCAVFAVGLLDNVLAVFILVKYKGLKNLGNIYFLNLALSNLCFLLPLPFWAHTAAHGESPGNGTCKVLVGLHSSGLYSEVFSNILLLVQGYRVFSQGRLASIFTTVSCGIVACVLAWAMATALSLPESVFYEPRMERQKHKCAFGKPHFLPIEAPLWKYVLTSKMIILVLAFPLLVFIICCRQLRRRQSFRERQYDLHKPALVITGVFLLMWAPYNTVLFLSAFQEHLSLQDEKSSYHLDASVQVTQLVATTHCCVNPLLYLLLDRKAFMRYLRSLFPRCNDIPYQSSGGSQQAPPRKGHGRPIELYSNLHQRQDII

SEQ ID NO: 815 - protein, 347 aa, Mus musculus
METNYSIPLNGSDVVIYDSTISRVLWILSMVVVSITFFLGVLGNGLVIWVAGFRMPHTVTTIWYLNLALADFSFTATLPFLLVEMAMKEKWPFGWFLCKLVHIAVDVNLFGSVFLIAVIALDRCICVLHPVWAQNHRTVSLVVGSWIFALILTLPLFLFLTTVRDARGDVHCRLSFVSWGNSVEERLNTAITFVTTRGIIRFIVSFSLPMSFVAICYGLITYKIHKKAFVNSSRPSRVLTGVVASFFICWFPFQLVALLGTVWLKEMQFSGSYKIIGRLVNPTSSLAFFNSCLNPMLYVFMGQDFQERLIHSLSSRLPRALSEDSGHISDTRTNLASLPEDIEIKAI

SEQ ID NO: 816 - protein, 351 aa, Mus musculus
MESNYSIHLNGSEVVVYDSTISRVLWILSMVVVSITFFLGVLGNGLVIWVAGFRMPHTVTTIWYLNLALADFSFTATLPFLLVEMAMKEKWPFGWFLCKLVHIVVDVNLFGSVFLIALIALDRCICVLHPVWAQNHRTVSLARKVVVGPWIFALILTLPIFIFLTTVRIPGGDVYCTFNFGSWAQTDEEKLNTAITFVTTRGIIRFLIGFSMPMSIVAVCYGLIAVKINRRNLVNSSRPLRVLTAVVASFFICWFPFQLVALLGTVWFKETLLSGSYKILDMFVNPTSSLAYFNSCLNPMLYVFMGQDFRERFIHSLPYSLERALSEDSGQTSDSSTSSTSPPADIELKAP

SEQ ID NO: 817 - protein, 343 aa, Mus musculus
MEANSSIPLNGSEVVFYDSTTSRVLWILSVIVLSITFVLGVLGNGLVIWVAGFRMAHTVTTICYLNLALGDFSFMVTLPLHIISMVMKGKWLFGWFLCKFVLSIVHINLFVSVFLITLIAMDRCTCVLHPVWVQNHRTVSLARKVIVGAWILSLLLTLPHFLFLTTVRDARGEVHCTCNFESVVANPEEQLKVSITVSTATGIISFINCFSLPMSFIAVCYGLMAAKICRKGFLNSSRPLRVLTAVAISFFMCWFPFQLIILLGNIWNKETPSSIHILLNPASTLASFNSCLNPILYVFLGQEFREKLIYSLSASLERALREDSVLSSGKSSNFSSCPADSEL

SEQ ID NO: 818 - protein, 323 aa, Mus musculus
MEVNISMPLNGSEVVFYDSTTSSVLWILSLVVLFITFVLGVLGNGLVIWVAGFQMAHTVTTVSYLNLALSDLSFMVTLPLHIISMVMRGKWLFGWFLCKLVHIIANINLFVSIFLITLIAMDRCICVLCPVWSQNHRTVSLARKVVLGAWIFALLLTLPHFLFLTTVRDARGDVYCISKFESWVATSEEQLKMSVIAATASGIINFIIGFSMPMSFIAICYGLMAAKICRRGFVNSSRPLRVLTAVAISFFVCWFPFQLIMLLGNIFNNETLSIIHMLVNPANTLASFNSCLNPILYVFLGQEFRDRLIYSLYASLERALRED

SEQ ID NO: 819 - protein, 339 aa, Mus musculus
MDLINSSTHVINVSTSLTNSTGVPTPAPKTIIAASLFMAFIIGVISNGLYLWMLQFKMQRTVNTLLFFHLILSYFISTLILPFMATSFLQDNHWVFGSVLCKAFNSTLSVSMFASVFFLSAISVARYYLILHPVWSQQHRTPHWASRIALQIWISATILSIPYLVFRTTHDDHKGRIKCQNNYIVSTDWESKEHQTLGQWIHAACFVGRFLLGFLLPFLVIIFCYKRVATKMKEKGLFKSSKPFKVMVTAVISFFVCWMPYHVHSGLVLTKSQPLPLHLTLGLAVVTISFNTVVSPVLYLFTGENFKVFKKSILALFNSTFSDISSTERTQTLNSETEI

SEQ ID NO: 820 - protein, 321 aa, Mus musculus
MEPLAMTLYPLESTQPTRNKTPNETTWSSEHTDDHTYFLVSLVICSLGLAGNGLLIWFLIFCIKRKPFTIYILHLAIADFMVLLCSSIMKLVNTFHIYNMTLESYAILFMIFGYNTGLHLLTAISVERCLSVLYPIWYQCQRPKHQSAVACMLLWALSVLVSGLENFFCILEVKPQFPECRYVYIFSCILTFLVFVPLMIFSNLILFIQVCCNLKPRQPTKLYVIIMTTVILFLVFAMPMKVLLIIGYYSSSLDDSVWDSLPYLNMLSTINCSINPIVYFVVGSLRRKRSRKSLKEALQKVFEEKPVVASRENVTQFSLPS

SEQ ID NO: 821 - protein, 370 aa, Mus musculus
MEVSNLSGATPGLAFPPGPESCSDSPSSGRSMGSTPGGLILPGREPPFSAFTVLVVTLLVLLIAATFLWNLLVLVTILRVRAFHRVPHNLVASTAVSDVLVAVLVMPLSLVSELSAGRRWQLGRSLCHVWISFDVLCCTASIWNVAAIALDRYWTITRHLQYTLRTRSRASALMIAITWALSALIALAPLLFGWGEAYDARLQRCQVSQEPSYAVFSTCGAFYLPLAVVLFVYWKIYKAAKFRFGRRRRAVVPLPATTQAKEAPPESEMVFTARRRATVTFQTSGDSWREQKEKRAAMMVGILIGVFVLCWIPFFLTELISPLCACSLPPIWKSIFLWLGYSNSFFNPLIYTAFNKNYNNAFKSLFTKQR

SEQ ID NO: 822 - protein, 304 aa, Mus musculus
MDNTIPGGINITILIPNLMIIIFGLVGLTGNGIVFWLLGFCLHRNAFSVYILNLALADFFFLLGHIIDSILLLLNVFYPITFLLCFYTIMMVLYIAGLSMLSAISTERCLSVLCPIWYHCHRPEHTSTVMCAVIWVLSLLICILNSYFCGFLNTQYKNENGCLALNFFTAAYLMFLFVVLCLSSLALVARLFCGTGQIKLTRLYVTIILSILVFLLCGLPFGIHWFLLFKIKDDFHVFDLGFYLASVVLTAINSCANPIIYFFVGSFRHRLKHQTLKMVLQNALQDTPETAKIMVEMSRSKSEP

SEQ ID NO: 823 - protein, 305 aa, Mus musculus
MDETLPGSINIRILIPKLMIIIFGLVGLMGNAIVFWLLGFHLRRNAFSVYILNLALADFLFLLSSIIASTLFLLKVSYLSIIFHLCFNTIMMVVYITGISMLSAISTECCLSVLCPTWYRCHRPVHTSTVMCAVIWVLSLLICILNSYFCAVLHTRYDNDNECLATNIFTASYMIFLLVVLCLSSLALLARLFCGAGQMKLTRFHVTILLTLLVFLLCGLPFVIYCILLFKIKDDFHVLDVNFYLALEVLTAINSCANPIIYFFVGSFRHQLKHQTLKMVLQSALQDTPETAENMVEMSSNKAEP

SEQ ID NO: 824 - protein, 302 aa, Mus musculus
MNETIPGSIDIETLIPDLMIIIFGLVGLTGNAIVFWLLGFRMHRTAFLVYILNLALADFLFLLCHIINSTVDLLKFTLPKGIFAFCFHTIKRVLYITGLSMLSAISTERCLSVLCPIWYHCRRPEHTSTVMCAVIWVLSLLICILDGYFCGYLDNHYFNYSVCQAWDIFIGAYLMFLFVVLCLSTLALLARLFCGARNMKFTRLFVTIMLTVLVFLLCGLPWGITWFLLFWIAPGVFVLDYSPLLVLTAINSCANPIIYFFVGSFRQRLNKQTLKMVLQKALQDTPETPENMVEMSRNKAEP

SEQ ID NO: 825 - protein, 313 aa, Mus musculus
MAPTTTNPMNETIPGSIDIETLIPNLMIIIFGLVGLTGNVILFWLLGFHLHRNAFLVYILNLALADFLFLLCHIINSTMLLLKVHLPNNILNHCFDIIMTVLYITGLSMLSAISTERCLSVLCPIWYRCRRPEHTSTVLCAVIWFLPLLICILNGYFCHFFGPKYVIDSVCLATNFFIRTYPMFLFIVLCLSTLALLARLFCGGGKTKFTRLFVTIMLTVLVFLLCGLPLGFFWFLVPWINRDFSVLDYILFQTSLVLTSVNSCANPIIYFFVGSFRHRLKHKTLKMVLQSALQDTPETPENMVEMSRSKAEP

SEQ ID NO: 826 - protein, 287 aa, Mus musculus
MIIIFRLVGMTGNAIVFWLLGFSLHRNAFSVYILNLALADFVFLLCHIIDSMLLLLTVFYPNNIFSGYFYTIMTVPYIAGLSMLSAISTELCLSVLCPIWYRCHHPEHTSTVMCAAIWVLPLLVCILNRYFCSFLDINYNNDKQCLASNFFTRAYLMFLFVVLCLSSMALLARLFCGTGQMKLTRLYVTIMLTVLGFLLCGLPFVIYYFLLFNIKDGFCLFDFRFYMSTHVLTAINNCANPIIYFFEGSFRHQLKHQTLKMVLQSVLQDTPEIAENMVEMSRNIPKP

SEQ ID NO: 827 - protein, 301 aa, Mus musculus
MHRSISIRILITNLMIVILGLVGLTGNAIVFWLLLFRLRRNAFSIYILNLALADFLFLLCHIIASTEHILTFSSPNSIFINCLYTFRVLLYIAGLSMLSAISIERCLSVMCPIWYRCHSPEHTSTVMCAMIWVLSLLLCILYRYFCGFLDTKYEDDYGCLAMNFLTTAYLMFLFVVLCVSSLALLARLFCGAGRMKLTRLYVTITLTLLVFLLCGLPCGFYWFLLSKIKNVFTVFEFSLYLASVVLTAINSCANPIIYFFVGSFRHRLKHQTLKMVLQSALQDTPETPENMVEMSRNKAEL

SEQ ID NO: 828 - protein, 305 aa, Mus musculus
MDETSPRSIDIESLIPNLMIIIFGLVGLTGNAIVLWLLGFCLHRNAFLVYILNLALADFLFLLCHFINSAMFLLKVPIPNGIFVYCFYTIKMVLYITGLSMLSAISTERCLSVLCPIWYHCRRPEHTSTVMCAVIWIFSVLICILKEYFCDFFGTKLGNYYVCQASNFFMGAYLMFLFVVLCLSTLALLARLFCGAEKMKFTRLFVTIMLTILVFLLCGLPWGFFWFLLIWIKGGFSVLDYRLYLASIVLTVVNSCANPIIYFFVGSFRHRLKHQTLKMVLQSALQDTPETHENMVEMSRIKAEQ

SEQ ID NO: 829 - protein, 305 aa, Mus musculus
MDKTILGSIDIETLIRHLMIIIFGLVGLTGNAIVFWLLGFHLHRNAFLVYILNLALADFFYLLCHIINSIMFLLKVPSPNIILDHCFYTIMIVLYITGLSMLSAISTERCLSVLCPIWYRCHRPEHTSTAMCAVIWVMSLLISILNGYFCNFSSPKYVNNSVCQASDIFIRTYPIFLFVLLCLSTLALLARLFSGAGKRKFTRLFVTIMLAILVFLLCGLPLGFFWFLSPWIEDRFIVLDYRLFFASVVLTVVNSCANPIIYFFVGSFRHRLKQQTLKMFLQRALQDTPETPENMVEMSRSKAEP

SEQ ID NO: 830 - protein, 338 aa, Mus musculus
MDLVIQDWTINITALKESNDNGISFCEVVSRTMTFLSLIIALVGLVGNATVLWFLGFQMSRNAFSVYILNLAGADFVFMCFQIVHCFYIILDIYFIPTNFFSSYTMVLNIAYLSGLSILTVISTERFLSVMWPIWYRCQRPRHTSAVICTVLWVLSLVLSLLEGKECGFLYYTSGPGLCKTFDLITTAWLIVLFVVLLGSSLALVLTIFCGLHKVPVTRLYVTIVFTVLVFLIFGLPYGIYWFLLEWIREFHDNKPCGFRNVTIFLSCINSCANPIIYFLVGSIRHHRFQRKTLKLLLQRAMQDSPEEEECGEMGSSRRPREIKTVWKGLRAALIRHK

SEQ ID NO: 831 - protein, 338 aa, Mus musculus
MSGDFLIKNLSTSAWKTNITVLNGSYYIDTSVCVTRNQAMILLSIIISLVGMGLNAIVLWFLGIRMHTNAFTVYILNLAMADFLYLCSQFVICLLIAFYIFYSIDINIPLVLYVVPIFAYLSGLSILSTISIERCLSVIWPIWYRCKRPRHTSAITCFVLWVMSLLLGLLEGKACGLLFNSFDSYWCETFDVITNIWSVVFFGVLCGSSLTLLVRIFCGSQRIPMTRLYVTITLTVLVFLIFGLPFGIYWILYQWISNFYYVEICNFYLEILFLSCVNSCMNPIIYFLVGSIRHRRFRRKTLKLLLQRAMQDTPEEEQSGNKSSSEHPEELETVQSCS

SEQ ID NO: 832 - protein, 312 aa, Mus musculus
MALRTSLITTTAPDKTSLPISICIIKFQVMNLLSITISPVGMVLNIIVLWFLGFQICRNAFSAYILNLAVADFLFLCSHSIFSFLIVCKLHYFLFYIRQLLDTVTMFAYVFGLSITTIISIECCLSIMWPIWYHCQRPRHTSAVICVLLWALSLLFPALQMEKCSVLFNTFEYSWCGIINIISGAWLVVLFVVLCGFSLILLLRISCGSQQIPVTRLNVTIALRVLLLLIFGIPFGIFWIVDKWNEENFFVRACGFSHHILYVYCINICVNATIYFLVGSIRHGKFQKMTLKLILQRAIQGTPEEEGGERGP

SEQ ID NO: 833 - protein, 321 aa, Mus musculus
MGTTTLAWNINNTAENGSYTEMFSCITKFNTLNFLTVIIAVVGLAGNGIVLWLLAFHLHRNAFSVYVLNLAGADFLYLFTQVVHSLECVLQLDNNSFYILLIVTMFAYLAGLCMIAAISAERCLSVMWPIWYHCQRPRHTSAIMCALVWVSSLLLSLVVGLGCGFLFSYYDYYFCITLNFITAAFLIVLSVVLSVSSLALLVKIVWGSHRIPVTRFFVTIALTVVVFIYFGMPFGICWFLLSRIMEFDSIFFNNVYEIIEFLSCVNSCANPIIYFLVGSIRQHRLRWQSLKLLLQRAMQDTPEEESGERGPSQRSGELETV

SEQ ID NO: 834 - protein, 322 aa, Mus musculus
MGLTTPAWNINNTVVNGSNNTEHFSCVSKFNTLNFLTVIIAMFGLAGNAIVLWLLAFHLPRNAFSVYVCNLACADFLQLCTQILGSLECFLQLNRRHTFFLTVVFMFAYLAGLCMIAAISVERSLSVMWPIWYHCQRPRHTSSIMCALLWAFCLLLNFLLGEGCGLLFSDPKYYFCITCALITTALIILLTVVPSVSSLALLVKMICGSHRIPVTRFYVTIALTLVVFIFLGLPFGIYSSFLIMFKEFQSIFSYHVLEVTIFLSCVNSCANPIIYFLVGSIRQHRLQWQSLKLLLQRAMQDTPEEDSGERVPSQRSGELESV

SEQ ID NO: 835 - protein, 382 aa, Mus musculus
MDGPSNVSLVHGDTTLGLPEYKVVSVLLVLLVCTVGIVGNAMVVLVVLTSRDMHTPTNCYLVSLALADLIVLLAAGLPNVSDSLVGHWIYGHAGCLGITYFQYLGINVSSCSILAFTVERYIAICHPMRAQTVCTVARARRIIAGIWGVTSLYCLLWFFLVDLNVRDNQRLECGYKVSRGLYLPIYLLDFAVFFIAPLLGTLVLYGFIGRILFQSPLSQEAWQKERQSHGQSEGTPGNCSRSKSSMSSRKQATRMLAVIVLLFAVLWTPYRTLVLLNSFLARPFLDPWVLLFCRTCVYTNSAINPVIYSLMSQKFRAAFLKLCWCRAAGSQRRAACAPTSNYSAAQETSLGTEKMQLGSREVSGPAAAASLRCQHEPHFSVL

SEQ ID NO: 836 - DNA, 3798 bp, Mus musculus
ccacgcgtccgcaatgccggctgctcgtggtccctggagtcaccgggcccccacgtgtgagggcagcagcgttacagagaggcctggctctgaggaggatgccccggccgctcgccagctccagtctgcaccatgagtgatgagcggaggctgcccagcagtgcggtaggttggctagcatgcggaggtctgtcgctgctagccaacgcctggggcatcctcagtgtgggtgccaagcagaagaagtggaagccgctggagttcttgctttgcacgctggcagccacccacatgctcaatgtggcggtacccatcgccacatatgctgtggtgcagctgcggaggcaacgtcccgactacgagtggaacgagggcctctgtaaggtcttcgtgtcgacattctacaccctcacactggccacctgcttctctgtcacctccatctcctaccaccgcatgtggatggtccgatggccagtcaactaccggctgagcaacgccaagaagcaggcggtgcacacagttatgggcatctggatggtgtccttcatcctgtcggcccttcctgccgttggctggcacgacacgagcgagcgtttctacacccacggctgccgcttcatcgtggccgagattggcctgggcttcggcgtctgcttcttgctgctggtgggaggcagcgtggccatgggcatggtctgcacagccattgccctcttccagacactggccacgcaggtggggcaccgggctgaccgccgcaccttcaccgtgcccaccatcgtggtggaagacgcacagggcaagcgtcgctcctccattgatggctcagagcctgccagaacttcgctacagatcacgggccttgtggccaccattgtggtcatctatgactgcctcatgggtttccctgtgctggtggtgagcttcagtagtctgcgggcagatgcttcagcaccctggatggcgctctgtgtcctgtggtgctccgtgacccaggccctgctgctgcctctgttcctctggacttgtgatcgttaccgggcggatctcaaggcagtctgggagaagtgtgtggcccttatggccaacgacgaagattctgacaatgagaccagtctagagggcagcatctcccccgacatggtattggagcgctctcttgactatagctatggaggtgacttcgtggctctggacaggatggccaagtatgaactctctgccctggaaggaggcttaccacagctctaccctctgcggccactgcaggaggatcggatgcagtatctgcagggcgcggggaggcatcggtgcgggtttccaggagggcagccctgtttcagcccggccgggtgctcgcaggtcccgcccacccggcggttctcccacgatgatgccgacgtgtgggcagccgtcccgctgcccaccttcctgccacgctggagctcgggcgaggacttggcagctctggcacacttaatgctgcccgcgggctccgaccggcggcgcgggagcctgctggccttcgccgaggatgcgcccccgttccgcccgcgccgtcgctctgccgagagcctgttgtccctgcagccctcgtccctagacggcggcccgcgtcacgcgcaggactcgcctcccggcagcccgcgtcgccgccccgggcctggcgcccgctccgcctcggtctcgctactgcccgacgccttcgcgctgaccgccttcgagcgcgagccgcaggctctgcgtcgcgtgcccgccccagcacaacccttccccgctgcccgggacagcgcggagcctgctgaggtcccaacgccccctggtggccgtacgcaacgcagccagggacgccgggccgcgcgcacgcacgtggggcccctgcagagcagcctgagcgcatcttggggcgagccaggcggcttgcacgcggcgggctgcggcagcattagcagctttctgagctcgccctccgagtcctcgggctacgtcacgctgcactcggactcgctgggctctgcgtcctagggctcccagagacgccatgcagagcgtggcgccatgaagaggcacagcgccaaagatgctcccacaggtgttgggcgacaataagcgccacctaagctaggggtgaatggatggtggactctgcgcttctcttacagttctttccttctggtgtcgcctggagggacgactggccaccttggatggctgcccaggacatggacctgctcctgggcaaggcatctcccaggaaggggcaggctgtgcctgtgtagcgagtggcatctgcactttttgtacagctctgaggctagtccagggcgtagggaaccctgagacccgaccaccatgagaaagtacgttcctagagaagcttaagccggaagtcacgactgcatccaacttcctgcactgccgctgcctcacctcaaggtgtagcatgtagaacgaccccaagcacaagggtcttcagagcccaaacaagttctattgagcaggcgtcccatgtggcctgcctcagtttccctatctctaagagtgaatgaccatgatacatctctcagggctgtttgaagaactctcccggtctgtgtgccctcgcacttgaatggaccaggtgtgagaggtagtgagggccctttgttagggtcagccttcagcacgtgggccccaattgaggcccctcagtcttaatgacctttgccctcttggagacttgccccactttagctaaagcacaacaccatgggtatataacagccacctggacccctgttagtgtccccatgctcaaaattccaccatattgcctgtctcccactatgtcggccgcttccgtggtcctgctgtgaaggctgctggtgcctatcgcagagaaccaaagctcgtggaagtggactttcgtgtctcagtgcccatctccagttttgcctcccacaggcaaagtccttggaaagggtgtcctgtaccccacttcccctgcaagaagggctttgctctctcctgggtctgggctgtgccagggacatgggtattcccaggagagtctgggagctgggagcagagggggagagctgtcaccagacagcggaccctctgtgttgggacctggagatagtcttaaggccagcacagaaccagcctgtgtctccttgttcttgagacgtggtggacaggcctgtctcctctccctctgcagacagatttccaaccacagctggggatgagggaggagggctggcctaccctaggcctcagaggtctctgttatccctggttaagtaaaagatcagccaccacagaagagtagagcaggggactgtggtccatgattggatttgggagaagctgcctctggccatttgctgctgtgccttcagggactgacatgtcatacaggggcagaggccaccagctagccactgtctctctcacaggtctcaaatgaccaatttaccacttgggtttcactctgtattttgtattcaatggcaatacttgtagtggggacatagtccccctcagtcactcctgatttttacaaaactttaagggcaaaccctgaactgagggccgtaggcacctagggctctttcccacactaagtccagcctccctgtttgctgacagctctagctatctctataccaccacccagcccagaggcagggattcgtttgtattttttttttttttggaaaaaacaaaacaaaacaaaacagcgtttcttttctgtacaggacccaataaaaaattcctcatggtttgcaaaaaaaaaaaaaaaaaaaaaaa

SEQ ID NO: 837 - DNA, 3258 bp, Mus musculus
accactgcttcattgctgctgagaatgttccaggctgagtgagaagtaaaaattcatcatctctgaagaactcttacccagccctgttgaagaaattcccagaatgttgatgggagcaactagagatatgggaagcaggtgccttctgcatgcctcagttcctggaatgctgcttatctggtcaatattacaaatgatgaatatttcagcttcctgtccccagtgcaatgaaaatgccagctgcttcaacagcacccactgtgtttgtaaagaaggattctggacgggctctgagaatagaagaattattgagccccatgagaaatgtcaagatattaatgagtgtctactgaaagaattggtatgcaaggatgtgtcgtactgcagaaataaaattgggacttacatatgcagctgtgtagtaaaatatcctttgttcaactgggtagctggcattattaatattgatcaccctgattgttatgtgaacaagagcaagaatacaggatcaaaaacacatactttgggagtactgagtgaatttaaatccaaagaggaggttgcaaaaggagctaccaagttacttcgcaaagtggaacatcacatcttgaatgaaaactcagatataccaaaaaaggatgaaaatcctttattggatatagtgtatgaaactaagaggtgcaagacgatgactcttctagaagctggcaacaacacaatgaaggttgactgcactagtggtttcaaagagcacaacagtggaggtgaaactgcagtggctttcattgcatataagtctcttgggaatcttctaaatggttccttttttagtaatgaagaagggtttcaggaagtgacactgaactctcacatcgttagtggagccattcgctcagaggtcaaacctgtcctctctgaacctgtactcctgactttacaaaatattcagcccattgactcaagagcagaacatctctgtgtccattgggaaggatcagaggaaggggggagctggtctaccaaaggatgctctcacgtgtacaccaataattcctacaccatttgcaagtgtttccacctgtccagctttgctgtgctcatggctctaccccatgaggaggatggtgtgctttctgcactctctgtgatcacctatgtgggactgagtctttctctcttgtgcctatttctggcggccatcacttttctcctgtgccgacccattcagaataccagcacgacactccacctgcagctctccatctgccttttcctggctgacctcctcttcctcacaggcatcaacagaactaagcctaaggtgctgtgctccatcatagcggggatgttgcactacctctacttggcttccttcatgtggatgtttctggaagggctacatctttttctcactgtgagcaatctcaaagtggccaactacagcaactcaggcagattcaagaagaggttcatgtatcctgtaggatatgggcttcctgcttttattgttgctgtatctgcaatagctggccacaagaattatggaacacacaaccactgctggctcagccttcatcgaggattcatctggagcttcttggggccagcggcagccattatcttgataaacctggtgttctactttctaataatatggattttgagaagcaaactttcttctctcaataaagaagtttctacacttcaagacacaaaggttatgacatttaaagccattgtccagttatttgtgttgggatgttcttggggcattggcttgtttattttcattgaagttgggaagacagtgagactgatcgttgcctatctgttcaccatcatcaatgtcctgcagggtgttttgatatttatggtacattgtctgcttaatcgccaggtgcggatggaatataagaagtggtttcatagactgcggaaggaagttgaaagtgaaagcactgaagtgtctcattctactactcacacaaaaatgggtctttctctgaacctggaaaatttctgcccaacaggaaacctccatgatccttctgactccatccttccaagtactgaagtagcaggtgtatatctaagcacacccaggtctcacatgggtgctgaggatgtgaactcaggtactcacgcttactggagcagaactattagtgattgaatcagctccttcccccaagcctcttacagtacattttaacttgtactgtgccatgcacatgaagctataattgctagtctggtaaaacaactgttgcatattccatgatcatttcattttatctctacttgcaaaagttagctttctttttatatcatttttatttctctttcttttgtttatatatagcttcagttgagtgggtttctagtcttaatgttctagatcactattttcttttcagttaacctttattggtatttagttcctgtgtagtgtataccactggaatatttttatttctttaattttgaggttaaaatatagttacatcatttttcctttttttctttcccacaatcctcctgtatactttttccctggtgtctattttattgtttctacatgcatatatattttatgcaaaacatatatatgtataaatataaatatatattcttatatgcatgaaaaccatctacttcatccaaataatgttccttctatgtatgttttcaggacagggacaacaatagctatggtagcatggcaggggaaagcccacaggacctcagccttatacaaagaatcagaggcaactgaggagtgctgagttgaaggaattgtcttacccaggggagggcacattaattggttatctaatacaaaatgttcagccccaaaactgttaagataaaagcctatatgcatcttaggaagtatctaccttgatacacctttattggaatatcatccacatgtttattgtgtgttctgaagagggtctgttgaatttctaagggttgatcagtttaattgtgccattttatattcagggtgtttggctttgttgtagtgaataatgctatatttccctgtatgtgtcatctttgactgttattttttcctggcgatactttattcaacaagaacctagagccttggtttattactttttcttccatagaaaaactatttgtcttccaggattagatatgatcaatatttcttatatgcatgtatcaaatatcatgatgaaatatattactgtgtataattaataactggcaataaagtccaaggga

SEQ ID NO: 838 - DNA, 2097 bp, Mus musculus
atgaagccctggattgccatggtttgctgtttagtattttttctgacaacagaatgttctcattccaaacccaagactcacagaaaagatgaagataaatttcaaatatctctacagaagcatgagtttagaccaagacagggtaaatgtgatggactgtgcagctcttcttccagctgtaaccagagctgtccttggaacttccgtggagaaatcgtattcacatgtaatcaaaacaaatggcaaaaaacaatcgaaacatgcacaagtctctctgtggacaccttgtttcagcgcatacatcctgcagctagcctatccttggcgtcttcttctgtttttcccatgagcttaattggcaatgcagcaccagtccatattggaaatgtatttcaaggaatccaaaagtactgccccgaggactacgtttgcattgttgatgctgtgaaatcctctgcagttacatctggaaatattgcattcatagtagagttattaaaaaatatctcttcaaacctgcaaacttctggaatacatgataatgtgaattggaagaaaatgaagaactatggcaaagtggccaaccatatccttggccccactgccatttcaaattgggctttcattgccaacaaaaatgccagctcagatctgttggagtcggtgaactcttttgccaagaaactccaaatccaaggtaaatctgagagcatcgtagatgaactctttattcagacgaaaggctctcgtatctctcacagttcctcagagcacagcctcagcctctctgtacccaggtacaatgctacagaagatgtcttagtggtgatcgaaattcctaggcaagcattacaggagctgtcgttcaatgcctcccaagccattgttgtcgcttttccaaccttgggggccattctaaaagaagtccatcggccaaatacaaatctccaaaagcctatagatgacctcatcctatcactggttttgccagaaggtctgaacgaaatcatactcacctttgataaaatcaataaatcccagagcaccagcagccagtgtgtcagctgggatcctgcaacagggcagtgggatgagagcccatgtacagtgatgtcagacatcaatagcacagtgaaatgccggtgcaggcacaccaaagctgtgacgtccttctccatcctcatgtcttctaagcctgtaaagaatacgattctgaaccatatcaccttcattggactcagcatctccatctttagcttggtgctctgcctggtcattgaggccatcgtctggtcccgggtggttgttacagagatatcctacatgcgccacgtgtgcatcgtgaacattgcagtgtccctcctgactgccaatgtgtggttcatcattggctccaacttcagtgccaacgttcaggaggatcacaagtggtgtgtggctgtgacatttctctgccacttcttcttcctctccctgttcttctggatgctcttcaaagcgctgctcatagtctatggaatactggttgtcttccgcaggatgatgaagtctcggatgatggccattggctttgccattggctatgggtgtccccttgtgatcgcggtcatcactgttactgtcacagagcctggggaaggctacaccagaaaagatgcctgttggcttaattggaaccaaaccaaagccctttttgcttttgctatcccagccttggccattgtggctgtgaatctccttgtggttctggcagttgctatcaacacacagaggcccttgattggcagttcaaaatctcaggatatggccattgttttcaggatcagcaaaaatgttgccatcctcaccccacttctgggactgacctggggttttggtctaacaaccctgctagaaggcgtacacctggtattccatataatcttcgccttgctcaatgctttccagggctttttcatcttgctgtttggtaccattatggatcacaagataagagatgctctgaggatgagggtatcttcattgaaggggaaatcaagggcagcagagaaggtgtcattaagtccagccaatggatccagaatactgaatcgctga

SEQ ID NO: 839 - DNA, 3874 bp, Mus musculus
ccacgcgtccgagcaacctggcctgagctggtgatagatacatcagtggacctgtggctgccagtcctgtcctgggtcaccagcgtcccttggcatctcccaacggtgccagtggctggggaacactggagaaaggctcagctgtgctgtgaagtccagagtcccaggtcagagagcaggagctgagagcagcatctgatgggaatggcagtgtgcacatgaagtttaagtttgccaagaagcaagcacacagcctccagggtgactagacacgggtgtctgtgttcagtccagagaggagagaaggaactactggatatgagaattggacttctgtggctcgtccctctcttcacgctcactgagggcaccgatggcttcctgcagcagaaaaatgatggccgaagaacaaaagaaattgtcagtatggttgaggaaaggcatccagtccacgagtatgaggtgctactgcaggtgacatacagagatccagaggagaagagagaactgaagagatttctgaagctcttgagatctccgtcgccgagtttacgtggtcccagcaagatcatcagagtgaaggccaccacatactgcagaagccgaaaagggttcctggagtgtgcctgcgaagacagctatacgtggtttcctccctcctgccttgacccccagaactgctgccttcacacaactggacccgtcccaagctgcaattgctctctcagaggcctcaggcagagtgttaatttctgtgagagagcaaaagtttggggcacttttgaaatcgatgaaaattttcctgaagacctttggaattcatcatctgatgtatatgcccactacacagttggaattgaaaatcaactgaaagaagcgtacagaagagtccatggttttgagtcagttcgggtcacccaatttcggaagggaagcatcgttgttggctatgaagtgaccggctccactagccctcctgaactcctctttgccattgaacaggaggccgaaaaggcacaggaggccctgaggaggcagtttccagtcaaatatggctcttttcgagtattcgggaaagctccgtgtaacagcatctcctttggattcgggtctgagaacgatgaatatactgtgccctgcagcagtggcttcacaggaagcatgacggtcaggtgccagtcctctgggtggcagatcaccagggagtcctgtgtgctctctcagctggaagaactgaagaaggagctcaggatgatcgcaggcaagatcacagaggcgggtgtggcatctttggtgcaaaacctttccaccatccttttgcaaagtccatcgaccacagttgggaacctgggctctgtggtgtcacttctgagcaacatttcatccctgtcgctggcaaactctttaactgtgtccaatctgacactgatgaacgtcatcaacatagctgatcatatcctggattcagcctccataacgaactggacaattttattacaagatgcaaaggatgccagctcccagctactaaagacattggaaagcatcagtagtctcatcccttccatggctctgcctcttaatttttctggaaaattcattgactggaaagggaccccagtgacccaaatccagagcacacggggctacaactatcagatggaaatgagacaaaatgcctctctgcctatccgaggccacgtgtttattgaaccagatcaattccagaaatcgcatccaaagactattatcagcatggcctcattgacctttggggacattctacccattacccagagaggaaatgcatgggtcaatggcccagtgatatccacacttattcaaaactattccatcagcgaaattttcctgaacttttccaaaataaagggaaacctgactcagcctcgctgtgtgttttgggattttagccagttgcaatggagcaatgcaggctgccaactggttaatgaaactctggacacggtactgtgccgatgtagtcacctgacctctttctccatgctcatgtcaccctttgtcccctcttctgttgttcctgtggtaaaatggatcacgtacatagggctgagcatctccattgcaagtctaatcttatgcttgatcatcgagtctctgttttggaagcagaccaagagaagccaaacctcctacacacgcaacatttgcctggtgaacatcgccgtgtcactcttaattgctgatgtttggtttatcattgctgccactgtggacccctctgtgagtccttctggagtctgtgtggctgcggtgttctttacccactttttctaccttgccgtattcttttggatgctcgttctgggcatcctgctggcttatcgaattatcctagtgtttcatcacatggctctgactaccatgatggctattggcttttgcctaggctatgggtgccctctccttatatccatcatcacccttgctgtcacccaacctagcaatagctataaaaggaacgatgtgtgttggcttaactggtctgacaagagcaaacctctcttggcgttcgttgttcccgcgttgactattgtggctgtgaacttggttgtggtgttgctggtcctcaggaagctttggaggccagcagttggagaaagactgaatcaggatgacaaggccactgccatccgcatgggaaagagcctcctcgtgctgaccccgttgctagggctcacctggggctttggcataggaacaatggcgaacagccacaatctggcttggcatgttctttttgctttactcaatgctttccagggatttttcatcttctgttttggaattctcctggataccaagctgcggcaacttctgtccaacaagttgactacattaagttcatggaagcaaacatcaaaacggaacgcctcagatacagttactcagccgaaatgcttaaggacattcaacatactacagcacagaggcatgtatgcactttctcatactggagattcgtccagtgacatcacattaacccagtttttatcaaccgaataaagccacgagtcacaagcaagggcaatttttttctttgagcaacatgccattcagagccacacagcaggcagcgaagacaagcacagagtcaggtgagactttgtgacttgggagtccaaggataaaactggttactctgaggttggagagatggctcagcggctaagagcacttgttgctcttgcagaggacctggactcaattcccagcacccacgtgggggatcacaaccacctgttccaagggatctaccgccctcttctgacttctatgagcacaacatgcgtatgcggtacatagacgtacatgccgacaaaacattcatacaccaaattaatctttttaacaaacccaataggtgacttcagtgattcaactctgcctcctttattccaaattaaatagaaatgttattaattacaaagtgagctaagaaatatcatacattgttcatacaagtctttgtcaatgagcaccctccaccccagtatctccagtcactagggaaaattaaaacaccaataaaatagagctatacacttactagaatatctgtccaaacaattcaaaccccaccctagagagcactgcataattctatttgtcctgaatcctagtcaggcaagacggtccacagtaaagtaggtcagtcattttagggtggagtttgagtggtgaattccacagcataaggaaggagtatgcaaattcccctgggaggtgacatatacatccagtgtcttgatgataatggtggtttggctatgtatgcactaatcaaaacatgttgcatattacaggcaattaatatgttaaaaaaaaaaaaaaa

SEQ ID NO: 840 - DNA, 4025 bp, Mus musculus
gattttaagcaacaacaagatctccgagctgaagaatggttcattttctggcttaagtctcctcgaaagactggacctccggaacaaccttattagtaggatagccccaggtgccttttggggactgtcttcactgaagagattggacctgacgaacaaccgaataggttgtctgaatgcagatgtatttcgaggactcaccaatctggttcggctaaacctttcagggaatctgtttacttcactgtctcaaggaacttttgattatcttggctcgttgcggtctttagaatttcagactgagtaccttctgtgtgactgtaacattctgtggatgcatcgctgggtaaaggagagaaacatcactgtgcgagacaccaggtgtgtttatcccaagtcactgcaggcccagcctgtcacgggggtgaaacaggagctcctcacttgcgatcctccccttgaactgccgtccttctacatgactccgtcgcaccgccaggttgtgtttgaaggagacagccttcccttccagtgcatggcttcctatatagatcaggacatgcaagtgctgtggtatcaggatgggcgcattgttgagaccgatgagtcccaagggatctttgtggagaaaagcatgatttacaattgctccttgatatccactgccctaaccatttctaatattcaagctggatctactggaaattggggctgtcatgttcagacgaaacgtgggaataacacaagaactgttgacattgtggtattagaaagctccgcccaatactgtccaccagagagggttgtgaacaacaaaggtgatttcagatggcccaggacactggcgggcatcacagcatatctccagtgtacccggaacacccacagcagtgggatctaccctggaagcgcacaggatgaaaggaaggcgtggcgccgatgcgacagaggtggcttttgggcagatgatgattattctaggtgccagtatgcaaatgacgtcactagagtcctgtatatgtttaatcagatgcccctcaaccttacaaatgcggtcgctacagctcggcagctgctggcttacacagtggaggccgccaacttctctgacaaaatggacgttatatttgtggctgaaatgatagaaaagtttggaagatttaccagagaggaaaaatcaaaagagcttggtgatgtaatggtcgatgtggcaagcaacatcatgttggctgatgagcgggtcctgtggctggcacagagggaagcaaaggcctgcagtcggattgtccagtgcctgcagcgcattgccacacatcgcctggccagtggggcccacgtgtactccacgtactcgcccaacattgctctggaggcttacgtcatcaaggctgctggcttcacaggaatgacctgctccgtgttccagaaggtggctgcctccgaccgtgcaggtctttctgactatgggcgaagggacccggatggaaacctggataagcagctgagcttcaaatgcaatgtctccagcaccttctcaagcctggccctgaagaacaccatcatggaggcctccattcagcttccttcctcccttttgtcaccaaaacacaagcgagaagcccgagcggcggatgacgccctctataagctccagctcattgccttccgcaacggaaagctttttccagccacaggaaattcaacaaagttggcagacgatggcaagcggcggacagtagtgacccctgtgatcctcacgaaaatagatggtgcaaccgtagatacccaccacatccctgttaatgtgacgctgcgccgaattgcccacggagcagatgcggttgcagcgcagtgggactttgatttgctgaacggacaaggaggctggaagtcagatgggtgctgtatactctactcggatgagaacatcaccaccattcagtgcggctccctgggcaactatgctgtgctaatggatctgactgggacagagttgtacaccccagcagccagtctcctgcaccctgtggtttacaccactgccatcactctcctcttgtgtctcttggctgttatcatcagttacatgtaccaccacagcttgatccgaatcagtctcaagagctggcacatgcttgtgaacctgtgctttcacattctcctgacctgcgtggtgtttgtgggaggaataacccagaccagaaatgccagcgtctgtcaagcagttgggatcattcttcattattctacccttgccacggtattgtgggttggagtcactgctagaaatatctataaacaagtcaccaagaaagccaagagatgccaggatccagatgagccacccgctcctccacgaccgatgctgaggttctacctgattggtggtgggatccccatcatagtgtgtggtatcaccgcggcagcaaacatcaagaactatggcagtcggcccagtgcaccgtattgctggatggcctgggaaccgtccttgggagccttctacggacctgccagcttcatcacttttgtaaactgtatgtattttctaagcatatttattcagttgaaaagacaccctgagcgcaaatatgagctcaaggagccgacagaagagcagcagagattggcagccaatgaaaatggtgaaatcaaccatcaggactccatgtctctgtctctcatctctacgtccacgttggagaacgagcacagttttcagtctcagcttctgggcgccagccttactttgcttttgtatgtcatcttgtggatgtttggggccatggctgtttctctgtattaccctctggacttggtttttagcttcttcttcggagccacttgtttaagcttcagtgctttcatgatggtgcaccactgcatcaacagggaggacgtgagacttgcgtggatcatgatgtgctgcccagggcggagctcgtactccgtgcaagtcaacgtccaacctcccaactcaagcgccactaatggagaggctccaaagtgcaccaatagcagcgcagagtcttcgtgcacgaacaaaagcgcatcgagcttcaaaaactcttcccagggctgcaagctgacaaacttgcaggctgctgcggcacagtaccacagcaatgccctacctgtgaatgccacgccgcagcttgataacagtctgaccgaacactcgatggacaacgatattaaaatgcatgtggctcctttagacgtgcagtttcgaacaaacgtgcacccaagccgccaccacaaaaaccgaagtaaaggacaccgggccagcaggctcacagtcctgcgagagtatgcctatgacgtcccaacaagtgtggaaggaagcgtgcagaatggcttacctaaaagccggccaggcagcaatgaaggacattcaaggagtaggagagcttatttagcctacagagagagacagtacaacccaccccaacaagacagcagtgatgcttgtagcacacttcccaaaagtagccgaaatgttgaaaagcctgtttcaactagtagtaagaaagatgcaccaaggaagccagctgcagccgaccttgaaagtcagcagaaatcttacggcctgaacttggctgttcagaatggaccagttaaaagcaatgggcaggaaggacccttgctagctaccgacgtcactggtaatgttaggactgggttatggaaacacgaaacaactgtgtagcattgcaggggcttccaagacaaggtgaaactgtggtactcacattcctttaagctatgaactcttagaaacaaactgtttacagccaccttggggatacaaagccgttctgagtattcttgtgagctttgggatttacttattttatattcccaaattgtcccccactccccccaagagttaaaaatgttttaaaacattgttttacttgtcaaagcaccaataagatattttggaagttgaaaatataatttcttagaatctgttatatctgcgtaacatctgagacttgtatttaataaactaaatagaagtt

SEQ ID NO: 841 - DNA, 2994 bp, Mus musculus
atgtcctctctagctctctcccagctgctcctggccgtgactcttcccctgctggagttggagccaacatttgtccccacagcccaatcagagctcagtccatatggagggaaatctgggcagcaactgaaccagtacagtggagaaggggaatcagtgctggtctccagctatgtgcatctggaattttcaagcacagcctggccacaggagctctctaaaaactttactcttcctaccgccctggcagtccttcccccgaaaacgcttactggccttggccttacaacagagtgtcgtgctaaccacagcggaaccagcctctgcacttgccaccctggctaccaatggaatgccacactttgttccctttacccacactgctggggccgcaggtcagaaagagattcctgtatgtgtcgcagcttccacggtcctgttactggctactgccagttgctgccacctgttcctgcaaacctgatactggactcccagctgcaaatgcacggcaacaccctgaacctcattctcctcaagaaagaggaagccacaaacctgagatggttcttgagacactcaaagaaccacacacccatcagcctatggccagggaccaatgtgttgcagacgtccagtgagggccagtctggccttcgtgtcgcccgcatgtcccgtcattgggcaggtgagtacgagagcatcttcgaagcccaggggttcaggtggaggctgcggcagctggtgaaggtgcccttgcaggaggaagaagtcgttcgactcccagacgccctgtccatctcctgtactgcctccactggctttcagctgagctgctgcatcccacttacaacagactacactgctacctggagtcctggggaggacagccaagcctccttgcaaaaaatgtcggattcccaatgctttgtgctagctgttccgcactgcccagcaaccaataccacatacacctgtacccttcagagtcagaacctgcctcctctcgtggctcctgtctctatcacgattatccaggatggagacactacctgccctgaggacttctcagtggttagctggaatgtcaccaaggctggcttcgtggcacaggccccatgtcctgtgaataagaaaggtgtggtaaagaggctctgtgggactgatggcatctggaggccagtccagaacacctgcacagaagcaaagatcctaaccttgtgtcttaaagccaagctgctgctggaaggccagggaaagccctacgaggaagtgccatggatcttgagtgagctgcaagagcaggtgggcgtggccagcaccccctctgacttatgggaaatgctgcacactgtgaccttactggccaaggtggtagcagagacaagcacagagctcacaggcagtgctctgaaggacctcctgacgaccacagacaagattctagacgcgaacatcagcgctctgtggactctggcccaggcccaggagccctccatgggctcagatttcctgaaggctgtggagaccttggttcacagcttaagaccacaacagcatcctttttccttcagctcagctaatgtgctactgcagagccagctcctcagacactcctctcctcctggctaccaaatgtccttctccacctggcccctgctgcaggcacggattccatggcattcactggccccactggtccatagtggaactaacgtcagtattactagcctagtactgcaaaagctggactaccggctgccctcaaactacacacaagggctgtggaacaccccatacaccacccctgggctgatccttgtggtctccataacagcagacggccaggccttcacgcaggcagaagttatcatggactatgaagacatgaatggaacccttcactgtgtgttctgggaccacagggtcttccagggtcagggaggttggtcagatgaagggtgtgaggtacatgcagccaatgccagcatcactcagtgcatttgccagcatctcacagccttttccatcctcatgtcccaacacactgtcccagaaaatcccaccctggacctgctgagccaggtgggtacgggggcttccgtcctggctttgctcgtctgcctggctatttacgggctggtgtggagagtggtggtccggaacaaagtcgccttcttccgccataccaccctgtttaacatggtgatctgcttgctggtcgcagacacatgcttcttgggaagccccttccttccttcaggctaccacagcctgatctgcctagtcactgctttcctgtgtcactttttctacctggccacctttttctggatgctggcacaggccctggtgctggcccaccagctgctttttgtcttccaccagctgtccaagcacgtagtcctctcactgatggtgatgctgggctacctgtgcccactggggtttgcgggtgtcaccctgggcctctacttgcctcaaaggaaatacctgtgggaggggaaatgctttctgaacggaggtggcgtcatgctgtacagcttcagtgagccagtgctggccatcgtcggtgtcaacgggctggtccttgtcatcgctgtgctgaagctgctgcgaccttcactgtcagaggggcccacagtggagaagcgccaagctcttgtgggggtgcttaaagccctgcttattctcacacccatctttggcctcacttggggactgggcgtggccactctgtttgatggctccatagtctctcactacgccttttccattctcaacagcctccagggtaaaacggtaagaaatagggaggggagaaaaagtaaccccccggtcgtcgagggtgtcttcatattagtgtttggctgcctcacagacaagaaggtactagaggccttgcgcaaacgattgcgaggcagccggtcctctaactctgccatctccatggatcactatcctcaaagcctgtttcttccgtacaatatgtga

SEQ ID NO: 842 - DNA, 1569 bp, Mus musculus
atggatccacacggcgcccttttcttctacctgtgccttctggctgctcaagttgtcctagtagaaaccctgtcagacctacttgtcttgatgaagcgccttgagcagcccgtaggccggggcttgtcttccagagcgaggcatatccacagcctggagcagaagctgctcaatgccagcttcggcgggcacaacttgaccttgcagacaaactccatccagtctcttgtcttcaagctgagctgcgactttcctggtctttccctgtccagcaccacactgacaaatgtctcccaggtgcgagccccacatgccatgcaattccctgctgagctgaccaagggtgcctgtgtgacctcccggcctgctgagcttcgactcatctgcatctatttcttcactgcacacctctttcaggatgaccggaactcatcactgctcaataactatgtcctgggggcccagctggatcacaggcctgtgaacaaccttcagaagccagtcaacatcagcttctggcataatcggagtctggaagggtatacagtatcctgtgttttctggaaggagggagccagcaagagcagctggggggcctggagccctgagggctgttatacagagcagccctcagccacccaggttctctgccattgcaaccatctcacctacttcgctgtgcttatgcagctctctggagaccccgtgcccgctgagctgcaggtgcctcttgagtacatctcctttgtgggttgcagcatctccatcgtggcctcgctgctcaccatactgctgtacgctcagtccaggaagcaaagcgattccaccacacgtatccacatgaacctgaatggctctgttctgctcctgaacgtcaccttccttctgagctcccagatgaccctgcccaccatgcccaggcccgtctgcaaggtgctggctgctgtcctacactacgcactgctcagcagccttacctggatggccatcgaaggcttcaacctctaccttttcctggggcgtgtctacaacgcctacattcgccgatacttgctcaagctctgcatgctgggctgggggtttccagccctcttggtgctgctgcttctgatgatcaagagctcagtgtatggaccctgtgtgacctcactctccaaaagccaggaaaatggcacaggcttccagaatgtgtccatgtgctggatccgaagtcccatggtacacagcatcctggtcatgggctatggtggcttcacatctctgaacctggtggtgctggcctgggctctgtggatcttgtgcaggcttcgggcacgggagaaggcactgagtccctgggcctaccgggacactgccatggtgttgggtctcactgtgctgcttggcaccacctggaccctagccttcttctccttcggtgtgttcctgctgcctcagctcttcctctttaccatcttcaactcgctctatggtttcttcctcttcctgtggttctgctcacaaaagcgttactcggatgccgaagccaaggcggagatggaggcagtcagctcctcccagatgacacac

SEQ ID NO: 843 - DNA, 2394 bp, Mus musculus
atggagccagaaatcaactgctctgaattttgtgacagttttcctggtcaagagctggatcggagaccccttcatgatctttgcaagacaaccattactgagtcccagcacagtagtacagccgcctccccactgtctcctgccctcttggggattatgtggacctttctcagctgtgggctacttctggtgctcttctttctggctttcacaattcgctgcaggaagaacaggattgtgaagatgtccagccccaatctgaatgttgtgaccttgctgggcagttgtctgacctacatcagcgcttacctttttgggattcaagatgctcttgaggggagttcagtagaagctctcattcagacacgactgtccttgctgtgcattgggacgtccttggtgtttggccctatcctggggaagagctggcgactctacaaagtgtttacccagagagtaccggacaagagagtgatcatcaaagacctgcagttgctgggattggtggcagcactggtggtggctgatgtaatcctgcttgtgacatgggtgctgactgaccccatccagtgcctccagatgcttggtgtcagcatgaaggtgacagggagagatgtctcctgctctttgaccaacacacacttctgtgcttcacggtactccgatgtctggatagccctggttttgggatgcaaggggctgctgctgctgtatggtgcttacctggctggcctgaccaaccatgtcagctctcctccagtgaaccagtccttaaccatcatggtcggggtcaacctcctgctcctcaccgctgggctgctttttgtggtcaccagatacctgcactcctggcccaatctggtctttggactcacatccggaggtatcttcgtttgcacaaccactgtgaactgctgtgtcttcattccccagctgaagcaatggaaggcatttgaaggagaaaaccaaacaatgagacacatggccaaatacttcagcactcccagcaaaagcttccacggccagttcgatgaggacccgagctgccacttgagagatgagaagagctgcatggagaggctcctaacagaaaaaaacgcagtaattgaaagcctgcaagagcaagtcagcaacgccaaggaaaagctggtaaagctgatgtctgccgagtgcacctatgactccccagagtgggctgtcccagatgcagcctctgcccgtgggctggcacttccgggaccttcggaatgccctgctgtttcggagaatgagagcggagcagctgctagggactccctacacgttccagcggcctgccagcacgtgcaaggccctggggcatcgagaagggacaccagtccctccccagcccaacaggacaacatgcctttaaaacagtattgtgatcatttggacacgggttgcaaccagaagccaaaggctgaacaaagcgagggtcccgaaagaggagaccaggaacccatggcccccagccagcgtttaatggcagatggagtggcctgtgaaccccataagcccaggcagagcccagagggactcccaaagaagctacctggggtcagttcagtagtcagagagaagcttcaagaagttctacaagagctggacctgggctctgaggctcccctttccccactaccctgtccccagcagctctggaagagtaccacttcccgtagcccccagaagctgtccccatctaaactgggtttcagcccgtacgtggtgaggaggagacgggcggcccagagggctcgctcccacatccctggctctgtgggtctcaatgtggggcatcaagcaaatagtaccgtttctagttcacaaagtgggcttattgtacagaacagagacagtcccaggctggaccacaacaatgcaaggtccaaggtaccaagatcttcttctgtaaaaccatcaccactctcggaacctcgccggaaacagggtaccctggagggcagcaaacaatgcgagaccgagcctcaagaggccggcggagcatgcaatgtagcttttccttgccaatcttctgcttctgtccaggcacaaagtcccgcagccccatgcctaccctcttcaccagctctgcccaggcagcgtcagcctcgaccccgactgtcccctggctgtccttccttgtcttctgggtgctacaaccttgacagtgagtccagcagctcagacgagttcttctgccgctgccacaggccctactgtgaaatctgcttccagagctctttggactccaatgacagcgacacttcagacagtgaccttgagcaggcttcaggattggcctcctggggaaagctgtgggcccgctccaagcctgttgtgaacttcaaagatgacttgaagcccacgctagtg

SEQ ID NO: 844 - DNA, 1083 bp, Mus musculus
atgtcccctgagtgtgcacagacgacgggccctggcccctcgcacaccctggaccaagtcaatcgcacccacttccctttcttctcggatgtcaagggcgaccaccggttggtgttgagcgtcgtggagaccaccgttctggggctcatctttgtcgtctcactgctgggcaacgtgtgtgctctagtgctggtggcgcgccgtcggcgccgtggggcgacagccagcctggtgctcaacctcttctgcgcggatttgctcttcaccagcgccatccctctagtgctcgtcgtgcgctggactgaggcctggctgttggggcccgtcgtctgccacctgctcttctacgtgatgacaatgagcggcagcgtcacgatcctcacactggccgcggtcagcctggagcgcatggtgtgcatcgtgcgcctccggcgcggcttgagcggcccggggcggcggactcaggcggcactgctggctttcatatggggttactcggcgctcgccgcgctgcccctctgcatcttgttccgcgtggtcccgcagcgccttcccggcggggaccaggaaattccgatttgcacattggattggcccaaccgcataggagaaatctcatgggatgtgttttttgtgactttgaacttcctggtgccgggactggtcattgtgatcagttactccaaaattctgcagatcacgaaagcatcgcggaagaggcttacgctgagcttggcatactctgagagccaccagatccgagtgtcccaacaagactaccgactcttccgcacgctcttcctgctcatggtttccttcttcatcatgtggagtcccatcatcatcaccatcctcctcatcttgatccaaaacttccggcaggacctggtcatctggccatcccttttcttctgggtggtggccttcacgtttgccaactctgccctaaaccccatactgtacaacatgtcgctgttcaggaacgaatggaggaagattttttgctgcttcttttttccagagaagggagccatttttacagatacgtctgtcaggcgaaatgacttgtctgttatttccagc

SEQ ID NO: 845 - DNA, 1269 bp, Mus musculus
atgggaaaggcaatgctgagagctgggtttgccgacaccaattccagcaacatgaacgagtcgtttgctcgcctccactttgcaggaggctacctgccgtctgactccaaggactggaggaccatcattccgtctctcttgatggccgtgtgcctggtgggtctcgtgggaaacctgtgtgtgattggcattctccttcatggcgtttggaaaagaaagccatccacgatccactccctgattctgaatctaagcctggctgacttctctctcctgctcttctctgcacctgtccgagcggcagcatactccaagggcgtttgggatctcggctggttcatctgcaagtcctctgactggttcacccacgtgtgcatggcagccaagagcttgacatttgttgtggtagccaaagcatgcttcgcgtatgcaagtgacccagccaagcaagagagtatccacagccgcaccatctggtcagtgctggcgggcatctgggttgtagccagcctgcttcccctgccagaatggctctttagcaccaccagacgtcacgcaggtgtggaaatgtgcctcgtggatgtgccagctgtggcagaagaattcatgtccatgttcggtaagctctaccctctgctggtgttctgccttcctttacttctggctggcgtttatttctggcgagcttatgaccaatgtaagacacgatgtacgaaaactcgaaatctgagagaccagatgcgttcaaagcaactcacagtgatgctgctaagcactgcaatcatctctgctcttctgtggctcccagagtggatagcctggctgtgggtatggcatgtgaaggctggagggccgatgccaccacaggggttcatagccctgtctcaagttctcatgtttttcacctccacagcaaaccctctcatttttctagttatgtctgaagagttcaaggcaggcttgaaaggcctatggaaatggatgataaccagaaagccagcagttacttcagaggttcaggaggcacctgctggaaacacagaggcccttcccggaaaggctccatcaccagagacccaaacatgcatcctagacacagacggacgtgggtctcctgatgacagcaaagagaaatctggtaaggtggtggctcccatcctccctgacgtggagcagttttggcacgagagggatgctgtcccttcagcacaagacaatgaccctataccctgggaacacgaaggccaagagacagagggctgcaattaa

SEQ ID NO: 846 - DNA, 1548 bp, Homo sapiens
atgggacataacgggagctggatctctccaaatgccagcgagccgcacaacgcgtccggcgccgaggctgcgggtgtgaaccgcagcgcgctcggggagttcggcgaggcgcagctgtaccgccagttcaccaccaccgtgcaggtcgtcatcttcataggctcgctgctcggaaacttcatggtgttatggtcaacttgccgcacaaccgtgttcaaatctgtcaccaacaggttcattaaaaacctggcctgctcggggatttgtgccagcctggtctgtgtgcccttcgacatcatcctcagcaccagtcctcactgttgctggtggatctacaccatgctcttctgcaaggtcgtcaaatttttgcacaaagtattctgctctgtgaccatcctcagcttccctgctattgctttggacaggtactactcagtcctctatccactggagaggaaaatatctgatgccaagtcccgtgaactggtgatgtacatctgggcccatgcagtggtggccagtgtccctgtgtttgcagtaaccaatgtggctgacatctatgccacgtccacctgcacggaagtctggagcaactccttgggccacctggtgtacgttctggtgtataacatcaccacggtcattgtgcctgtggtggtggtgttcctcttcttgatactgatccgacgggccctgagtgccagccagaagaagaaggtcatcatagcagcgctccggaccccacagaacaccatctctattccctatgcctcccagcgggaggccgagctgcacgccaccctgctctccatggtgatggtcttcatcttgtgtagcgtgccctatgccaccctggtcgtctaccagactgtgctcaatgtccctgacacttccgtcttcttgctgctcactgctgtttggctgcccaaagtctccctgctggcaaaccctgttctctttcttactgtgaacaaatctgtccgcaagtgcttgatagggaccctggtgcaactacaccaccggtacagtcgccgtaatgtggtcagtacagggagtggcatggctgaggccagcctggaacccagcatacgctcgggtagccagctcctggagatgttccacattgggcagcagcagatctttaagcccacagaggatgaggaagagagtgaggccaagtacattggctcagctgacttccaggccaaggagatatttagcacctgcctggagggagagcaggggccacagtttgcgccctctgccccacccctgagcacagtggactctgtatcccaggtggcaccggcagcccctgtggaacctgaaacattccctgataagtattccctgcagtttggctttgggccttttgagttgcctcctcagtggctctcagagacccgaaacagcaagaagcggctgcttccccccttgggcaacaccccagaagagctgatccagacaaaggtgcccaaggtaggcagggtggagcggaagatgagcagaaacaataaagtgagcatttttccaaaggtggattcctag

SEQ ID NO: 847 - DNA, 4755 bp, Homo sapiens
atgaggggccaggccgccgccccgggccccgtctggatcctcgccccgctgctactgctgctgctgctgctgggacgccgcgcgcgggcggccgccggagcagacgcggggcccgggcccgagccgtgcgccacgctggtgcagggaaagttcttcggctacttctccgcggccgccgtgttcccggccaacgcctcgcgctgctcctggacgctacgcaacccggacccgcggcgctacactctctacatgaaggtggccaaggcgcccgtgccctgcagcggccccggccgcgtgcgcacctaccagttcgactccttcctcgagtccacgcgcacctacctgggcgtggagagcttcgacgaggtgctgcggctctgcgacccctccgcacccctggccttcctgcaggccagcaagcagttcctgcagatgcggcgccagcagccgccccagcacgacgggctccggccccgggccgggccgccgggccccaccgacgacttctccgtggagtacctggtggtggggaaccgcaaccccagccgtgccgcctgccagatgctgtgccgctggctggacgcgtgtctggccggtagtcgcagctcgcacccctgcgggatcatgcagaccccctgcgcctgcctgggcggcgaggcgggcggccctgccgcgggacccctggccccccgcggggatgtctgcttgagagatgcggtggctggtggccctgaaaactgcctcaccagcctgacccaggaccggggcgggcacggcgccacaggcggctggaagctgtggtccctgtggggcgaatgcacgcgggactgcgggggaggcctccagacgcggacgcgcacctgcctgcccgcgccgggcgtggagggcggcggctgcgagggggtgctggaggagggtcgccagtgcaaccgcgaggcctgcggccccgctgggcgcaccagctcccggagccagtccctgcggtccacagatgcccggcggcgcgaggagctgggggacgagctgcagcagtttgggttcccagccccccagaccggtgacccagcagccgaggagtggtccccgtggagcgtgtgctccagcacctgcggcgagggctggcagacccgcacgcgcttctgcgtgtcctcctcctacagcacgcagtgcagcggacccctgcgcgagcagcggctgtgcaacaactctgccgtgtgcccagtgcatggtgcctgggatgagtggtcgccctggagcctctgctccagcacctgtggccgtggctttcgggatcgcacgcgcacctgcaggcccccccagtttgggggcaacccctgtgagggccctgagaagcaaaccaagttctgcaacattgccctgtgccctggccgggcagtggatggaaactggaatgagtggtcgagctggagcgcctgctccgccagctgctcccagggccgacagcagcgcacgcgtgaatgcaacgggccttcctacgggggtgcggagtgccagggccactgggtggagacccgagactgcttcctgcagcagtgcccagtggatggcaagtggcaggcctgggcgtcatggggcagttgcagcgtcacgtgtggggctggcagccagcgacgggagcgtgtctgctctgggcccttcttcgggggagcagcctgccagggcccccaggatgagtaccggcagtgcggcacccagcggtgtcccgagccccatgagatctgtgatgaggacaactttggtgctgtgatctggaaggagaccccagcgggagaggtggctgctgtccggtgtccccgcaacgccacaggactcatcctgcgacggtgtgagctggacgaggaaggcatcgcctactgggagccccccacctacatccgctgtgtttccattgactacagaaacatccagatgatgacccgggagcacctggccaaggctcagcgagggctgcctggggagggggtctcggaggtcatccagacactggtggagatctctcaggacgggaccagctacagtggggacctgctgtccaccatcgatgtcctgaggaacatgacagagattttccggagagcgtactacagccccacccctggggacgtacagaactttgtccagatccttagcaacctgttggcagaggagaatcgggacaagtgggaggaggcccagctggcgggccccaacgccaaggagctgttccggctggtggaggactttgtggacgtcatcggcttccgcatgaaggacctgagggatgcataccaggtgacagacaacctggttctcagcatccataagctcccagccagcggagccactgacatcagcttccccatgaagggctggcgggccacgggtgactgggccaaggtgccagaggacagggtcactgtgtccaagagtgtcttctccacggggctgacagaggccgatgaagcatccgtgtttgtggtgggcaccgtgctctacaggaacctgggcagcttcctggccctgcagaggaacacgaccgtcctgaattctaaggtgatctccgtgactgtgaaacccccgcctcgctccctgcgcacacccttggagatcgagtttgcccacatgtataatggcaccaccaaccagacctgtatcctgtgggatgagacggatgtaccctcctcctccgcccccccgcagctcgggccctggtcgtggcgcggctgccgcacggtgcccctcgacgccctccggacgcgctgcctctgtgaccggctctccaccttcgccatcttagcccagctcagcgccgacgcgaacatggagaaggcgactctgccgtcggtgacgctcatcgtgggctgtggcgtgtcctctctcaccctgctcatgctggtcatcatctacgtgtccgtgtggaggtacattcgctcagagcgttctgtcatcctcatcaacttctgcctgtccatcatctcctccaatgccctcatcctcatcgggcagacccagacccgcaacaaggtgatgtgcacgctggtggccgccttcctgcacttcttcttcctgtcctccttctgctgggtgctcaccgaggcctggcagtcctacatggccgtgacgggccacctccggaaccgcctcatccgcaagcgcttcctctgcctgggctgggggctccctgcactggttgtggccatttctgtgggattcaccaaggccaaagggtacagcaccatgaactactgctggctctccctggaggggggactgctctatgccttcgtgggacctgccgctgccgttgtgctggtgaacatggtcattgggatcctggtgttcaacaagctcgtgtccaaagacggcatcacggacaagaagctgaaggagcgggcaggggcctccctgtggagctcctgcgtggtgctgccgctgctggcgctgacctggatgtcggctgtgctcgccgtcaccgaccgccgctccgccctcttccagatcctcttcgctgtcttcgactcgctggagggcttcgtcatcgtcatggtgcactgtatcctccgtagagaggtccaggacgctgtgaaatgccgtgtggttgaccggcaggaggagggcaacggggactcagggggctccttccagaacggccacgcccagctcatgaccgacttcgagaaggacgtggatctggcctgtagatcagtgctgaacaaggacatcgcggcctgccgcactgccaccatcacgggcacactgaagcggccgtctctgcccgaggaggagaagctgaagctggcccatgccaaggggccgcccaccaatttcaacagcctgccggccaacgtgtccaagctgcacctgcacggctcaccccgctatcccggcgggcccctgcccgacttccccaaccactcactgaccctcaagagggacaaggcgcccaagtcctccttcgtcggtgacggggacatcttcaagaagctggactcggagctgagccgggcccaggagaaggctctggacacgagctacgtgatcctgcccacggccacggccacgctgcggcccaagcccaaggaggagcccaagtacagcatccacattgaccagatgccgcagacccgcctcatccacctcagcacggcccccgaggccagcctccccgcccgcagcccgccctcccgccagccccccagcggcgggccccccgaggcaccccctgcccagcccccaccgcctccgcccccaccgccaccacctccccagcagcccctgcccccaccgcccaatctggagccggcaccccccagcctgggggatcccggggagcctgccgcccatccgggacccagcacggggcccagcaccaagaacgagaatgtcgccaccttgtctgtgagctccctggagcggcggaagtcgcggtatgcagaactggactttgagaagatcatgcacacccggaagcggcaccaagacatgttccaggacctgaaccggaagctgcagcacgcagcggagaaggacaaggaggtgctggggccggacagcaagccggaaaagcagcagacgcccaacaagaggccctgggagagcctccggaaagcccacgggacgcccacgtgggtgaagaaggagctggagccgctgcagccgtcgccgctggagcttcgcagcgtggagtgggagaggtcgggcgccacgatcccgctggtgggccaggacatcatcgacctccagaccgaggtctga

SEQ ID NO: 848 - DNA, 4719 bp, Homo sapiens
atgaccccagcctgtcccctcttactgtctgtgattctgtccctgcgcctggccaccgccttcgaccccgcccccagtgcctgctctgccctggcctcgggtgtgctctacggggccttctcgctgcaggacctctttcctaccatcgcctcgggctgctcctggaccctggagaaccctgaccccaccaagtactccctctacctgcgcttcaaccgccaggagcaggtgtgcgcacactttgccccccgcctgctgcccctggaccactacctggtcaactttacctgcctgcggcctagccccgaggaggcggtggcccaggcggagtcagaggtggggcggccagaagaggaggaggcagaggcggcagcggggttggagctgtgcagcggctcaggcccctttaccttcctgcacttcgacaagaacttcgtgcagctgtgcctgtcggctgagccctccgaggccccgcgcctgctggcgcccgctgccctagccttccgctttgtcgaggtcttgctcatcaacaacaacaactctagccaattcacctgtggtgtgctctgccgctggagtgaggagtgtggccgcgctgccggcagggcctgcggctttgctcagccaggctgcagctgccctggagaggcgggggccggctccaccaccaccacatctccaggccctcctgctgcccacaccctgtccaatgccctggtgcccgggggcccagccccacctgctgaggccgatttgcactcggggagcagcaatgatctgttcacaaccgagatgagatatggtgaggagccggaagaggaaccgaaagtgaaaacccagtggccgaggtctgcagatgagcctgggctatacatggcgcagacaggcgacccggcggctgaggagtggtccccgtggagcgtgtgttccctgacgtgtgggcagggtctgcaggtgcggacccgctcctgtgtgtcctccccctatgggaccctgtgcagcgggcccctgcgggagaccaggccctgcaacaattcagccacctgcccagtgcacggcgtgtgggaggagtgggggtcctggagcctgtgctcccgcagctgcgggcgggggtcccggagccggatgcggacctgcgtgcccccccagcacggcggcaaggcctgcgagggtcctgagctgcagactaagctctgcagtatggctgcctgcccggtggaaggccagtggttagaatggggtccctggggcccatgctccacgtcctgtgccaatgggacccaacagcgcagccggaagtgcagcgtggcgggcccagcctgggccacatgcacgggtgccctcactgacacccgggagtgcagcaacctcgagtgcccggccactgatagcaagtgggggccatggaatgcgtggagcctgtgctctaagacgtgtgacacaggctggcagcgccgcttccgcatgtgccaggccacgggcacgcagggctacccctgcgagggcaccggagaggaggtgaagccttgtagtgagaagaggtgtccagccttccatgagatgtgcagggatgagtacgtgatgctgatgacgtggaagaaggcagctgctggcgagatcatctacaacaagtgccccccgaatgcctcagggtctgccagccgccgctgtctcctcagtgcccaaggcgtggcgtactgggggctgcccagctttgctcgctgcatctcccatgagtaccgctacctgtatctgtcacttagggagcacctggccaaggggcagcgcatgctggcaggcgagggcatgtcgcaggtggtgcgcagcctgcaggagctactggcccggcgcacctactatagtggggacctgctcttctctgtggacattctgaggaatgtcactgacacctttaagagggccacctacgtgccctcggctgatgatgtgcagcgcttcttccaggtggtgagcttcatggtggatgcggaaaacaaggagaagtgggacgatgctcagcaggtgtcccctggctctgtgcacctgctccgtgtcgtggaggacttcattcacctggtgggcgatgctctcaaggccttccagagctctctgattgtcacagataatctagtgatcagcattcagcgagagcccgtctcagctgtgtccagtgacatcacgttccccatgcggggccgccggggcatgaaggactgggtgcggcactcagaggaccgcctcttcctgcccaaggaggtgctcagcctctcctccccagggaagccagccacatctggggcagcaggcagccctggcagggggaggggcccaggaacggtgcctcctggcccaggccactcccaccagcgcctcctcccagcagaccctgatgagtcctcctactttgtgatcggtgctgtactctaccgcacccttggcctcatcctgccgcctcccaggcccccgctggccgtcacatcccgggtgatgacagtgactgtgcgcccccctacccagcctccagctgagcccctcatcactgtggagctctcctacatcatcaatgggaccacggatccccattgcgccagctgggactactccagagcagatgccagctcaggagactgggacactgaaaattgccagaccctggagacccaggcagctcacacccgctgccagtgccagcacctgtccacctttgctgtactagcccagccgcccaaggacctgaccctggagctggcgggctccccctcggtccccctggtgatcggctgtgcagtgtcgtgcatggcgctgctcaccctgctcgccatctatgccgccttttggaggttcataaaatctgaacgctccatcatcttgctgaacttctgcctgtccatcttggcatccaacatcctgatcctcgtgggccagtcccgggtgctgagcaagggcgtgtgcaccatgacggctgccttcctgcacttcttctttctctcctccttttgctgggtgcttaccgaggcctggcagtcctacctggctgtcattgggcggatgcgcacccgcctcgttcgcaagcgcttcctctgcctgggctggggtctgcctgccctggtggtggccgtgtctgttggctttacccgaacgaaaggatacggtacatccagctactgctggctctccctggagggcggcctgctctacgcctttgtgggccctgcagccgtcattgtcctggtgaacatgctcatcggaatcatcgtcttcaacaagctcatggcacgtgatggcatctccgacaaatccaagaagcagagggccgggtcggagcggtgcccctgggccagcctgctcctcccctgctcagcgtgtggagcggtccccagccccctgctcagctcagcctcggccaggaacgccatggcctcactctggagctcctgcgtggtgctgcccctgctggcgctcacctggatgtctgccgtcctggctatgacagaccgccgttccgtcctcttccaggccctctttgctgtcttcaactccgcgcagggctttgtcatcactgctgtgcactgcttcctgcgccgagaggtccaggatgtggtgaagtgccagatgggggtgtgccgggctgatgagagcgaagactcccctgactcgtgtaagaacgggcagctgcagatcctgtcagactttgaaaaggatgtggatctggcttgtcaaacagtgctgttcaaggaggtcaacacttgcaacccgtccaccatcacgggcacactatcccgcctgtccctggatgaggatgaggagcccaagtcctgcctcgtgggccctgagggcagcctcagcttctcaccactgcctgggaatatcctggtgcccatggcagcctcaccagggctgggggagcctccgcccccacaggaggccaaccctgtttacatgtgtggggagggtggcctgcggcagctggacctcacatggctgcggcccactgagccaggctctgagggagactacatggtgctgccccggcggactttgagcctgcagcctggcggtgggggtggaggtggtgaggatgcccccagggcccggcccgaggggaccccccggcgagctgccaagacagtggcccacactgaaggctaccccagcttcctgtccgtggaccactcgggcctggggctgggccctgcctatggatctctccagaatccctatggaatgaccttccaaccgccaccgccgacacccagcgcccgccaagtgcccgagccaggggagcgcagccggaccatgcctcgcaccgtgcccggctctaccatgaagatgggctccctggagcgaaagaaattacggtattcagacctggactttgaggtgatgcacacccggaaacggcattcagaactctaccacgagctcaaccagaagttccacactttcgaccgctaccgcagccagtccacggccaagagggagaagcggtggagtgtgtcctcgggtggggcggccgagcggagcgtgtgcaccgataagcccagccctggggagcgccccagcttgtcccaacatcggcgccatcagagctggagcaccttcaaatctatgacactgggctcgctgccccccaagccccgagaacggctgactctgcaccgggcagcagcctgggagcccacagaaccaccggatggtgacttccagacagaggtgtga

SEQ ID NO: 849 - DNA, 4569 bp, Homo sapiens
atgaaggctgttcgtaacctgctgatttatatattttccacctatctcctggttatgtttggatttaatgctgcccaagacttctggtgttcaactttggtgaagggagtcatttatggatcgtattctgtaagtgaaatgtttcctaaaaactttacaaactgcacttggacgctggaaaatccagatccaaccaaatatagcatttacctgaaattttccaaaaaggaccttagctgctctaacttttcactcctggcttatcagtttgatcatttttcccatgaaaaaataaaggatcttttaagaaagaatcattctataatgcaactctgcaattccaagaatgctttcgtttttctacagtatgataaaaattttattcaaatacgtcgagtatttccaactaatttcccaggattacagaaaaaaggggaagaagatcagaaatctttttttgagtttttggtattgaacaaggtcagcccaagccagtttggttgccatgtattatgtacttggttggagagctgcttaaaatcagaaaatgggagaacagaatcatgtgggatcatgtatacaaaatgcacctgccctcagcatttgggagagtgggggatcgacgaccagtcgctgattttgttaaataacgtggtgttacccctgaatgagcagacagagggctgcctgacccaggagctgcaaaccacccaagtctgcaatcttaccagggaggccaagcgaccacccaaagaagaatttggaatgatgggagatcatacaattaaaagtcagcgacctcgatctgttcatgaaaaaagggtccctcaggaacaagctgatgctgctaaatttatggcacaaactggtgaatctggtgtggaagagtggtcccagtggagcacatgttcggttacttgtggtcaagggtcgcaggtgcgaaccagaacttgtgtatcaccttacgggacacactgcagcggcccattaagagaatcaagggtttgcaataacactgccctctgtccagtacacggagtatgggaggaatggtcaccatggagtttatgttcatttacatgtggtcgaggccaaagaacaagaacaaggtcatgcacacctcctcagtatggaggaaggccgtgtgaaggacctgaaacacatcataagccttgtaatattgctctttgcccagttgatggacagtggcaagagtggagttcgtggagccagtgctcagtaacgtgctcgaatgggactcagcagagaagccggcagtgcactgcagctgcccatggaggctccgaatgcagagggccatgggcagaaagcagagagtgctataaccctgaatgtacagccaatggtcaatggaatcagtggggtcattggagtggttgttccaagtcctgtgatggcggctgggaaaggcgaataaggacctgtcagggtgcagtgataacagggcagcaatgtgaaggaacgggcgaagaagtgagaagatgcagtgagcagcgatgccctgcaccttatgaaatatgccctgaggattatctgatgtcgatggtgtggaaaagaactccagcaggcgacttggcattcaatcaatgtcccctgaatgccacaggcaccactagcagacgctgctctctcagtcttcatggagtggccttctgggaacagccgagctttgcaagatgcatatcaaatgagtacagacacttgcagcattcaattaaagagcaccttgctaaggggcagcgaatgctggcaggtgatggaatgtcccaggtgaccaagacactgttggatttaactcagagaaaaaatttctatgcaggcgatcttctgatgtctgtggagatcctgagaaatgtgacagacacatttaaaagggcaagttacatccctgcatctgatggtgtccagaacttctttcaaatagttagcaaccttctagatgaagaaaacaaggaaaaatgggaagatgcacaacagatttatccagggtcaatagagttaatgcaggtgattgaagattttatacacattgttggaatggggatgatggactttcagaattcatacttaatgactggaaatgtagtggctagtattcagaagcttcctgcagcctctgttctaacagacatcaactttccaatgaaaggacggaagggaatggttgactgggcaagaaactcagaagatagggtagtaattccaaaaagcattttcactccggtgtcatcaaaagaattagatgaatcatctgtatttgttcttggcgcagtcctatacaaaaacttagatctaattttgcccactttgagaaattatactgtcattaattccaaaatcatcgtggtcacaataaggcctgaacccaaaacaaccgattcgtttctggagatagaactagctcatttggctaatggtactttgaatccctattgtgtattgtgggatgactccaaaacgaacgagtctttgggaacgtggtccacccagggatgtaaaactgtgcttaccgatgcatcccatacgaaatgcttatgtgatcgtctctctaccttcgccattttggctcagcaacctagagaaataatcatggaatcctctggcacaccttcagttaccctaatagtaggcagtggtctttcttgcttggccttgattaccctagcagttgtctatgcagcattatggaggtacatacgctctgagagatccataatactaattaacttctgcctgtctatcatctcatccaatatcctcatactggttggacagactcagacacataataagagtatctgcacaaccaccactgcatttttgcactttttcttcctggcttcattctgttgggttttgactgaggcgtggcaatcatatatggctgtaactggaaaaattaggacacggcttataagaaaacgctttttgtgccttggatggggtttaccagcattagtagtggccacatcagtaggcttcaccagaacaaaaggatatggcactgatcactactgctggctctctcttgaaggaggactactctatgcttttgtgggacctgcagccgctgttgtcctggtcaacatggtgattggcattttggtatttaataaacttgtttccagagatggaatcctagataaaaagctcaaacacagagccggtcagatgagtgagcctcatagcggtttgacgctcaaatgtgccaagtgtggagtagtttcaacaacagctttgtcagccaccaccgccagtaacgccatggcgtctctttggagctcctgtgtggtgttgccccttctggctttgacgtggatgtctgcggttctggccatgacagataaacgctccatattgtttcaaatactttttgctgtgtttgattcattgcaaggctttgttatagtcatggtccactgcattcttcggagagaggttcaggatgcatttagatgccgattgagaaactgtcaggatcccatcaatgcagattcttcgagttcgtttcctaatgggcatgctcaaatcatgacagactttgaaaaggatgtagacattgcctgtcgatcagttcttcataaggatattggtccttgccgagcagccacaataacaggaacactttctaggatttctctaaatgatgatgaagaagaaaagggaacaaaccctgaagggctaagctattcaacattgcctggaaatgtcatttccaaagtcatcatccagcaacccacaggtttgcacatgcccatgagtatgaatgagcttagcaatccatgtttgaaaaaagaaaatagtgaattgcggagaactgtgtacttatgtacggatgataatttgagaggggctgacatggacatagtccatcctcaagaaagaatgatggaaagtgactatattgtgatgcccagaagttctgtaaataaccagccttcaatgaaagaagaaagcaaaatgaatattggcatggaaaccttgccacatgaaaggctattgcactacaaagtaaaccctgaattcaatatgaatccccctgtaatggaccagttcaatatgaacttagagcaacatctcgcaccccaggaacatatgcagaatttgccctttgaacctcgcacagctgtgaagaatttcatggcctctgagttggatgataatgcaggactatcaagaagtgaaactggatcaacgatatcaatgagttctttagagagaagaaaatcacgatattcagaccttgactttgagaaggtcatgcatacaaggaagaggcatatggaactatttcaagaactaaatcagaaatttcaaactttggacagatttcgggatataccaaatacaagcagtatggaaaaccccgcaccaaacaagaatccatgggacactttcaaaaaccccagtgaatacccgcattacaccacaatcaatgtcttagacacagaggcaaaggatgctttggaactgaggccagcagagtgggagaagtgtctgaatttgcctctggatgtgcaagagggtgactttcaaacagaagtttaa

SEQ ID NO: 850 - DNA, 3088 bp, Homo sapiens
ttgcttgagtcatcttctgaagctttaaaaacaattgatgaattggccttcaagatagacctaaatagcacatcacatgtgaatattacaactcggaacttggctctcagcgtatcatccctgttaccagggacaaatgcaatttcaaattttagcattggtcttccaagcaataatgaatcgtatttccagatggattttgagagtggacaagtggatccactggcatctgtaattttgcctccaaacttacttgagaatttaagtccagaagattctgtattagttagaagagcacagtttactttcttcaacaaaactggacttttccaggatgtaggaccccaaagaaaaactttagtgagttatgtgatggcgtgcagtattggaaacattactatccagaatctgaaggatcctgttcaaataaaaatcaaacatacaagaactcaggaagtgcatcatcccatctgtgccttctgggatctgaacaaaaacaaaagttttggaggatggaacacgtcaggatgtgttgcacacagagattcagatgcaagtgagacagtctgcctgtgtaaccacttcacacactttggagttctgatggaccttccaagaagtgcctcacagttagatgcaagaaacactaaagtcctcactttcatcagctatattgggtgtggaatatctgctattttttcagcagcaactctcctgacatatgttgcttttgagaaattgcgaagggattatccctccaaaatcttgatgaacctgagcacagccctgctgttcctgaatctcctcttcctcctagatggctggatcacctccttcaatgtggatggactttgcattgctgttgcagtcctgttgcatttcttccttctggcaacctttacctggatggggctagaagcaattcacatgtacattgctctagttaaagtatttaacacttacattcgccgatacattctaaaattctgcatcattggctggggtttgcctgccttagtggtgtcagttgttctagcgagcagaaacaacaatgaagtctatggaaaagaaagttatgggaaagaaaaaggtgatgaattctgttggattcaagatccagtcatattttatgtgacctgtgctgggtattttggagtcatgttttttctgaacattgccatgttcattgtggtaatggtgcagatctgtgggaggaatggcaagagaagcaaccggaccctgagagaagaagtgttaaggaacctgcgcagtgtggttagcttgacctttctgttgggcatgacatggggttttgcattctttgcctggggacccttaaatatccccttcatgtacctcttctccatcttcaattcattacaaggcttatttatattcatcttccactgtgctatgaaggagaatgttcagaaacagtggcggcggcatctctgctgtggtagatttcggttagcagataactcagattggagtaagacagctaccaatatcatcaagaaaagttctgataatctaggaaaatctttgtcttcaagctccattggttccaactcaacctatcttacatccaaatctaaatccagctctaccacctatttcaaaaggaatagccacacagataatgtctcctatgagcattccttcaacaaaagtggatcactcagacagtgcttccatggacaagtccttgtcaaaactggcccatgctgatggagatcaaacatcaatcatccctgtccatcaggtcattgataaggtcaagggttattgcaatgctcattcagacaacttctataaaaatattatcatgtcagacaccttcagccacagcacaaagttttaatgtctttaagaaaaagaaatcaatctgcagaaatgtgaagatttgcaagcagtgtaaactgcaactagtgatgtaaatgtgctattacctaggtaactgcatatatataaggaatgtattttgttaagaaggcttttgtgaaattcagaatttttctttttaatatatttcttccatggaagagttgtcatcactaaaacttcagtactgagagtaacatgactcagtagccacagaagctatgatttgtaaaatatataattgaatcagagtaatcataatgcaggggagacattcaaattagagacaagggagaagcaatgctgaggaagaccctagatagagctcattttactccacctaatcgttatatctggatatacccattttctgcatcttctttctcaacaataaactgtccttgctttggagactttaagacatttcctaaagcacaaataaaagcctcgtatttccccattgagagttttgttccaaggaatatgaagtgagacatatgggtgagtcataataatcaaaataatttatgaagagctgggtctgcaatagctagtctaaaaactacttgtgtgtcagtcctctggttatagtatataagagcctgaggaggtctggcaagatagatggtgtattatttatggatcaggctgctgcatacaaaccttgcatactattatgcagcttacctaactctcagactattctgagtaatgcttgcttgctaatgaatgtataggagaccacattgtaattgttcttagatgatggagtccatgcagtttcttagaaatcggtctcagtgcatgctgtgctttttcacatttgctctgggttatctgggaagtatcaggttctgggaggcaacagcattaagtgataagaaaaggagacattctggcaaagccaatctgcttaaaggcaaagtccagaacctggaacctagaggcctttctctctgcacgaaaaacaggtagtttgcagtctgagatatgggagagcttttaggctacacagcaacccaagggacctctcaccttttgctgagcttcaatcaggaagctatttgcctggctccagcagatgatgagataatgaggtagtgggttttttattactgttccattttgcaacatcctgcaacaccatcctgggagacaagagcattacccagcttggctttcacgggggagggttgtattcagt

SEQ ID NO: 851 - DNA, 1341 bp, Homo sapiens
atgaggactctgaacacctctgccatggacgggactgggctggtggtggagagggacttctctgttcgtatcctcactgcctgtttcctgtcgctgctcatcctgtccacgctcctggggaacacgctggtctgtgctgccgttatcaggttccgacacctgcggtccaaggtgaccaacttctttgtcatctccttggctgtgtcagatctcttggtggccgtcctggtcatgccctggaaggcagtggctgagattgctggcttctggccctttgggtccttctgtaacatctgggtggcctttgacatcatgtgctccactgcatccatcctcaacctctgtgtgatcagcgtggacaggtattgggctatctccagccctttccggtatgagagaaagatgacccccaaggcagccttcatcctgatcagtgtggcatggaccttgtctgtactcatctccttcatcccagtgcagctcagctggcacaaggcaaaacccacaagcccctctgatggaaatgccacttccctggctgagaccatagacaactgtgactccagcctcagcaggacatatgccatctcatcctctgtaataagcttttacatccctgtggccatcatgattgtcacctacaccaggatctacaggattgctcagaaacaaatacggcgcattgcggccttggagagggcagcagtccacgccaagaattgccagaccaccacaggtaatggaaagcctgtcgaatgttctcaaccggaaagttcttttaagatgtccttcaaaagagaaactaaagtcctgaagactctgtcggtgatcatgggtgtgtttgtgtgctgttggctacctttcttcatcttgaactgcattttgcccttctgtgggtctggggagacgcagcccttctgcattgattccaacacctttgacgtgtttgtgtggtttgggtgggctaattcatccttgaaccccatcatttatgcctttaatgctgattttcggaaggcattttcaaccctcttaggatgctacagactttgccctgcgacgaataatgccatagagacggtgagtatcaataacaatggggccgcgatgttttccagccatcatgagccacgaggctccatctccaaggagtgcaatctggtttacctgatcccacatgctgtgggctcctctgaggacctgaaaaaggaggaggcagctggcatcgccagacccttggagaagctgtccccagccctatcggtcatattggactatgacactgacgtctctctggagaagatccaacccatcacacaaaacggtcagcacccaacctga

SEQ ID NO: 852 - DNA, 1434 bp, Homo sapiens
atgctgccgccaggcagcaacggcaccgcgtacccggggcagttcgctctataccagcagctggcgcaggggaacgccgtggggggctcggcgggggcaccgccactggggccctcacaggtggtcaccgcctgcctgctgaccctactcatcatctggaccctgctgggcaacgtgctggtgtgcgcagccatcgtgcggagccgccacctgcgcgccaacatgaccaacgtcttcatcgtgtctctggccgtgtctgaccttttcgtggcgctgctggtcatgccctggaaggcagtcgccgaggtggccggttactggccctttggagcgttctgcgacgtctgggtggccttcgacatcatgtgctccactgcctccatcctgaacctgtgcgtcatcagcgtggaccgctactgggccatctccaggcccttccgctacaagcgcaagatgactcagcgcatggccttggtcatggtcggcctggcatggaccttgtccatcctcatctccttcattccggtccagctcaactggcacagggaccaggcggcctcttggggcgggctggacctgccaaacaacctggccaactggacgccctgggaggaggacttttgggagcccgacgtgaatgcagagaactgtgactccagcctgaatcgaacctacgccatctcttcctcgctcatcagcttctacatccccgttgccatcatgatcgtgacctacacgcgcatctaccgcatcgcccaggtgcagatccgcaggatttcctccctggagagggccgcagagcacgcgcagagctgccggagcagcgcagcctgcgcgcccgacaccagcctgcgcgcttccatcaagaaggagaccaaggttctcaagaccctgtcggtgatcatgggggtcttcgtgtgttgctggctgcccttcttcatccttaactgcatggtccctttctgcagtggacaccctgaaggccctccggccggcttcccctgcgtcagtgagaccaccttcgacgtcttcgtctggttcggctgggctaactcctcactcaaccccgtcatctatgccttcaacgccgactttcagaaggtgtttgcccagctgctggggtgcagccacttctgctcccgcacgccggtggagacggtgaacatcagcaatgagctcatctcctacaaccaagacatcgtcttccacaaggaaatcgcagctgcctacatccacatgatgcccaacgccgttacccccggcaaccgggaggtggacaacgacgaggaggagggtcctttcgatcgcatgttccagatctatcagacgtccccagatggtgaccctgttgctgagtctgtctgggagctggactgcgagggggagatttctttagacaaaataacacctttcaccccgaatggattccattaa

SEQ ID NO: 853 - DNA, 1086 bp, Homo sapiens
atggatatacaaatggcaaacaattttactccgccctctgcaactcctcagggaaatgactgtgacctctatgcacatcacagcacggccaggatagtaatgcctctgcattacagcctcgtcttcatcattgggctcgtgggaaacttactagccttggtcgtcattgttcaaaacaggaaaaaaatcaactctaccaccctctattcaacaaatttggtgatttctgatatactttttaccacggctttgcctacacgaatagcctactatgcaatgggctttgactggagaatcggagatgccttgtgtaggataactgcgctagtgttttacatcaacacatatgcaggtgtgaactttatgacctgcctgagtattgaccgcttcattgctgtggtgcaccctctacgctacaacaagataaaaaggattgaacatgcaaaaggcgtgtgcatatttgtctggattctagtatttgctcagacactcccactcctcatcaaccctatgtcaaagcaggaggctgaaaggattacatgcatggagtatccaaactttgaagaaactaaatctcttccctggattctgcttggggcatgtttcataggatatgtacttccacttataatcattctcatctgctattctcagatctgctgcaaactcttcagaactgccaaacaaaacccactcactgagaaatctggtgtaaacaaaaaggctctcaacacaattattcttattattgttgtgtttgttctctgtttcacaccttaccatgttgcaattattcaacatatgattaagaagcttcgtttctctaatttcctggaatgtagccaaagacattcgttccagatttctctgcactttacagtatgcctgatgaacttcaattgctgcatggacccttttatctacttctttgcatgtaaagggtataagagaaaggttatgaggatgctgaaacggcaagtcagtgtatcgatttctagtgctgtgaagtcagcccctgaagaaaattcacgtgaaatgacagaaacgcagatgatgatacattccaagtcttcaaatggaaagtga

SEQ ID NO: 854 - DNA, 3070 bp, Homo sapiens
acttttttcatgttctccttgagtgaaggatgaggaaattgaaagcagagtatgcaccttttattaggagattcaaactgcatcctactggattagcctcaaaagtcctaaaatacaaagacatccatctgacagatcactgaggggaggacttgtttttctgttttagaatagtttccgattaaactttttagctcaagaagaaaagaagctagttatttctcacccaggagtggatttgtggtttggcttcaccatggcttcctgccgtgcctggaaccttagggtgctggtggctgtcgtgtgtggactactgactggcatcattttgggactgggcatctggaggattgtgatcaggatccaaagaggaaaatctacttcctcatcaagcacccctacagagttctgcaggaatggtggaacctgggaaaatggcagatgtatttgtacagaagagtggaaaggactgagatgtacaattgctaatttttgtgaaaatagtacctatatgggttttacttttgccagaatcccagtgggcagatatggaccatccttgcaaacatgtggcaaggatactccaaatgcgggcaatccaatggcagtccggttgtgcagtctctctctatatggagagatagaattacaaaaagtgacaataggaaattgcaatgaaaatctggaaaccctggaaaagcaggtagaggatgtcacagcaccacttaataacatttcttctgaagtccagattttaacatctgatgccaataaattaactgctgagaacatcactagtgctacgcgagtggttggacagatattcaacacttccagaaatgcttcacctgaggcaaagaaagttgccatagtaacagtgagtcaactcctagatgccagtgaagatgcttttcaaagagttgctgctactgctaatgatgatgcccttacaacgcttattgagcaaatggagacttattccttgtctttgggtaatcaatcagtggtggaacctaacatagcaatacagtcagcaaatttctcttcagaaaatgcggtggggccttcaaatgttcgcttctctgtgcagaaaggagctagcagttctctagtttctagttcaacatttatacatacaaatgtggatggccttaacccagatgcacagactgagcttcaggtcttgcttaatatgacgaaaaattacaccaagacatgcggctttgtagtttatcaaaatgacaagcttttccaatcaaaaacttttacagctaaatcggattttagtcaaaaaattatctcaagcaaaactgatgaaaatgagcaagatcagagtgcttctgttgacatggtctttagtccaaagtacaaccaaaaagaatttcaactctattcctatgcctgtgtctattggaatttgtcagcgaaggactgggacacatatggctgtcaaaaagacaagggcactgatggattcctgcgctgccgctgcaaccatactactaattttgctgtattaatgactttcaaaaaggattatcaatatcccaaatcacttgacatattatccaacgttggatgtgcactgtctgttactggtctggctctcacagttatatttcagattgtcaccaggaaagtcagaaaaacctcagtaacctgggttttggtcaatctgtgcatatcaatgttgattttcaacctcctctttgtgtttggaattgaaaactccaataagaacttgcagacaagtgatggtgacatcaataatattgactttgacaataatgacatacccaggacagacaccattaacatcccgaatcccatgtgcactgcgattgccgccttactgcactattttctgttagtgacatttacctggaacgcactcagcgctgcacagctctattaccttctaataaggaccatgaagcctcttcctcggcatttcattcttttcatctcattaattggatggggagtcccagctatagtagtggctataacagtgggagttatttattctcagaatggaaataatccacagtgggaattagactaccggcaagagaaaatctgctggctggcaattccagaacccaatggtgttataaaaagtccgctgttgtggtcattcatcgtacctgtaaccattatcctcatcagcaatgttgttatgtttattacaatctcgatcaaagtgctgtggaagaataaccagaacctgacaagcacaaaaaaagtttcatccatgaagaagattgttagcacattatctgttgcagttgtttttggaattacctggattctagcatacctgatgctagttaatgatgatagcatcaggatcgtcttcagctacatattctgccttttcaacactacacagggattgcaaatttttatcctgtacactgttagaacaaaagtcttccagagtgaagcttccaaagtgttgatgttgctatcgtctattgggagaaggaagtcattgccttcagtgacgcggccgaggctgcgtgtaaagatgtataatttcctcaggtcattgccaaccttacatgaacgctttaggctactggaaacctctccgagtactgaggaaatcacactctctgaaagtgacaatgcaaaggaaagcatctagacagtaaaacttacctgttgtggtctttttaatcacctcgtttgagttttatctgtttctctcctttatttcccagtcctctcagaaagtcttcctcaatgtattttgctcaggattaagaattagataaaacctgttgtttattattattcggcataatggacttggtagtttttctatttttcaatagatttgtacttgaataaggtgaagaatttcacacaacatacaagagtaccattgttccttatatcgttaaatctttgtgacacactttgacaaaaatgtagaacctataacaaattcttttacaagttactataaaggacacaaagagaaaactttaccttccagaacaaaatgactcctgatgaacagtgtgtggggatttgcttgtatgtattaaacttttgacctctg

SEQ ID NO: 855 - DNA, 1101 bp, Homo sapiens
atgtggaacgcgacgcccagcgaagagccggggttcaacctcacactggccgacctggactgggatgcttcccccggcaacgactcgctgggcgacgagctgctgcagctcttccccgcgccgctgctggcgggcgtcacagccacctgcgtggcactcttcgtggtgggtatcgctggcaacctgctcaccatgctggtggtgtcgcgcttccgcgagctgcgcaccaccaccaacctctacctgtccagcatggccttctccgatctgctcatcttcctctgcatgcccctggacctcgttcgcctctggcagtaccggccctggaacttcggcgacctcctctgcaaactcttccaattcgtcagtgagagctgcacctacgccacggtgctcaccatcacagcgctgagcgtcgagcgctacttcgccatctgcttcccactccgggccaaggtggtggtcaccaaggggcgggtgaagctggtcatcttcgtcatctgggccgtggccttctgcagcgccgggcccatcttcgtgctagtcggggtggagcacgagaacggcaccgacccttgggacaccaacgagtgccgccccaccgagtttgcggtgcgctctggactgctcacggtcatggtgtgggtgtccagcatcttcttcttccttcctgtcttctgtctcacggtcctctacagtctcatcggcaggaagctgtggcggaggaggcgcggcgatgctgtcgtgggtgcctcgctcagggaccagaaccacaagcaaaccgtgaaaatgctggctgtagtggtgtttgccttcatcctctgctggctccccttccacgtagggcgatatttattttccaaatcctttgagcctggctccttggagattgctcagatcagccagtactgcaacctcgtgtcctttgtcctcttctacctcagtgctgccatcaaccccattctgtacaacatcatgtccaagaagtaccgggtggcagtgttcagacttctgggattcgaacccttctcccagagaaagctctccactctgaaagatgaaagttctcgggcctggacagaatctagtattaatacatga

SEQ ID NO: 856 - DNA, 1401 bp, Homo sapiens
atgactacctctccgatcctgcagctgctgctgcggctctcactgtgcgggctgctgctccagagggcggagacaggctctaaggggcagacggcgggggagctgtaccagcgctgggaacggtaccgcagggagtgccaggagaccttggcagccgcggaaccgccttcaggcctcgcctgtaacgggtccttcgatatgtacgtctgctgggactatgctgcacccaatgccactgcccgtgcgtcctgcccctggtacctgccctggcaccaccatgtggctgcaggtttcgtcctccgccagtgtggcagtgatggccaatggggactttggagagaccatacacaatgtgagaacccagagaagaatgaggcctttctggaccaaaggctcatcttggagcggttgcaggtcatgtacactgtcggctactccctgtctctcgccacactgctgctagccctgctcatcttgagtttgttcaggcggctacattgcactagaaactatatccacatcaacctgttcacgtctttcatgctgcgagctgcggccattctcagccgagaccgtctgctacctcgacctggcccctaccttggggaccaggcccttgcgctgtggaaccaggccctcgctgcctgccgcacggcccagatcgtgacccagtactgcgtgggtgccaactacacgtggctgctggtggagggcgtctacctgcacagtctcctggtgctcgtgggaggctccgaggagggccacttccgctactacctgctcctcggctggggggcccccgcgcttttcgtcattccctgggtgatcgtcaggtacctgtacgagaacacgcagtgctgggagcgcaacgaagtcaaggccatttggtggattatacggacccccatcctcatgaccatcttgattaatttcctcatttttatccgcattcttggcattctcctgtccaagctgaggacacggcaaatgcgctgccgggattaccggctgaggctggctcgctccacgctgacgctggtgcccctgctgggtgtccacgaggtggtgtttgctcccgtgacagaggaacaggcccggggcgccctgcgcttcgccaagctcggctttgagatcttcctcagctccttccagggcttcctggtcagcgtcctctactgcttcatcaacaaggaggtgcagtcggagatccgccgtggctggcaccactgccgcctgcgccgcagcctgggcgaggagcaacgccagctcccggagcgcgccttccgggccctgccctccggctccggcccgggcgaggtccccaccagccgcggcttgtcctcggggaccctcccagggcctgggaatgaggccagccgggagttggaaagttactgctag

SEQ ID NO: 857 - DNA, 1662 bp, Homo sapiens
atgaagctgggatcgagcagggcagggcctgggagaggaagcgcgggactcctgcctggcgtccacgagctgcccatgggcatccctgccccctgggggaccagtcctctctccttccacaggaagtgctctctctgggcccctgggaggcccttcctcactctggtcctgctggtttccatcaagcaagttacaggatccctccttgaggaaacgactcggaagtgggctcagtacaaacaggcatgtctgagagacttactcaaggaaccttctggcatattttgtaacgggacatttgatcagtacgtgtgttggcctcattcttctcctggaaatgtctctgtaccctgcccttcatacttaccttggtggagtgaagagagctcaggaagggcctacagacactgcttggctcaggggacttggcagacgatagagaacgccacggatatttggcaggatgactccgaatgctccgagaaccacagcttcaagcaaaacgtggaccgttatgccttgctgtcaaccttgcagctgatgtacaccgtgggatactccttctctcttatctccctcttcctggctctcaccctcctcttgtttcttcgaaaactccactgcacgcgcaactacatccacatgaacttgtttgcttctttcatcctgagaaccctggctgtactggtgaaggacgtcgtcttctacaactcttactccaagaggcctgacaatgagaatgggtggatgtcctacctgtcagagatgtccacctcctgccgctcagtccaggttctcttgcattactttgtgggtgccaattacttatggctgctggttgaaggcctctacctccacacgctgctggagcccacagtgcttcctgagaggcggctgtggcccagatacctgctgttgggttgggccttccctgtgctatttgttgtaccctggggtttcgcccgtgcacacctggagaacacagggtgctggacaacaaatgggaataagaaaatctggtggatcatccgaggacccatgatgctctgtgtaacagtcaatttcttcatcttcctgaaaattctcaagcttctcatttctaagctcaaagctcatcaaatgtgcttcagagattataaatacagattggcaaaatcaacactggtcctcattcctttattgggcgttcatgagatcctcttctctttcatcactgatgatcaagttgaaggatttgcaaaacttatacgacttttcattcagttgacactgagctcctttcatgggttcctggtggccttgcagtatggttttgccaatggagaagtgaaggctgagctgcggaaatactgggtccgcttcttgctagcccgccactcaggctgcagagcctgtgtcctggggaaggacttccggttcctaggaaaatgtcccaagaagctctcggaaggagatggcgctgagaagcttcggaagctgcagccctcacttaacagtgggcggctcctacatctagccatgcgaggtcttggggagctgggcgcccagccccaacaggaccatgcacgctggccccggggcagcagcctgtccgagtgcagtgagggggatgtcaccatggccaacaccatggaggagattctggaagagagtgagatctag

SEQ ID NO: 858 - DNA, 1527 bp, Homo sapiens
atgacgtccacctgcaccaacagcacgcgcgagagtaacagcagccacacgtgcatgcccctctccaaaatgcccatcagcctggcccacggcatcatccgctcaaccgtgctggttatcttcctcgccgcctctttcgtcggcaacatagtgctggcgctagtgttgcagcgcaagccgcagctgctgcaggtgaccaaccgttttatctttaacctcctcgtcaccgacctgctgcagatttcgctcgtggccccctgggtggtggccacctctgtgcctctcttctggcccctcaacagccacttctgcacggccctggttagcctcacccacctgttcgccttcgccagcgtcaacaccattgtcgtggtgtcagtggatcgctacttgtccatcatccaccctctctcctacccgtccaagatgacccagcgccgcggttacctgctcctctatggcacctggattgtggccatcctgcagagcactcctccactctacggctggggccaggctgcctttgatgagcgcaatgctctctgctccatgatctggggggccagccccagctacactattctcagcgtggtgtccttcatcgtcattccactgattgtcatgattgcctgctactccgtggtgttctgtgcagcccggaggcagcatgctctgctgtacaatgtcaagagacacagcttggaagtgcgagtcaaggactgtgtggagaatgaggatgaagagggagcagagaagaaggaggagttccaggatgagagtgagtttcgccgccagcatgaaggtgaggtcaaggccaaggagggcagaatggaagccaaggacggcagcctgaaggccaaggaaggaagcacggggaccagtgagagtagtgtagaggccaggggcagcgaggaggtcagagagagcagcacggtggccagcgacggcagcatggagggtaaggaaggcagcaccaaagttgaggagaacagcatgaaggcagacaagggtcgcacagaggtcaaccagtgcagcattgacttgggtgaagatgacatggagtttggtgaagacgacatcaatttcagtgaggatgacgtcgaggcagtgaacatcccggagagcctcccacccagtcgtcgtaacagcaacagcaaccctcctctgcccaggtgctaccagtgcaaagctgctaaagtgatcttcatcatcattttctcctatgtgctatccctggggccctactgctttttagcagtcctggccgtgtgggtggatgtcgaaacccaggtaccccagtgggtgatcaccataatcatctggcttttcttcctgcagtgctgcatccacccctatgtctatggctacatgcacaagaccattaagaaggaaatccaggacatgctgaagaagttcttctgcaaggaaaagcccccgaaagaagatagccacccagacctgcccggaacagagggtgggactgaaggcaagattgtcccttcctacgattctgctacttttccttga

SEQ ID NO: 859 - DNA, 1368 bp, Homo sapiens
atgatctgctgcagtgctctgagccctaggattcatctttcttttcaccgtagcctgactggcattgtattagcaaactcatcactagacatcgtactacacgacacgtactacgttgtagcccactgcgggggaaatgttaggcgcctgcattgcggtggccccgcgtcccgggagcgcacagcaatgcaggcgcttaacattaccccggagcagttctctcggctgctgcgggaccacaacctgacgcgggagcagttcatcgctctgtaccggctgcgaccgctcgtctacaccccagagctgccgggacgcgccaagctggccctcgtgctcaccggcgtgctcatcttcgccctggcactctttggcaatgctctggtgttctacgtggtgacccgcagcaaggccatgcgcaccgtcaccaacatctttatctgctccttggcgctcagtgacctgctcatcaccttcttctgcattcccgtcaccatgctccagaacatttccgacaactggctggggggtgctttcatttgcaagatggtgccatttgtccagtctaccgctgttgtgacagaaatcctcactatgacctgcattgctgtggaaaggcaccagggacttgtgcatccttttaaaatgaagtggcaatacaccaaccgaagggctttcacaatgctaggtgtggtctggctggtggcagtcatcgtaggatcacccatgtggcacgtgcaacaacttgagatcaaatatgacttcctatatgaaaaggaacacatctgctgcttagaagagtggaccagccctgtgcaccagaagatctacaccaccttcatcctgtcatcctcttcctcctgcctcttatggaagaagaaacgagctgtcattatgatggtgacagtggtggctctctttgctgtgtgctgggcaccattccatgttgtccatatgatgattgaatacagtaattttgaaaaggaatatgatgatgtcacaatcaagatgatttttgctatcgtgcaaattattggattttccaactccatctgtaatcccattgtctatgcatttatgaatgaaaacttcaaaaaaaatgttttgtctgcagtttgttattgcatagtaaataaaaccttctctccagcacaaaggcatggaaattcaggaattacaatgatgcggaagaaagcaaagttttccctcagagagaatccagtggaggaaaccaaaggagaagcattcagtgatggcaacattgaagtcaaattgtgtgaacagacagaggagaagaaaaagctcaaacgacatcttgctctctttaggtctgaactggctgagaattctcctttagacagtgggcattaa

SEQ ID NO: 860 - DNA, 2070 bp, Homo sapiens
ccgacacccacgggcggagatcacctgctgccccgcagacccctgtcccttcctcccggaccagcagctagaggatgtccaaacggagttggtgggctggatccagaaagcccccaagagagatgctgaaactctcaggctctgactccagccaaagcatgaatggccttgaagtggctcccccaggtctgatcaccaacttctccctggccacggcagagcaatgtggccaggagacgccactggagaacatgctgttcgcctccttctaccttctggattttatcctggctttagttggcaataccctggctctgtggcttttcatccgagaccacaagtccgggaccccggccaacgtgttcctgatgcatctggccgtggccgacttgtcgtgcgtgctggtcctgcccacccgcctggtctaccacttctctgggaaccactggccatttggggaaatcgcatgccgtctcaccggcttcctcttctacctcaacatgtacgccagcatctacttcctcacctgcatcagcgccgaccgtttcctggccattgtgcacccggtcaagtccctcaagctccgcaggcccctctacgcacacctggcctgtgccttcctgtgggtggtggtggctgtggccatggccccgctgctggtgagcccacagaccgtgcagaccaaccacacggtggtctgcctgcagctgtaccgggagaaggcctcccaccatgccctggtgtccctggcagtggccttcaccttcccgttcatcaccacggtcacctgctacctgctgatcatccgcagcctgcggcagggcctgcgtgtggagaagcgcctcaagaccaaggcagtgcgcatgatcgccatagtgctggccatcttcctggtctgcttcgtgccctaccacgtcaaccgctccgtctacgtgctgcactaccgcagccatggggcctcctgcgccacccagcgcatcctggccctggcaaaccgcatcacctcctgcctcaccagcctcaacggggcactcgaccccatcatgtatttcttcgtggctgagaagttccgccacgccctgtgcaacttgctctgtggcaaaaggctcaagggcccgccccccagcttcgaagggaaaaccaacgagagctcgctgagtgccaagtcagagctgtgagcggggggcgccgtccaggccgagcgcagactgtttaggactcagcagacccagcaagaggcatctgccctttccccagccacctccccagcaagcaacctgaaatctcagcagatgcccaccatttctctagatcgcctagtctcaacccataaaaaggaagaactgacaaaggggatccatcggccacccctctgcaggggcttgtgatggctacaatggctcctagacactcaacgacttcatctgtggcagggagagaggaggccggaagaacaacccctgaacaatggaggcctttctttcccgctaggctcccagcctccttcccgctacagaatcgctcatcggcgaggctcagcagaaagaccctgaaggcaggctgcaaatgacccagaagagggacctgggagtcctggtggggacggggagggagtctcaatactcctttgcagcgcaaggtactctgagtcccctctgtagtgcctctgccagacacacactgcctgagttgaagagacacaggccacacatttcaggctggttgccagcggacgtcagcactcacggcctgcggggactcagcacagctctggattctggatctctcctgctgtaaccccacgcacaagcctgcaacccccagagctctttgacaggctcccaggcctcccagtcctggacaagcatgtgcagtcacgggagctcagctcaggccagggctgggctgtgcacctgcctcccactgacccagacccacttcctccagagaggcctctctccgcctgagctatttcccttgctagtgtgcagatatttccctaacatgtccttttttgtatttgtttgtacggaccataaatataactgtagctttaagactaaaaaaaaa

SEQ ID NO: 861 - DNA, 1077 bp, Homo sapiens
atgccctctgtgtctccagcggggccctcggccggggcagtccccaatgccaccgcagtgacaacagtgcggaccaatgccagcgggctggaggtgcccctgttccacctgtttgcccggctggacgaggagctgcatggcaccttcccaggcctgtgcgtggcgctgatggcggtgcacggagccatcttcctggcagggctggtgctcaacgggctggcgctgtacgtcttctgctgccgcacccgggccaagacaccctcagtcatctacaccatcaacctggtggtgaccgatctactggtagggctgtccctgcccacgcgcttcgctgtgtactacggcgccaggggctgcctgcgctgtgccttcccgcacgtcctcggttacttcctcaacatgcactgctccatcctcttcctcacctgcatctgcgtggaccgctacctggccatcgtgcggcccgaagctcccgccgcctgccgccagcctgcctgtgccagggccgtgtgcgccttcgtgtggctggccgccggtgccgtcaccctgtcggtgctgggcgtgacaggcagccggccctgctgccgtgtctttgcgctgactgtcctggagttcctgctgcccctgctggtcatcagcgtgtttaccggccgcatcatgtgtgcactgtcgcggccgggtctgctccaccagggtcgccagcgccgcgtgcgggccatgcagctcctgctcacggtgctcatcatctttctcgtctgcttcacgcccttccacgcccgccaagtggccgtggcgctgtggcccgacatgccacaccacacgagcctcgtggtctaccacgtggccgtgaccctcagcagcctcaacagctgcatggaccccatcgtctactgcttcgtcaccagtggcttccaggccaccgtccgaggcctcttcggccagcacggagagcgtgagcccagcagcggtgacgtggtcagcatgcacaggagctccaagggctcaggccgtcatcacatcctcagtgccggccctcacgccctcacccaggccctggctaatgggcccgaggcttag

SEQ ID NO: 862 - DNA, 1050 bp, Homo sapiens
atgaactccaccttggatggtaatcagagcagccaccctttttgcctcttggcatttggctatttggaaactgtcaatttttgccttttggaagtattgattattgtctttctaactgtattgattatttctggcaacatcattgtgatttttgtatttcactgtgcacctttgttgaaccatcacactacaagttattttatccagactatggcatatgctgacctttttgttggggtgagctgcgtggtcccttctttatcactcctccatcacccccttccagtagaggagtccttgacttgccagatatttggttttgtagtatcagttctgaagagcgtctccatggcttctctggcctgtatcagcattgatagatacattgccattactaaacctttaacctataatactctggttacaccctggagactacgcctgtgtattttcctgatttggctatactcgaccctggtcttcctgccttcctttttccactggggcaaacctggatatcatggagatgtgtttcagtggtgtgcggagtcctggcacaccgactcctacttcaccctgttcatcgtgatgatgttatatgccccagcagcccttattgtctgcttcacctatttcaacatcttccgcatctgccaacagcacacaaaggatatcagcgaaaggcaagcccgcttcagcagccagagtggggagactggggaagtgcaggcctgtcctgataagcgctatgccatggtcctgtttcgaatcactagtgtattttacatcctctggttgccatatatcatctacttcttgttggaaagctccactggccacagcaaccgcttcgcatccttcttgaccacctggcttgctattagtaacagtttctgcaactgtgtaatttatagtctctccaacagtgtattccaaagaggactaaagcgcctctcaggggctatgtgtacttcttgtgcaagtcagactacagccaacgacccttacacagttagaagcaaaggccctcttaatggatgtcatatctga

SEQ ID NO: 863 - DNA, 1113 bp, Homo sapiens
atgggtgacagaagattcattgacttccaattccaagattcaaattcaagcctcagacccaggttgggcaatgctactgccaataatacttgcattgttgatgattccttcaagtataatctcaatggtgctgtctacagtgttgtattcatcttgggtctgataaccaacagtgtctctctgtttgtcttctgtttccgcatgaaaatgagaagtgagactgctatttttatcaccaatctagctgtctctgatttgctttttgtctgtacactaccttttaaaatattttacaacttcaaccgccactggccttttggtgacaccctctgcaagatctctggaactgcattccttaccaacatctatgggagcatgctctttctcacctgtattagtgtggatcgtttcctggccattgtctatccttttcgatctcgtactattaggactaggaggaattctgccattgtgtgtgctggtgtctggatcctagtcctcagtggcggtatttcagcctctttgttttccaccactaatgtcaacaatgcaaccaccacctgctttgaaggcctctccaaacgtgtctggaagacttatttatccaagatcacaatatttattgaagttgttgggtttatcattcctctaatattgaatgtctcttgctcttctgtggtgctgagaactcttcgcaagcctgctactctgtctcaaattgggaccaataagaaaaaagtactgaaaatgatcacagtacatatggcagtctttgtggtatgctttgtaccctacaactctgtcctcttcttgtatgccctggtgcgctcccaagctattactaattgctttttggaaagatttgcaaagatcatgtacccaatcaccttgtgccttgcaactctgaactgttgttttgaccctttcatctattacttcacccttgaatcctttcagaagtccttctacatcaatgcccacatcagaatggagtccctgtttaagactgaaacacctttgaccacaaagccttcccttccagctattcaagaggaagtgagtgatcaaacaacaaataatggtggtgaattaatgctagaatccaccttttag

SEQ ID NO: 864 - DNA, 1083 bp, Homo sapiens
atggcccccacagagccctggagccccagcccggggtcagcgccctgggactactcggggttggacggcctggaggagctggagctgtgtccggccggggacctgccctacggctacgtctacatccccgcgctctacctggcggccttcgccgtgggcctgctgggcaacgcctttgtggtgtggctgctggccgggcggcggggcccgcggcggctggtggataccttcgtgctgcacctggcggcagctgacctgggcttcgtgctcacgctgccgctgtgggccgcggcggcggctaggcggccgtggccgttcggcgatggcctctgcaagctcagcacgttcgcgctggcgggcacgcgctcggcgggcgcgctgctgctggcgggcatgagcgtggaccgctacctggccgtggtgaagctgctcgaggcgaggccactgcgcaccccgcgctgcgccgtggcctcgtgctgcggcgtctgggccgtggcgctgctggccggcctgccctccctggtctaccgggggttgcagcccctgcctgggggccaggacagccagtgcggcgaggagccctcccacgccttccagggcctcagcttgctgctgctgctgctgaccttcgtgctgcccctggtcgtcaccctcttctgctactgccgcatctcgcgccgcctgcgacggccgccgcacgtgggtcgggcccggaggaactcgctgcgcatcatcttcgccatcgagagcacgtttgtgggctcctggctgcccttcagcgccctgcgggccgtcttccacctggcgcgtctgggggcgctgccgctgccgtgccccctgctgctggcgctgcgctggggcctcaccattgccacctgcctggccttcgtcaacagctgcgccaacccgctcatctacctcctgctggaccgctcattccgagcccgggcgctggacggggcctgcgggcgcaccggccgcctggcgcgaaggatcagctcagcctcctcgctctccagggacgacagttccgtgttccgttgccgggcccaggccgcgaacactgcctcggcctcctggtag

SEQ ID NO: 865 - DNA, 7512 bp, Homo sapiens
cgccatggcggcgccgggttgcggaccctgacgccggcgcggggcgcgcaccatgaactcgtgggacgcgggcctggcggggctactggtgggcacgatgggcgtctcgctgctgtccaacgcgctggtgctgctctgcctgctgcacagcgcggacatccgccgccaggcgccggcgctcttcaccctgaacctcacgtgcgggaacctgctgtgcaccgtggtcaacatgccgctcacgctggccggcgtcgtggcgcagcggcagccggcgggcgaccgcctgtgccgcctggctgccttcctcgacaccttcctggctgccaactccatgctcagcatggccgcgctcagcatcgaccgctgggtggccgtggtcttcccgctgagctaccgggccaagatgcgcctccgcgacgcggcgctcatggtggcctacacgtggctgcacgcgctcaccttcccagccgccgcgctcgccctgtcctggctcggcttccaccagctgtacgcctcgtgcacgctgtgcagccggcggccggacgagcgcctgcgcttcgccgtcttcactggcgccttccacgctctcagcttcctgctctccttcgtcgtgctctgctgcacgtacctcaaggtgctcaaggtggcccgcttccattgcaagcgcatcgacgtgatcaccatgcagacgctcgtgctgctggtggacctgcaccccagtgtgcgggaacgctgtctggaggagcagaagcggaggcgacagcgagccaccaagaagatcagcaccttcatagggaccttccttgtgtgcttcgcgccctatgtgatcaccaggctagtggagctcttctccacggtgcccatcggctcccactggggggtgctgtccaagtgcttggcgtacagcaaggccgcatccgacccctttgtgtactccttactgcgacaccagtaccgcaaaagctgcaaggagattctgaacaggctcctgcacagacgctccatccactcctctggcctcacaggcgactctcacagccagaacattctgccggtgtctgagtgaaggaccgcgctcctgctgaagagtttagaatgaggcagcggtgagaagaagggtgggagggcgtgggggcccctgggtggacaccaccagccaccagtccctggcatgcccagtgatcctggttccctggcttgtaggggctccagagcctgcttcctggttcctcaagggcagatattggacactccttatttgtcaccaaaggatgactgtaggccgtgtgctggcctttctttctaagaagctgctttgagctcctggactcacctgaggctccctgggggatgacactcagttctgtcactgtcaaggatgcagagagctggtggtaggtgggaagcatggtgtccacctgcctgctgaccactggacgctgctccatgctgaagaaaagtgacagtctccaggggacatttcagccatgctgaaagggaggctggcagtggtcatttggcccggatctaacatggcacctcgtctccacagggtagtggtggctgcttcaacccaaatattattcagctggtactaacgacattgtgcccagctgggactcttgggctctgtgcctgagggaaaatgtttcacaactagtggctgcccaattgctgctgaccagttgtcttagaaatggtcaattggattcaactttagtcctctccttccccctaaaagcgaatgtttgtgtgtgcagacaatcttagcatgaaaatggtttaaataggctggtcctacatgtattaggttctttcaagtttgactgggaggtcacctttttctgatttacaagtcctaattgttggagctcagtaaaggtaggaggaaggtggctggttggtcctcccttccccctgtttgtgacctgaatttacaggaagtgtttcaacttgtcttatgcatcttatctggcatgtcctgggagatggatgggcaagaactggcctgagcagggatttttgccttgattttaagtcactgggttccattgtcctggcacctccatttccttagtttctgtaagcctgttaacagaaagtagaggctattcaaggttatcaagaaagtgccctgtgctaatgatgagacagtgaattttttttttttttcgagatgggagtttcactcttattgcccaggctagagtgcaatggtgcgatctaggctcaccacaacctctgccttccaggttcaagtgattagagacagtgaaatttttatggaatactgcacctataaaacacatgccaatctgttagcagtcctgacttgatttaataaaaaccaaggagagccacccctgctttctggccatctcttctttgtctaccatttcaaattgacttgtgaatactcagagcagttatttttcaatcctccactctaagtgattcctccagggtgggaagcacggggagcaatggaatcagatggctcattctctccttccagctctttacatcctaactttggaggtatagaaggaaggatgtggtccaacgggaaggaagtgaagagtctattggtttttacttctaggcagtcccaatttttaaaggcagagaagtatctgcatctttatttgaaaagacgtcttattaactcttagctcctcagttagaaaacaattcacctggcttagtcttgtctagtttcaaagttaccatggagactagaatggagacaggtgtagcttccaaggaggccttggcatcttgcagttgctgtcagagatgggctcatatctgcttggggaagccaatggggcacaatccttcccaatttcatgatctggggcatcatgtcggtagctgaagtcagccacggtgggagtgtttataccatgaaaatcagcaagtgctgtaaatcaggccttttgccccacagagagctgattgtgaaacatctactagcacaccactgccagacatgactgtgtgtgtccctgaaacaaaattgctctggctcagagctcctttggccactcatattacaatagcaacagacatttgcttcctggtggcaagtaactgtgcaccctccaacatcccaaccccagaggaaccagtgggattgaaaaccagcagaagccaagacaggatgcacagctgaattggaggagagtagctcccttctcacacaaacgctttcaaagttgggcaaaagtggcccagtgcgtgaggtcagtcaacagccaaattccagcagcaaaatacattttcatcaatatcactttgggagaataactgtggcacatgctctttctgctttctctgtactgtataggcaacatgttgtactcccagtagcaactagatctcttttacctcttctttagccaagaagcaagatctgtcacccacaacaccacatatcttgaaaagatgcttttcataattttcactatacctctaaaaccaattgtaccgacatcacgtagacaaaaactccagataaatccattgattgggtattttcattattatttggacacatgaattaaatcccaagggaaagtgagaagaaaattaatgtattagcaaccagtgttagccaactctgctgtaattacctttagataaatgtttattttcatctctatacagtctatcaaatttgccccctggctttattactcccaattgaattatctacctcattttgttaatttaatttatcaaaggtaacattgttttctcaggtataacacatagaaacaccaagattttcagcatctgaatcaaactaaaattacttgcttgacttcactccagggtgagacttgacctttaaggcccaaactctggtgaactgttggactgggtagaaatctttcaagaagcttgaaaataaggccataaaggaggggctttcaaattcctaaatccacatatagggctgagttcctagtcctacacaatcagaatttgcctttttaagtcacgctgcaactattccggctttttatatggcacctttctgagggaggggattttacagccgagggacctccaaagggaacgtccatttgcatgtgtgccctggtatttagggtttgtctcatggtcagctcgcctctcaaagatggctcaccaatcacctgcctgtttttacttagaaagcaggcttgggcaggaggggaaatggatttgaaccatctcagaccaactctatctcttctagcactcagctcagcctcctgtccccatgagcaataaaactctctccttatgtctgtgaaattcgttttctttttcatggtgcctttctttctaagaaaagatagaaagaatggggccaggttcatgtcccagttgtcacccttttacatgcttgggtgcaggtagatgaggccttcccatggctacagtgtgacccttggaggaaccaaaggctgtgcattgttagaatttagcccagatgcaggataaactagcttgcctgagtttaatgaggatattatatcaggtgccaggaatcccttgggtcagctcctatcctctggacggggagcatcatgggaaaaagaggtccgagtcatatttagggcttcatgtgtctggaagggagccattagctcttaaattattcacagaagtcaccacggaaggttgtttaagatgcagattccagcatcccctcctcagagatcaatttcagcagggccaggcaggacctgggtttccgcacttttaatcatcgatgcccaggtaactgataggagttttcttcaaaccatcccctaaggagaaatgatcttagacacttggataaactctatagaaaattgagtgtttctattaataactatctaggtttcaattgtcttgtatctttccctaattctccaaacagttcaatctccagctttattcaatggctgggccattttgttcttggagggacaaaattgacctctccatgaaattgcaaaaacccatcttcattcctttttatggggctccaggtcataaggatgagatatatttggggtactggcagaggatggcagagctggctggctctgagccaggaagccttgttagaggaaggaactctggcattcagaggtgtccccttgggggcacttgcttgggtcttggatcaaactctactggggcagcctggctgtgggaggtgatgacatctgccacctctgccactacccagagcttgtcctgccctcttcccagccagcctcacacacaggagctgagccaggctgaggcaaggtcagcgagagacagttctccatgccagtatctgggtgtgggtctcttgttggctcccagctcatcccgtgtggctgacccttccaggtcacttggagcagccagtaatgacagtgtcctaacagctggtgggtatggaggaaagactagacatcaggctatggactcacatggagggccctggtgttggctctgggacctgggctgggccggacctggggagagggtgggtggagcttggcctctgcagtttgcgcttgcaggttcaggggagaaagttgtttgagatcagggtttaggggtagtgtttcccattaatcttcatcataatcttttgatgtaggtgctgttattatctctacgttacacatctgggaggatttgaaagtcctggagacagggaggttttggggagaatgcaaaacagggcagggctctcaaggagggtggaccagtgaccatggggaaactggtgtttctattaataagtatctaagtttcaattgtcttgtatctttccctaattctccaaacggttcaatctccagttttattcagggactgggccattttgttctcagagggacaaaactgatctctccatgaaatcccctgcacctcactctgggcagctctaggctcagcagatgtttttctgccattaggaaacagccccttactctcagctcctgtgctaacacccatacccaccagctgggcgttgggacctctcccgtcatatggctgccacttgcttgggaaggaattctccagactccttttactttgtatgtgtttctaggggaattctgagggaagaagctttgcagcaacctctgtgcccagaacatacggctcacaagtcctttgtgccgacagggaatctatctaattgttttagtgtgtgaggctcattgtcagcctagatttccctgaaactctgggccagcagcccccaggagcatcagtaggacccagcatttcccctggcaccaaagtggacctctttgcaccttgcagccgggagaactgacttagagggccctggtgttggctctggaacctgggctgagatggattcggggagaggctgggtggagcttggcctctacggtctgttcttgcagattcaggagagaaagtggtatgagagcagtgtggtttgtaagttccccaacttccccgctggctcacactgtctccccagaccaatggcctattagcccccaaaaagttagtccaaccccaggccagctgcctttgctctgctgtggcctaagttctggcctggtcaaaggaaggtggcaggaactccaggcttgctcctgcctcctcacacctcattccacaaatgcggagtgaaagagcaggagccagacacatttgggggttgactgtctagaaaggaggaatcagaggtcccaaggaacacaatcgtgcaacttcctagggaatctgcatcaggagaaagaagcggctaggacacacagtggcttcgctcagcctggccacgacatcactgtgcagaagaagagatctgtcaggggtccagaggagcggagtcctggagcctctgggagggtggcatgtggcagctgcaggctgtggtccagaactatgagcagacttgcctgtcactctccaaacatttactgaacacctactgtgtgccaggccctgtgctttgtcaggctctgggggagacaggtcattactctgcagtgtgggaagcggggctgccctggaagtgtgtactcagtgctgtgggggtacagagggagggctggagaacttagctggtgggaaaggagggttctggaaggcttctcagaggtagtggcattgggccagaacttacagtagggaagagcatgtggcaaggcacagaggagatgggagcctgcctggtgaggggtccagtggtgacagagctcagtgtgggtccagagatggtgtcaggtgagggctgagaggggagggcaagtgccccttgagatgggctgaacgtgatgatgatctgtggccagtgggagatgatagaagtcttgaggttgggaatataagaattaggtctcttttagaaagagaggacatggagaaaatccatatatttttagctaccaaaaaagagaaggaagaaagaaaagaaataagaagagaagcaagacagaaaagaaggaagagagaaggaagaatggcaaaggaaggaagaaggag

SEQ ID NO: 866 - DNA, 1446 bp, Homo sapiens
atgcggtggctgtggcccctggctgtctctcttgctgtgattttggctgtggggctaagcagggtctctgggggtgcccccctgcacctgggcaggcacagagccgagacccaggagcagcagagccgatccaagaggggcaccgaggatgaggaggccaagggcgtgcagcagtatgtgcctgaggagtgggcggagtacccccggcccattcaccctgctggcctgcagccaaccaagcccttggtggccaccagccctaaccccgacaaggatgggggcaccccagacagtgggcaggaactgaggggcaatctgacaggggcaccagggcagaggctacagatccagaaccccctgtatccggtgaccgagagctcctacagtgcctatgccatcatgcttctggcgctggtggtgtttgcggtgggcattgtgggcaacctgtcggtcatgtgcatcgtgtggcacagctactacctgaagagcgcctggaactccatccttgccagcctggccctctgggattttctggtcctctttttctgcctccctattgtcatcttcaacgagatcaccaagcagaggctactgggtgacgtttcttgtcgtgccgtgcccttcatggaggtctcctctctgggagtcacgactttcagcctctgtgccctgggcattgaccgcttccacgtggccaccagcaccctgcccaaggtgaggcccatcgagcggtgccaatccatcctggccaagttggctgtcatctgggtgggctccatgacgctggctgtgcctgagctcctgctgtggcagctggcacaggagcctgcccccaccatgggcaccctggactcatgcatcatgaaaccctcagccagcctgcccgagtccctgtattcactggtgatgacctaccagaacgcccgcatgtggtggtactttggctgctacttctgcctgcccatcctcttcacagtcacctgccagctggtgacatggcgggtgcgaggccctccagggaggaagtcagagtgcagggccagcaagcacgagcagtgtgagagccagctcaacagcaccgtggtgggcctgaccgtggtctacgccttctgcaccctcccagagaacgtctgcaacatcgtggtggcctacctctccaccgagctgacccgccagaccctggacctcctgggcctcatcaaccagttctccaccttcttcaagggcgccatcaccccagtgctgctcctttgcatctgcaggccgctgggccaggccttcctggactgctgctgctgctgctgctgtgaggagtgcggcggggcttcggaggcctctgctgccaatgggtcggacaacaagctcaagaccgaggtgtcctcttccatctacttccacaagcccagggagtcacccccactcctgcccctgggcacaccttgctga

SEQ ID NO: 867 - DNA, 1362 bp, Homo sapiens
atggcttcacccagcctcccgggcagtgactgctcccaaatcattgatcacagtcatgtccccgagtttgaggtggccacctggatcaaaatcacccttattctggtgtacctgatcatcttcgtgatgggccttctggggaacagcgccaccattcgggtcacccaggtgctgcagaagaaaggatacttgcagaaggaggtgacagaccacatggtgagtttggcttgctcggacatcttggtgttcctcatcggcatgcccatggagttctacagcatcatctggaatcccctgaccacgtccagctacaccctgtcctgcaagctgcacactttcctcttcgaggcctgcagctacgctacgctgctgcacgtgctgacactcagctttgagcgctacatcgccatctgtcaccccttcaggtacaaggctgtgtcgggaccttgccaggtgaagctgctgattggcttcgtctgggtcacctccgccctggtggcactgcccttgctgtttgccatgggtactgagtaccccctggtgaacgtgcccagccaccggggtctcacttgcaaccgctccagcacccgccaccacgagcagcccgagacctccaatatgtccatctgtaccaacctctccagccgctggaccgtgttccagtccagcatcttcggcgccttcgtggtctacctcgtggtcctgctctccgtagccttcatgtgctggaacatgatgcaggtgctcatgaaaagccagaagggctcgctggccgggggcacgcggcctccgcagctgaggaagtccgagagcgaagagagcaggaccgccaggaggcagaccatcatcttcctgaggctgattgttgtgacattggccgtatgctggatgcccaaccagattcggaggatcatggctgcggccaaacccaagcacgactggacgaggtcctacttccgggcgtacatgatcctcctccccttctcggagacgtttttctacctcagctcggtcatcaacccgctcctgtacacggtgtcctcgcagcagtttcggcgggtgttcgtgcaggtgctgtgctgccgcctgtcgctgcagcacgccaaccacgagaagcgcctgcgcgtacatgcgcactccaccaccgacagcgcccgctttgtgcagcgcccgttgctcttcgcgtcccggcgccagtcctctgcaaggagaactgagaagattttcttaagcacttttcagagcgaggccgagccccagtctaagtcccagtcattgagtctcgagtcactagagcccaactcaggcgcgaaaccagccaattctgctgcagagaatggttttcaggagcatgaagtttga

SEQ ID NO: 868 - DNA, 1089 bp, Homo sapiens
atgggcaaccacacgtgggagggctgccacgtggactcgcgcgtggaccacctctttccgccatccctctacatctttgtcatcggcgtggggctgcccaccaactgcctggctctgtgggcggcctaccgccaggtgcaacagcgcaacgagctgggcgtctacctgatgaacctcagcatcgccgacctgctgtacatctgcacgctgccgctgtgggtggactacttcctgcaccacgacaactggatccacggccccgggtcctgcaagctctttgggttcatcttctacaccaatatctacatcagcatcgccttcctgtgctgcatctcggtggaccgctacctggctgtggcccacccactccgcttcgcccgcctgcgccgcgtcaagaccgccgtggccgtgagctccgtggtctgggccacggagctgggcgccaactcggcgcccctgttccatgacgagctcttccgagaccgctacaaccacaccttctgctttgagaagttccccatggaaggctgggtggcctggatgaacctctatcgggtgttcgtgggcttcctcttcccgtgggcgctcatgctgctgtcgtaccggggcatcctgcgggccgtgcggggcagcgtgtccaccgagcgccaggagaaggccaagatcaagcggctggccctcagcctcatcgccatcgtgctggtctgctttgcgccctatcacgtgctcttgctgtcccgcagcgccatctacctgggccgcccctgggactgcggcttcgaggagcgcgtcttttctgcataccacagctcactggctttcaccagcctcaactgtgtggcggaccccatcctctactgcctggtcaacgagggcgcccgcagcgatgtggccaaggccctgcacaacctgctccgctttctggccagcgacaagccccaggagatggccaatgcctcgctcaccctggagaccccactcacctccaagaggaacagcacagccaaagccatgactggcagctgggcggccactccgccctcccagggggaccaggtgcagctgaagatgctgccgccagcacaatga

SEQ ID NO: 869 - DNA, 2856 bp, Homo sapiens
atgccgggcccgctagggctgctctgcttcctcgccctggggctgctcggctcggccgggcccagcggcgcggcgccgcctctctgcgcggcgccctgcagctgcgacggcgaccgtcgggtggactgctccgggaaggggctgacggccgtgcccgaggggctcagcgccttcacccaagcgctggatatcagtatgaacaacattactcagttgccagaagatgcatttaagaactttccttttctagaagagctacaattggcgggcaacgacctttcttttatccacccaaaggccttgtctgggttgaaagaactcaaagttctaacgctccagaataatcagttgaaaacagtacccagtgaagccattcgagggctgagtgctttgcagtctttgcgtttagatgccaaccatattacctcagtccccgaggacagttttgaaggacttgttcagttacggcatctgtggctggatgacaacagcttgacggaggtgcctgtgcaccccctcagcaatctgcccaccctacaggcgctgaccctggctctcaacaagatctcaagcatccctgactttgcatttaccaacctttcaagcctggtagttctgcatcttcataacaataaaattagaggcctgagtcaacactgttttgatggactagataacctggagaccttagacttgagttataataacttgggggaatttcctcaggctattaaagcccgtcctagccttaaagagctaggatttcatagtaattctatttctgttatccctgatggagcatttgatggtaatccactcttaagaactatacatttgtatgataatcctctgtcttttgtggggaactcagcatctcacaatttatctgatcttcattccctagtcattcgtggtgcaagcatggtgcagcagttccccaatcttacaggaactgtccacctggaaagtctgactttgacaggtacaaagataagcagcatacctaataatttgtgtcaagaacaaaagatgcttaggactttggacttgtcttacaataatataagagaccttccaagttttaatggttgccatgctctggaagaaatttctttacagcgtaatcaaatctaccaaataaaggaaggcacctttcaaggcctgatatctctaaggattctagatctgagtagaaacctgatacatgaaattcacagtagagcttttgccacacttgggccaataactaacctagatgtaagtttcaatgaattaacttcctttcctacggaaggcccgaatgggctaaatcaactgaaacttgtgggcaacttcaagctgaaagaagccttagcagcaaaagactttgttaacctcaggtctttatcggtaccatatgcttatcagtgctgtgcattttggggttgtgactcttatgcaaatttaaacacagaagataacagcctccaggaccacagtgtggcacaggagaaaggtactgctgatgcagcaaatgtcacaagcactcttgaaaatgaagaacatagtcaaataattatccattgtacaccttcaacaggtgcttttaagccctgtgaatatttactgggaagctggatgattcgtcttactgtgtggttcattttcttggttgcattatttttcaacctgcttgttattttaacaacatttgcatcttgtacatcactgccttcgtccaaattgtttataggcttgatttctgtgtctaacttattcatgggaatctatactggcatcctaacttttcttgatgctgtgtcctggggcagattcgctgaatttggcatttggtgggaaactggcagtggctgcaaagtagctgggtttcttgcagttttctcctcagaaagtgccatatttttattaatgctagcaactgtcgaaagaagcttatctgcaaaagatataatgaaaaatgggaagagcaatcatctcaaacagttccgggttgctgccctttcggctttcctaggtgctacagtagcaggctgttttccccttttccatagaggggaatattctgcatcacccctttgtttgccatttcctacaggtgaaacgccatcattaggattcactgtaacgttagtgctattaaactcactagcatttttattaatggccgttatctacactaagctatactgcaacttggaaaaagaggacctctcagaaaactcacaatctagcatgattaagcatgtcgcttggctaatcttcaccaattgcatctttttctgccctgtggcgtttttttcatttgcaccattgatcactgcaatctctatcagccccgaaataatgaagtctgttactctgatattttttccattgcctgcttgcctgaatccagtcctgtatgttttcttcaacccaaagtttaaagaagactggaagttactgaagcgacgtgttaccaagaaaagtggatcagtttcagtttccatcagtagccaaggtggttgtctggaacaggatttctactacgactgtggcatgtactcacatttgcagggcaacctgactgtttgcgactgctgcgaatcgtttcttttaacaaagccagtatcatgcaaacacttgataaaatcacacagctgtcctgcattggcagtggcttcttgccaaagacctgagggctactggtccgactgtggcacacagtcggcccactctgattatgcagatgaagaagattcctttgtctcagacagttctgaccaggtgcaggcctgtggacgagcctgcttctaccagagtagaggattccctttggtgcgctatgcttacaatctaccaagagttaaagactga

SEQ ID NO: 870 - DNA, 2826 bp, Homo sapiens
atggcttccccgcggagctccgggcagcccgggccgccgccgccgccgccaccgccgcccgcgcgcctgctactgctactgctgctgccgctgctgctgcctctggcgcccggggcctggggctgggcgcggggcgccccccggccgccgcccagcagcccgccgctctccatcatgggcctcatgccgctcaccaaggaggtggccaagggcagcatcgggcgcggtgtgctccccgccgtggaactggccatcgagcagatccgcaacgagtcactcctgcgcccctacttcctcgacctgcggctctatgacacggagtgcgacaacgcaaaagggttgaaagccttctacgatgcaataaaatacgggccgaaccacttgatggtgtttggaggcgtctgtccatccgtcacatccatcattgcagagtccctccaaggctggaatctggtgcagctttcttttgctgcaaccacgcctgttctagccgataagaaaaaatacccttatttctttcggaccgtcccatcagacaatgcggtgaatccagccattctgaagttgctcaagcactaccagtggaagcgcgtgggcacgctgacgcaagacgttcagaggttctctgaggtgcggaatgacctgactggagttctgtatggcgaggacattgagatttcagacaccgagagcttctccaacgatccctgtaccagtgtcaaaaagctgaaggggaatgatgtgcggatcatccttggccagtttgaccagaatatggcagcaaaagtgttctgttgtgcatacgaggagaacatgtatggtagtaaatatcagtggatcattccgggctggtacgagccttcttggtgggagcaggtgcacacggaagccaactcatcccgctgcctccggaagaatctgcttgctgccatggagggctacattggcgtggatttcgagcccctgagctccaagcagatcaagaccatctcaggaaagactccacagcagtatgagagagagtacaacaacaagcggtcaggcgtggggcccagcaagttccacgggtacgcctacgatggcatctgggtcatcgccaagacactgcagagggccatggagacactgcatgccagcagccggcaccagcggatccaggacttcaactacacggaccacacgctgggcaggatcatcctcaatgccatgaacgagaccaacttcttcggggtcacgggtcaagttgtattccggaatggggagagaatggggaccattaaatttactcaatttcaagacagcagggaggtgaaggtgggagagtacaacgctgtggccgacacactggagatcatcaatgacaccatcaggttccaaggatccgaaccaccaaaagacaagaccatcatcctggagcagctgcggaagatctccctacctctctacagcatcctctctgccctcaccatcctcgggatgatcatggccagtgcttttctcttcttcaacatcaagaaccggaatcagaagctcataaagatgtcgagtccatacatgaacaaccttatcatccttggagggatgctctcctatgcttccatatttctctttggccttgatggatcctttgtctctgaaaagacctttgaaacactttgcaccgtcaggacctggattctcaccgtgggctacacgaccgcttttggggccatgtttgcaaagacctggagagtccacgccatcttcaaaaatgtgaaaatgaagaagaagatcatcaaggaccagaaactgcttgtgatcgtggggggcatgctgctgatcgacctgtgtatcctgatctgctggcaggctgtggaccccctgcgaaggacagtggagaagtacagcatggagccggacccagcaggacgggatatctccatccgccctctcctggagcactgtgagaacacccatatgaccatctggcttggcatcgtctatgcctacaagggacttctcatgttgttcggttgtttcttagcttgggagacccgcaacgtcagcatccccgcactcaacgacagcaagtacatcgggatgagtgtctacaacgtggggatcatgtgcatcatcggggccgctgtctccttcctgacccgggaccagcccaatgtgcagttctgcatcgtggctctggtcatcatcttctgcagcaccatcaccctctgcctggtattcgtgccgaagctcatcaccctgagaacaaacccagatgcagcaacgcagaacaggcgattccagttcactcagaatcagaagaaagaagattctaaaacgtccacctcggtcaccagtgtgaaccaagccagcacatcccgcctggagggcctacagtcagaaaaccatcgcctgcgaatgaagatcacagagctggataaagacttggaagaggtcaccatgcagctgcaggacacaccagaaaagaccacctacattaaacagaaccactaccaagagctcaatgacatcctcaacctgggaaacttcactgagagcacagatggaggaaaggccattttaaaaaatcacctcgatcaaaatccccagctacagtggaacacaacagagccctctcgaacatgcaaagatcctatagaagatataaactctccagaacacatccagcgtcggctgtccctccagctccccatcctccaccacgcctacctcccatccatcggaggcgtggacgccagctgtgtcagcccctgcgtcagccccaccgccagcccccgccacagacatgtgccaccctccttccgagtcatggtctcgggcctgtaa

SEQ ID NO: 871 - DNA, 921 bp, Homo sapiens
atgtattcatttatggcaggatccatattcatcacaatatttggcaatcttgccatgataatttccatttcctacttcaagcagcttcacacaccaaccaacttcctcatcctctccatggccatcactgatttcctcctgggattcaccatcatgccatatagtatgatcagatcggtggagaactgctggtattttgggcttacattttgcaagatttattatagttttgacctgatgcttagcataacatccatttttcatctttgctcagtggccattgatagattttatgctatatgttacccattactttattccaccaaaataactattccagtcattaaaagattgctacttctatgttggtcggtccctggagcatttgccttcggggcggtcttctcagaggcctatgcagatggaatagagggctatgacatcttggttgcttgttccagttcctgcccagtgatgttcaacaagctatgggggaccaccttgtttatggcaggtttcttcactcctgggtctatgatggtggggatttacggcaaaatttttgcagtatccagaaaacatgctcatgccatcaataacttgcgagaaaatcaaaataatcaagtgaagaaagacaaaaaagctgccaaaactttaggaatagtgataggagttttcttattatgttggtttccttgtttcttcacaattttattggatccctttttgaacttctctactcctgtagttttgtttgatgccttgacatggtttggctattttaactccacatgtaatccgttaatatatggtttcttctatccctggtttcgcagagcactgaagtacattttgctaggtaaaattttcagctcatgtttccataatactattttgtgtatgcaaaaagaaagtgagtag

SEQ ID NO: 872 - DNA, 1107 bp, Homo sapiens
atggccaactccacagggctgaacgcctcagaagtcgcaggctcgttggggttgatcctggcagctgtcgtggaggtgggggcactgctgggcaacggcgcgctgctggtcgtggtgctgcgcacgccgggactgcgcgacgcgctctacctggcgcacctgtgcgtcgtggacctgctggcggccgcctccatcatgccgctgggcctgctggccgcaccgccgcccgggctgggccgcgtgcgcctgggccccgcgccatgccgcgccgctcgcttcctctccgccgctctgctgccggcctgcacgctcggggtggccgcacttggcctggcacgctaccgcctcatcgtgcacccgctgcggccaggctcgcggccgccgcctgtgctcgtgctcaccgccgtgtgggccgcggcgggactgctgggcgcgctctccctgctcggcccgccgcccgcaccgccccctgctcctgctcgctgctcggtcctggctgggggcctcgggcccttccggccgctctgggccctgctggccttcgcgctgcccgccctcctgctgctcggcgcctacggcggcatcttcgtggtggcgcgtcgcgctgccctgaggcccccacggccggcgcgcgggtcccgactccgctcggactctctggatagccgcctttccatcttgccgccgctccggcctcgcctgcccgggggcaaggcggccctggccccagcgctggccgtgggccaatttgcagcctgctggctgccttatggctgcgcgtgcctggcgcccgcagcgcgggccgcggaagccgaagcggctgtcacctgggtcgcctactcggccttcgcggctcaccccttcctgtacgggctgctgcagcgccccgtgcgcttggcactgggccgcctctctcgccgtgcactgcctggacctgtgcgggcctgcactccgcaagcctggcacccgcgggcactcttgcaatgcctccagagacccccagagggccctgccgtaggcccttctgaggctccagaacagacccccgagttggcaggagggcggagccccgcataccaggggccacctgagagttctctctcctga

SEQ ID NO: 873 - DNA, 3045 bp, Homo sapiens
atggttttctctgtcaggcagtgtggccatgttggcagaactgaagaagttttactgacgttcaagatattccttgtcatcatttgtcttcatgtcgttctggtaacatccctggaagaagatactgataattccagtttgtcaccaccacctgctaaattatctgttgtcagttttgccccctcctccaatgaggttgaaacaacaagcctcaatgatgttactttaagcttactcccttcaaacgaaacagaaaaaactaaaatcactatagtaaaaaccttcaatgcttcaggcgtcaaaccccagagaaatatctgcaatttgtcatctatttgcaatgactcagcattttttagaggtgagatcatgtttcaatatgataaagaaagcactgttccccagaatcaacatataacgaatggcaccttaactggagtcctgtctctaagtgaattaaaacgctcagagctcaacaaaaccctgcaaaccctaagtgagacttactttataatgtgtgctacagcagaggcccaaagcacattaaattgtacattcacaataaaactgaataatacaatgaatgcatgtgctgcaatagccgctttggaaagagtaaagattcgaccaatggaacactgctgctgttctgtcaggataccctgcccttcctccccagaagagttgggaaagcttcagtgtgacctgcaggatcccattgtctgtcttgctgaccatccacgtggcccaccattttcttccagccaatccatcccagtggtgcctcgggccactgtgctttcccaggtccccaaagctacctcttttgctgagcctccagattattcacctgtgacccacaatgttccctctccaataggggagattcaacccctttcaccccagccttcagctcccatagcttccagccctgccattgacatgcccccacagtctgaaacgatctcttcccctatgccccaaacccatgtctccggcaccccacctcctgtgaaagcctcattttcctctcccaccgtgtctgcccctgcgaatgtcaacactaccagcgcacctcctgtccagacagacatcgtcaacaccagcagtatttctgatcttgagaaccaagtgttgcagatggagaaggctctgtccttgggcagcctggagcctaacctcgcaggagaaatgatcaaccaagtcagcagactccttcattccccgcctgacatgctggcccctctggctcaaagattgctgaaagtagtggatgacattggcctacagctgaacttttcaaacacgactataagtctaacctccccttctttggctctggctgtgatcagagtgaatgccagtagtttcaacacaactacctttgtggcccaagaccctgcaaatcttcaggtttctctggaaacccaagctcctgagaacagtattggcacaattactcttccttcatcgctgatgaataatttaccagctcatgacatggagctagcttccagggttcagttcaatttttttgaaacacctgctttgtttcaggatccttccctggagaacctctctctgatcagctacgtcatatcatcgagtgttgcaaacctgaccgtcaggaacttgacaagaaacgtgacagtcacattaaagcacatcaacccgagccaggatgagttaacagtgagatgtgtattttgggacttgggcagaaatggtggcagaggaggctggtcagacaatggctgctctgtcaaagacaggagattgaatgaaaccatctgtacctgtagccatctaacaagcttcggcgttctgctggacctatctaggacatctgtgctgcctgctcaaatgatggctctgacgttcattacatatattggttgtgggctttcatcaatttttctgtcagtgactcttgtaacctacatagcttttgaaaagatccggagggattacccttccaaaatcctcatccagctgtgtgctgctctgcttctgctgaacctggtcttcctcctggactcgtggattgctctgtataagatgcaaggcctctgcatctcagtggctgtatttcttcattattttctcttggtctcattcacatggatgggcctagaagcattccatatgtacctggcccttgtcaaagtatttaatacttacatccgaaaatacatccttaaattctgcattgtcggttggggggtaccagctgtggttgtgaccatcatcctgactatatccccagataactatgggcttggatcctatgggaaattccccaatggttcaccggatgacttctgctggatcaacaacaatgcagtattctacattacggtggtgggatatttctgtgtgatatttttgctgaacgtcagcatgttcattgtggtcctggttcagctctgtcgaattaaaaagaagaagcaactgggagcccagcgaaaaaccagtattcaagacctcaggagtatcgctggccttacatttttactgggaataacttggggctttgccttctttgcctggggaccagttaacgtgaccttcatgtatctgtttgccatctttaataccttacaaggatttttcatattcatcttttactgtgtggccaaagaaaatgtcaggaagcaatggaggcggtatctttgttgtggaaagttacggctggctgaaaattctgactggagtaaaactgctactaatggtttaaagaagcagactgtaaaccaaggagtgtccagctcttcaaattccttacagtcaagcagtaactccactaactccaccacactgctagtgaataatgattgctcagtacacgcaagcgggaatggaaatgcttctacagagaggaatggggtctcttttagtgttcagaatggagatgtgtgccttcacgatttcactggaaaacagcacatgtttaacgagaaggaagattcctgcaatgggaaaggccgtatggctctcagaaggacttcaaagcggggaagcttacactttattgagcaaatgtga

SEQ ID NO: 874 - DNA, 1098 bp, Homo sapiens
atggggaacatcactgcagacaactcctcgatgagctgtaccatcgaccataccatccaccagacgctggccccggtggtctatgttaccgtgctggtggtgggcttcccggccaactgcctgtccctctacttcggctacctgcagatcaaggcccggaacgagctgggcgtgtacctgtgcaacctgacggtggccgacctcttctacatctgctcgctgcccttctggctgcagtacgtgctgcagcacgacaactggtctcacggcgacctgtcctgccaggtgtgcggcatcctcctgtacgagaacatctacatcagcgtgggcttcctctgctgcatctccgtggaccgctacctggctgtggcccatcccttccgcttccaccagttccggaccctgaaggcggccgtccgcgtcacggtggtcatctgggccaaggagctgctgaccagcatctacttcctgatgcacgaggaggtcatcgaggacgagaaccagcaccgcgtgtgctttgagcactaccccatccaggcatggcagcgcgccatcaactactaccgcttcctggtgggcttcctcttccccatctgcctgctgctggcgtcctaccagggcatcctgcgcgccgtgcgccggagccacggcacccagaagagccgcaaggaccagatccagcggctggtgctcagcaccgtggtcatcttcctggcctgcttcctgccctaccacgtgttgctgctggtgcgcagcgtctgggaggccagctgcgacttcgccaagggcgttttcaacgcctaccacttctccctcctgctcaccagcttcaactgcgtcgccgaccccgtgctctactgcttcgtcagcgagaccacccaccgggacctggcccgcctccgcggggcctgcctggccttcctcacctgctccaggaccggccgggccagggaggcctacccgctgggtgcccccgaggcctccgggaaaagcggggcccagggtgaggagcccgagctgttgaccaagctccacccggccttccagacccctaactcgccagggtcgggcgggttccccacgggcaggttggcctag

SEQ ID NO: 875 - DNA, 1011 bp, Homo sapiens
atgaacaacaatacaacatgtattcaaccatctatgatctcttccatggctttaccaatcatttacatcctcctttgtattgttggtgtttttggaaacactctctctcaatggatatttttaacaaaaataggtaaaaaaacatcaacgcacatctacctgtcacaccttgtgactgcaaacttacttgtgtgcagtgccatgcctttcatgagtatctatttcctgaaaggtttccaatgggaatatcaatctgctcaatgcagagtggtcaattttctgggaactctatccatgcatgcaagtatgtttgtcagtctcttaattttaagttggattgccataagccgctatgctaccttaatgcaaaaggattcctcgcaagagactacttcatgctatgagaaaatattttatggccatttactgaaaaaatttcgccagcccaactttgctagaaaactatgcatttacatatggggagttgtactgggcataatcattccagttaccgtatactactcagtcatagaggctacagaaggagaagagagcctatgctacaatcggcagatggaactaggagccatgatctctcagattgcaggtctcattggaaccacatttattggattttcctttttagtagtactaacatcatactactcttttgtaagccatctgagaaaaataagaacctgtacgtccattatggagaaagatttgacttacagttctgtgaaaagacatcttttggtcatccagattctactaatagtttgcttccttccttatagtatttttaaacccattttttatgttctacaccaaagagataactgtcagcaattgaattatttaatagaaacaaaaaacattctcacctgtcttgcttcggccagaagtagcacagaccccattatatttcttttattagacaaaacattcaagaagacactatataatctctttacaaagtctaattcagcacatatgcaatcatatggttga

SEQ ID NO: 876 - DNA, 1119 bp, Homo sapiens
atgttagccaacagctcctcaaccaacagttctgttctcccgtgtcctgactaccgacctacccaccgcctgcacttggtggtctacagcttggtgctggctgccgggctccccctcaacgcgctagccctctgggtcttcctgcgcgcgctgcgcgtgcactcggtggtgagcgtgtacatgtgtaacctggcggccagcgacctgctcttcaccctctcgctgcccgttcgtctctcctactacgcactgcaccactggcccttccccgacctcctgtgccagacgacgggcgccatcttccagatgaacatgtacggcagctgcatcttcctgatgctcatcaacgtggaccgctacgccgccatcgtgcacccgctgcgactgcgccacctgcggcggccccgcgtggcgcggctgctctgcctgggcgtgtgggcgctcatcctggtgtttgccgtgcccgccgcccgcgtgcacaggccctcgcgttgccgctaccgggacctcgaggtgcgcctatgcttcgagagcttcagcgacgagctgtggaaaggcaggctgctgcccctcgtgctgctggccgaggcgctgggcttcctgctgcccctggcggcggtggtctactcgtcgggccgagtcttctggacgctggcgcgccccgacgccacgcagagccagcggcggcggaagaccgtgcgcctcctgctggctaacctcgtcatcttcctgctgtgcttcgtgccctacaacagcacgctggcggtctacgggctgctgcggagcaagctggtggcggccagcgtgcctgcccgcgatcgcgtgcgcggggtgctgatggtgatggtgctgctggccggcgccaactgcgtgctggacccgctggtgtactactttagcgccgagggcttccgcaacaccctgcgcggcctgggcactccgcaccgggccaggacctcggccaccaacgggacgcgggcggcgctcgcgcaatccgaaaggtccgccgtcaccaccgacgccaccaggccggatgccgccagtcaggggctgctccgaccctccgactcccactctctgtcttccttcacacagtgtccccaggattccgccctctga

SEQ ID NO: 877 - DNA, 2619 bp, Homo sapiens
atgggatcgctgcttgcgctcctggcactgctgccgctgtggggtgctgtggctgagggcccagccaagaaggtgctgaccctggagggagacttggtgctgggtgggctgttcccagtgcaccagaagggcggcccagcagaggactgtggtcctgtcaatgagcaccgtggcatccagcgcctggaggccatgctttttgcactggaccgcatcaaccgtgacccgcacctgctgcctggcgtgcgcctgggtgcacacatcctcgacagttgctccaaggacacacatgcgctggagcaggcactggactttgtgcgtgcctcactcagccgtggtgctgatggatcacgccacatctgccccgacggctcttatgcgacccatggtgatgctcccactgccatcactggtgttattggcggttcctacagtgatgtctccatccaggtggccaacctcttgaggctatttcagatcccacagattagctacgcctctaccagtgccaagctgagtgacaagtcccgctatgactactttgcccgcacagtgcctcctgacttcttccaagccaaggccatggctgagattctccgcttcttcaactggacctatgtgtccactgaggcctctgagggcgactatggcgagacaggcattgaggcctttgagctagaggctcgtgcccgcaacatctgtgtggccacctcggagaaagtgggccgtgccatgagccgcgcggcctttgagggtgtggtgcgagccctgctgcagaagcccagtgcccgcgtggctgtcctgttcacccgttctgaggatgcccgggagctgcttgctgccagccagcgcctcaatgccagcttcacctgggtggccagtgatggttggggggccctggagagtgtggtggcaggcagtgagggggctgctgagggtgctatcaccatcgagctggcctcctaccccatcagtgactttgcctcctacttccagagcctggacccttggaacaacagccggaacccctggttccgtgaattctgggagcagaggttccgctgcagcttccggcagcgagactgcgcagcccactctctccgggctgtgccctttgaacaggagtccaagatcatgtttgtggtcaatgcagtgtacgccatggcccatgcgctccacaacatgcaccgtgccctctgccccaacaccacccggctctgtgacgcgatgcggccagttaacgggcgccgcctctacaaggactttgtgctcaacgtcaagtttgatgccccctttcgcccagctgacacccacaatgaggtccgctttgaccgctttggtgatggtattggccgctacaacatcttcacctatctgcgtgcaggcagtgggcgctatcgctaccagaaggtgggctactgggcagaaggcttgactctggacaccagcctcatcccatgggcctcaccgtcagccggccccctggccgcctctcgctgcagtgagccctgcctccagaatgaggtgaagagtgtgcagccgggcgaagtctgctgctggctctgcattccgtgccagccctatgagtaccgattggacgaattcacttgcgctgattgtggcctgggctactggcccaatgccagcctgactggctgcttcgaactgccccaggagtacatccgctggggcgatgcctgggctgtgggacctgtcaccatcgcctgcctcggtgccctggccaccctgtttgtgctgggtgtctttgtgcggcacaatgccacaccagtggtcaaggcctcaggtcgggagctctgctacatcctgctgggtggtgtcttcctctgctactgcatgaccttcatcttcattgccaagccatccacggcagtgtgtaccttacggcgtcttggtttgggcactgccttctctgtctgctactcagccctgctcaccaagaccaaccgcattgcacgcatcttcggtggggcccgggagggtgcccagcggccacgcttcatcagtcctgcctcacaggtggccatctgcctggcacttatctcgggccagctgctcatcgtggtcgcctggctggtggtggaggcaccgggcacaggcaaggagacagcccccgaacggcgggaggtggtgacactgcgctgcaaccaccgcgatgcaagtatgttgggctcgctggcctacaatgtgctcctcatcgcgctctgcacgctttatgccttcaatactcgcaagtgccccgaaaacttcaacgaggccaagttcattggcttcaccatgtacaccacctgcatcatctggctggcattgttgcccatcttctatgtcacctccagtgactaccgggtacagaccaccaccatgtgcgtgtcagtcagcctcagcggctccgtggtgcttggctgcctctttgcgcccaagctgcacatcatcctcttccagccgcagaagaacgtggttagccaccgggcacccaccagccgctttggcagtgctgctgccagggccagctccagccttggccaagggtctggctcccagtttgtccccactgtttgcaatggccgtgaggtggtggactcgacaacgtcatcgctttga

SEQ ID NO: 878 - DNA, 2739 bp, Homo sapiens
atgcctgggaagagaggcttgggctggtggtgggcccggctgcccctttgcctgctcctcagcctttacggcccctggatgccttcctccctgggaaagcccaaaggccaccctcacatgaattccatccgcatagatggggacatcacactgggaggcctgttcccggtgcatggccggggctcagagggcaagccctgtggagaacttaagaaggaaaagggcatccaccggctggaggccatgctgttcgccctggatcgcatcaacaacgacccggacctgctgcctaacatcacgctgggcgcccgcattctggacacctgctccagggacacccatgccctcgagcagtcgctgacctttgtgcaggcgctcatcgagaaggatggcacagaggtccgctgtggcagtggcggcccacccatcatcaccaagcctgaacgtgtggtgggtgtcatcggtgcttcagggagctcggtctccatcatggtggccaacatccttcgcctcttcaagataccccagatcagctacgcctccacagcgccagacctgagtgacaacagccgctacgacttcttctcccgcgtggtgccctcggacacgtaccaggcccaggccatggtggacatcgtccgtgccctcaagtggaactatgtgtccacagtggcctcggagggcagctatggtgagagcggtgtggaggccttcatccagaagtcccgtgaggacgggggcgtgtgcatcgcccagtcggtgaagataccacgggagcccaaggcaggcgagttcgacaagatcatccgccgcctcctggagacttcgaacgccagggcagtcatcatctttgccaacgaggatgacatcaggcgtgtgctggaggcagcacgaagggccaaccagacaggccatttcttctggatgggctctgacagctggggctccaagattgcacctgtgctgcacctggaggaggtggctgagggtgctgtcacgatcctccccaagaggatgtccgtacgaggcttcgaccgctacttctccagccgcacgctggacaacaaccggcgcaacatctggtttgccgagttctgggaggacaacttccactgcaagctgagccgccacgccctcaagaagggcagccacgtcaagaagtgcaccaaccgtgagcgaattgggcaggattcagcttatgagcaggaggggaaggtgcagtttgtgatcgatgccgtgtacgccatgggccacgcgctgcacgccatgcaccgtgacctgtgtcccggccgcgtggggctctgcccgcgcatggaccctgtagatggcacccagctgcttaagtacatccgaaacgtcaacttctcaggcatcgcagggaaccctgtgaccttcaatgagaatggagatgcgcctgggcgctatgacatctaccaataccagctgcgcaacgattctgccgagtacaaggtcattggctcctggactgaccacctgcaccttagaatagagcggatgcactggccggggagcgggcagcagctgccccgctccatctgcagcctgccctgccaaccgggtgagcggaagaagacagtgaagggcatgccttgctgctggcactgcgagccttgcacagggtaccagtaccaggtggaccgctacacctgtaagacgtgtccctatgacatgcggcccacagagaaccgcacgggctgccggcccatccccatcatcaagcttgagtggggctcgccctgggccgtgctgcccctcttcctggccgtggtgggcatcgctgccacgttgttcgtggtgatcacctttgtgcgctacaacgacacgcccatcgtcaaggcctcgggccgtgaactgagctacgtgctgctggcaggcatcttcctgtgctatgccaccaccttcctcatgatcgctgagcccgaccttggcacctgctcgctgcgccgaatcttcctgggactagggatgagcatcagctatgcagccctgctcaccaagaccaaccgcatctaccgcatcttcgagcagggcaagcgctcggtcagtgccccacgcttcatcagccccgcctcacagctggccatcaccttcagcctcatctcgctgcagctgctgggcatctgtgtgtggtttgtggtggacccctcccactcggtggtggacttccaggaccagcggacactcgacccccgcttcgccaggggtgtgctcaagtgtgacatctcggacctgtcgctcatctgcctgctgggctacagcatgctgctcatggtcacgtgcaccgtgtatgccatcaagacacgcggcgtgcccgagaccttcaatgaggccaagcccattggcttcaccatgtacaccacttgcatcgtctggctggccttcatccccatcttctttggcacctcgcagtcggccgacaagctgtacatccagacgacgacgctgacggtctcggtgagtctgagcgcctcggtgtccctgggaatgctctacatgcccaaagtctacatcatcctcttccacccggagcagaacgtgcccaagcgcaagcgcagcctcaaagccgtcgttacggcggccaccatgtccaacaagttcacgcagaagggcaacttccggcccaacggagaggccaagtctgagctctgcgagaaccttgaggccccagcgctggccaccaaacagacttacgtcacttacaccaaccatgcaatctag

SEQ ID NO: 879 - DNA, 4518 bp, Homo sapiens
acaaaatggtcctttagaaaatacatctgaattgctggctaatttcttgatttgcgactcaacgtaggacatcgcttgttcgtagctatcagaaccctcctgaattttccccaccatgctatctttattggcttgaactcctttcctaaaatggtccttctgttgatcctgtcagtcttacttttgaaagaagatgtccgtgggagtgcacagtccagtgagaggagggtggtggctcacatgccgggtgacatcattattggagctctcttttctgttcatcaccagcctactgtggacaaagttcatgagaggaagtgtggggcggtccgtgaacagtatggcattcagagagtggaggccatgctgcataccctggaaaggatcaattcagaccccacactcttgcccaacatcacactgggctgtgagataagggactcctgctggcattcggctgtggccctagagcagagcattgagttcataagagattccctcatttcttcagaagaggaagaaggcttggtacgctgtgtggatggctcctcctcttccttccgctccaagaagcccatagtaggggtcattgggcctggctccagttctgtagccattcaggtccagaatttgctccagcttttcaacatacctcagattgcttactcagcaaccagcatggatctgagtgacaagactctgttcaaatatttcatgagggttgtgccttcagatgctcagcaggcaagggccatggtggacatagtgaagaggtacaactggacctatgtatcagccgtgcacacagaaggcaactatggagaaagtgggatggaagccttcaaagatatgtcagcgaaggaagggatttgcatcgcccactcttacaaaatctacagtaatgcaggggagcagagctttgataagctgctgaagaagctcacaagtcacttgcccaaggcccgggtggtggcctgcttctgtgagggcatgacggtgagaggtctgctgatggccatgaggcgcctgggtctagcgggagaatttctgcttctgggcagtgatggctgggctgacaggtatgatgtgacagatggatatcagcgagaagctgttggtggcatcacaatcaagctccaatctcccgatgtcaagtggtttgatgattattatctgaagctccggccagaaacaaaccaccgaaacccttggtttcaagaattttggcagcatcgttttcagtgccgactggaagggtttccacaggagaacagcaaatacaacaagacttgcaatagttctctgactctgaaaacacatcatgttcaggattccaaaatgggatttgtgatcaacgccatctattcgatggcctatgggctccacaacatgcagatgtccctctgcccaggctatgcaggactctgtgatgccatgaagccaattgatggacggaaacttttggagtccctgatgaaaaccaattttactggggtttctggagatacgatcctattcgatgagaatggagactctccaggaaggtatgaaataatgaatttcaaggaaatgggaaaagattactttgattatatcaacgttggaagttgggacaatggagaattaaaaatggatgatgatgaagtatggtccaagaaaagcaacatcatcagatctgtgtgcagtgaaccatgtgagaaaggccagatcaaggtgatccgaaagggagaagtcagctgttgttggacctgtacaccttgtaaggagaatgagtatgtctttgatgagtacacatgcaaggcatgccaactggggtcttggcccactgatgatctcacaggttgtgacttgatcccagtacagtatcttcgatggggtgaccctgaacccattgcagctgtggtgtttgcctgccttggcctcctggccaccctgtttgttactgtagtcttcatcatttaccgtgatacaccagtagtcaagtcctcaagcagggaactctgctacattatccttgctggcatctgcctgggctacttatgtaccttctgcctcattgcgaagcccaaacagatttactgctaccttcagagaattggcattggtctctccccagccatgagctactcagcccttgtaacaaagaccaaccgtattgcaaggatcctggctggcagcaagaagaagatctgtaccaaaaagcccagattcatgagtgcctgtgcccagctagtgattgctttcattctcatatgcatccagttgggcatcatcgttgccctctttataatggagcctcctgacataatgcatgactacccaagcattcgagaagtctacctgatctgtaacaccaccaacctaggagttgtcactccacttggatacaatggattgttgattttgagctgcaccttctatgcgttcaagaccagaaatgttccagctaacttcaacgaggccaagtatatcgccttcacaatgtacacgacctgcattatatggctagcttttgtgccaatctactttggcagcaactacaaaatcatcaccatgtgtttctcggtcagcctcagtgccacagtggccctaggctgcatgtttgtgccgaaggtgtacatcatcctggccaaaccagagagaaacgtgcgcagcgccttcaccacatctaccgtggtgcgcatgcatgtaggggatggcaagtcatcctccgcagccagcagatccagcagcctagtcaacctgtggaagagaaggggctcctctggggaaaccttaagttccaatggaaaatccgtcacgtgggcccagaatgagaagagcagccgggggcagcacctgtggcagcgcctgtccatccacatcaacaagaaagaaaaccccaaccaaacggccgtcatcaagcccttccccaagagcacggagagccgtggcctgggcgctggcgctggcgcaggcgggagcgctgggggcgtgggggccacgggcggtgcgggctgcgcaggcgccggcccaggcgggcccgagtccccagacgccggccccaaggcgctgtatgatgtggccgaggctgaggagcacttcccggcgcccgcgcggccgcgctcaccgtcgcccatcagcacgctgagccaccgcgcgggctcggccagccgcacggacgacgatgtgccgtcgctgcactcggagcctgtggcgcgcagcagctcctcgcagggctccctcatggagcagatcagcagtgtggtcacccgcttcacggccaacatcagcgagctcaactccatgatgctgtccaccgcggcccccagccccggcgtcggcgccccgctctgctcgtcctacctgatccccaaagagatccagttgcccacgaccatgacgacctttgccgaaatccagcctctgccggccatcgaagtcacgggcggcgcgcagcccgcggcaggggcgcaggcggctggggacgcggcccgggagagccccgcggccggtcccgaggctgcggccgccaagccagacctggaggagctggtggctctcaccccgccgtcccccttcagagactcggtggactcggggagcacaacccccaactcgccagtgtccgagtcggccctctgtatcccgtcgtctcccaaatatgacactcttatcataagagattacactcagagctcctcgtcgttgtgaatgtccctggaaagcacgccggcctgcgcgtgcggagcggagccccccgtgttcacacacacacaatggcaagcatagtcgcctggttacggcccagggggaatatgccaagggaccccttaatggaaacacagatcagtagtgctatctcatgacaaccacaagaaaccgacgacaaatcttttgcgagattttcttctagtggcttagaaacatggcttttaagaaacacggtgatatctttgagggtgacaaggcgtctcttcaaacagttccataccaactgctttgctctagggaagcagtgcgtgtgaaacagcgtaacggagggtgaagagcatagttaataagcaactgtaaaaagttttatttgtttactttaattcttttcccctgtaaaaagttttatttgtttactttaattcttttcccagaaaagagtctttgattcaccaaacatgaatgtacattttctaacaaactcaaaatctgggaccaaaacatcaacttttttctttcttttttctttctttttgttttttctttcctgtaaagaccttgaaaagaccttgaaaagcagtaacttgggtccagtatttacggaggcgttgtgaatgtgtcccatgcataacacactactggatagtgagtcgtgcgctaatgtactacgtagggcttctaccagagattttcctctccaattgggttgtgaaatactcttccaaaagcctgcatcggggattccacctacttatttcagattcacctccattaaccaagaaaaccagtggaagatttcttgactatttcaccatgttgccaatc

SEQ ID NO: 880 - DNA, 2634 bp, Homo sapiens
atggcgcggccccggagagcccgggagccgctgctcgtggcgctgctgccgctggcgtggctggcgcaggcgggcctggcgcgcgcggcgggctctgtgcgcctggcgggcggcctgacgctgggcggcctgttcccggtgcacgcgcggggcgcggcgggccgggcgtgcgggccgctgaagaaggagcagggcgtgcaccggctggaggccatgctgtacgcgctggaccgcgtcaacgccgaccccgagctgctgcccggcgtgcgcctgggcgcgcggctgctggacacctgctcgcgggacacctacgcgctggagcaggcgctgagcttcgtgcaggcgctgatccgcggccgcggcgacggcgacgaggtgggcgtgcgctgcccgggaggcgtccctccgctgcgccccgcgccccccgagcgcgtcgtggccgtcgtgggcgcctcggccagctccgtctccatcatggtcgccaacgtgctgcgcctgtttgcgataccccagatcagctatgcctccacagccccggagctcagcgactccacacgctatgacttcttctcccgggtggtgccacccgactcctaccaggcgcaggccatggtggacatcgtgagggcactgggatggaactatgtgtccacgctggcctccgagggcaactatggcgaaagtggggttgaggccttcgttcagatctcccgagaggctgggggggtctgtattgcccagtctatcaagattcccagggaaccaaagccaggagagttcagcaaggtgatcaggagactcatggagacgcccaacgcccggggcatcatcatctttgccaatgaggatgacatcaggcgggtcctggaggcagctcgccaggccaacctgaccggccacttcctgtgggtcggctcagacagctggggagccaagacctcacccatcttgagcctggaggacgtggccgttggggccatcaccatcctgcccaaaagggcctccatcgacggatttgaccagtacttcatgactcgatccctggagaacaaccgcaggaacatctggttcgccgagttctgggaagagaattttaactgcaaactgaccagctcaggtacccagtcagatgattccacccgcaaatgcacaggcgaggaacgcatcggccgggactccacctacgagcaggagggcaaggtgcagtttgtgattgatgcggtgtatgccattgcccacgccctccacagcatgcaccaggcgctctgccctgggcacacaggcctgtgcccggcgatggaacccaccgatgggcggatgcttctgcagtacattcgagctgtccgcttcaacggcagcgcaggaacccctgtgatgttcaacgagaacggggatgcgcccgggcggtacgacatcttccagtaccaggcgaccaatggcagtgccagcagtggcgggtaccaggcagtgggccagtgggcagagaccctcagactggatgtggaggccctgcagtggtctggcgacccccacgaggtgccctcgtctctgtgcagcctgccctgcgggccgggggagcggaagaagatggtgaagggcgtcccctgctgttggcactgcgaggcctgtgacgggtaccgcttccaggtggacgagttcacatgcgaggcctgtcctggggacatgaggcccacgcccaaccacacgggctgccgccccacacctgtggtgcgcctgagctggtcctccccctgggcagccccgccgctcctcctggccgtgctgggcatcgtggccactaccacggtggtggccaccttcgtgcggtacaacaacacgcccatcgtccgggcctcgggccgagagctcagctacgtcctcctcaccggcatcttcctcatctacgccatcaccttcctcatggtggctgagcctggggccgcggtctgtgccgcccgcaggctcttcctgggcctgggcacgaccctcagctactctgccctgctcaccaagaccaaccgtatctaccgcatctttgagcagggcaagcgctcggtcacaccccctcccttcatcagccccacctcacagctggtcatcaccttcagcctcacctccctgcaggtggtggggatgatagcatggctgggggcccggcccccacacagcgtgattgactatgaggaacagcggacagtggaccccgagcaggccagaggggtgctcaagtgcgacatgtcggatctgtctctcatcggctgcctgggctacagcctcctgctcatggtcacgtgcacagtgtacgccatcaaggcccgtggcgtgcccgagaccttcaacgaggccaagcccatcggcttcaccatgtacaccacctgcatcatctggctggcattcgtgcccatcttctttggcactgcccagtcagctgaaaagatctacatccagacaaccacgctaaccgtgtccttgagcctgagtgcctcggtgtccctcggcatgctctacgtacccaaaacctacgtcatcctcttccatccagagcagaatgtgcagaagcgaaagcggagcctcaaggccacctccacggtggcagccccacccaagggcgaggatgcagaggcccacaagtag

SEQ ID NO: 881 - DNA, 2748 bp, Homo sapiens
atggtccagctgaggaagctgctccgcgtcctgactttgatgaagttcccctgctgcgtgctggaggtgctcctgtgcgcgctggcggcggcggcgcgcggccaggagatgtacgccccgcactcaatccggatcgagggggacgtcaccctcggggggctgttccccgtgcacgccaagggtcccagcggagtgccctgcggcgacatcaagagggaaaacgggatccacaggctggaagcgatgctctacgccctggaccagatcaacagtgatcccaacctactgcccaacgtgacgctgggcgcgcggatcctggacacttgttccagggacacttacgcgctcgaacagtcgcttactttcgtccaggcgctcatccagaaggacacctccgacgtgcgctgcaccaacggcgaaccgccggttttcgtcaagccggagaaagtagttggagtgattggggcttcggggagttcggtctccatcatggtagccaacatcctgaggctcttccagatcccccagattagttatgcatcaacggcacccgagctaagtgatgaccggcgctatgacttcttctctcgcgtggtgccacccgattccttccaagcccaggccatggtagacattgtaaaggccctaggctggaattatgtgtctaccctcgcatcggaaggaagttatggagagaaaggtgtggagtccttcacgcagatttccaaagaggcaggtggactctgcattgcccagtccgtgagaatcccccaggaacgcaaagacaggaccattgactttgatagaattatcaaacagctcctggacacccccaactccagggccgtcgtgatttttgccaacgatgaggatataaagcagatccttgcagcagccaaaagagctgaccaagttggccattttctttgggtgggatcagacagctggggatccaaaataaacccactgcaccagcatgaagatatcgcagaaggggccatcaccattcagcccaagcgagccacggtggaagggtttgatgcctactttacgtcccgtacacttgaaaacaacagaagaaatgtatggtttgccgaatactgggaggaaaacttcaactgcaagttgacgattagtgggtcaaaaaaagaagacacagatcgcaaatgcacaggacaggagagaattggaaaagattccaactatgagcaggagggtaaagtccagttcgtgattgacgcagtctatgctatggctcacgcccttcaccacatgaacaaggatctctgtgctgactaccggggtgtctgcccagagatggagcaagctggaggcaagaagttgctgaagtatatacgcaatgttaatttcaatggtagtgctggcactccagtgatgtttaacaagaacggggatgcacctgggcgttatgacatctttcagtaccagaccacaaacaccagcaacccgggttaccgtctgatcgggcagtggacagacgaacttcagctcaatatagaagacatgcagtggggtaaaggagtccgagagatacccgcctcagtgtgcacactaccatgtaagccaggacagagaaagaagacacagaaaggaactccttgctgttggacctgtgagccttgcgatggttaccagtaccagtttgatgagatgacatgccagcattgcccctatgaccagaggcccaatgaaaatcgaaccggatgccaggatattcccatcatcaaactggagtggcactccccctgggctgtgattcctgtcttcctggcaatgttggggatcattgccaccatctttgtcatggccactttcatccgctacaatgacacgcccattgtccgggcatctgggcgggaactcagctatgttcttttgacgggcatctttctttgctacatcatcactttcctgatgattgccaaaccagatgtggcagtgtgttctttccggcgagttttcttgggcttgggtatgtgcatcagttatgcagccctcttgacgaaaacaaatcggatttatcgcatatttgagcagggcaagaaatcagtaacagctcccagactcataagcccaacatcacaactggcaatcacttccagtttaatatcagttcagcttctaggggtgttcatttggtttggtgttgatccacccaacatcatcatagactacgatgaacacaagacaatgaaccctgagcaagccagaggggttctcaagtgtgacattacagatctccaaatcatttgctccttgggatatagcattcttctcatggtcacatgtactgtgtatgccatcaagactcggggtgtacccgagaattttaacgaagccaagcccattggattcactatgtacacgacatgtatagtatggcttgccttcattccaattttttttggcaccgctcaatcagcggaaaagctctacatacaaactaccacgcttacaatctccatgaacctaagtgcatcagtggcgctggggatgctatacatgccgaaagtgtacatcatcattttccaccctgaactcaatgtccagaaacggaagcgaagcttcaaggcggtagtcacagcagccaccatgtcatcgaggctgtcacacaaacccagtgacagacccaacggtgaggcaaagaccgagctctgtgaaaacgtagacccaaacagccctgctgcaaaaaagaagtatgtcagttataataacctggttatctaa

SEQ ID NO: 882 - DNA, 1278 bp, Homo sapiens
atggagccctcagccaccccaggggcccagatgggggtcccccctggcagcagagagccgtcccctgtgcctccagactatgaagatgagtttctccgctatctgtggcgtgattatctgtacccaaaacagtatgagtgggtcctcatcgcagcctatgtggctgtgttcgtcgtggccctggtgggcaacacgctggtctgcctggccgtgtggcggaaccaccacatgaggacagtcaccaactacttcattgtcaacctgtccctggctgacgttctggtgactgctatctgcctgccggccagcctgctggtggacatcactgagtcctggctgttcggccatgccctctgcaaggtcatcccctatctacaggctgtgtccgtgtcagtggcagtgctaactctcagcttcatcgccctggaccgctggtatgccatctgccacccactattgttcaagagcacagcccggcgggcccgtggctccatcctgggcatctgggctgtgtcgctggccatcatggtgccccaggctgcagtcatggaatgcagcagtgtgctgcctgagctagccaaccgcacacggctcttctcagtctgtgatgaacgctgggcagatgacctctatcccaagatctaccacagttgcttctttattgtcacctacctggccccactgggcctcatggccatggcctatttccagatattccgcaagctctggggccgccagatccccggcaccacctcagcactggtgcggaactggaagcgcccctcagaccagctgggggacctggagcagggcctgagtggagagccccagccccggggccgcgccttcctggctgaagtgaagcagatgcgtgcacggaggaagacagccaagatgctgatggtggtgctgctggtcttcgccctctgctacctgcccatcagcgtcctcaatgtccttaagagggtgttcgggatgttccgccaagccagtgaccgcgaagctgtctacgcctgcttcaccttctcccactggctggtgtacgccaacagcgctgccaaccccatcatctacaacttcctcagtggcaaattccgggagcagtttaaggctgccttctcctgctgcctgcctggcctgggtccctgcggctctctgaaggcccctagtccccgctcctctgccagccacaagtccttgtccttgcagagccgatgctccatctccaaaatctctgagcatgtggtgctcaccagcgtcaccacagtgctgccctga

SEQ ID NO: 883 - DNA, 1335 bp, Homo sapiens
atgtccggcaccaaattggaggactcccccccttgtcgcaactggtcatctgcttcggagctgaatgaaactcaagagccctttttaaaccccaccgactatgacgacgaggaattcctgcggtacctgtggagggaatacctgcacccgaaagaatatgagtgggtcctgatcgccgggtacatcatcgtgttcgtcgtggctctcattgggaacgtcctggtttgtgtggcagtgtggaagaaccaccacatgaggacggtaaccaactacttcatagtcaatctttctctggctgatgtgctcgtgaccatcacctgccttccagccacactggtcgtggatatcactgagacctggttttttggacagtccctttgcaaagtgattccttatctacagaccgtgtcggtgtctgtgtctgtcctcacactgagctgtatcgccttggatcggtggtatgcaatctgtcaccctttgatgtttaagagcacagcaaagcgggcccgtaacagcattgtcatcatctggattgtctcctgcattataatgattcctcaggccatcgtcatggagtgcagcaccgtgttcccaggcttagccaataaaaccaccctctttacggtgtgtgatgagcgctggggtggtgaaatttatcccaagatgtaccacatctgtttctttctggtgacatacatggcaccactgtgtctcatggtgttggcttatctgcaaatatttcgcaaactctggtgtcgacagatccctggaacatcatctgtagttcagagaaaatggaagcccctgcagcctgtttcacagcctcgagggccaggacagccaacgaagtcccggatgagcgctgtggcggctgaaataaagcagatccgagccagaaggaaaacagcccggatgttgatggttgtgcttttggtatttgcaatttgctatctaccaattagcatcctcaatgtgctaaagagagtatttgggatgtttgcccatactgaagacagagagactgtgtatgcctggtttaccttttcacactggcttgtatatgccaatagtgctgcgaatccaattatttataattttctcagtggaaaatttcgagaggaatttaaagctgcgttttcttgctgttgccttggagttcaccatcgccaggaggatcggctcaccaggggacgaactagcacagagagccggaagtccttgaccactcaaatcagcaactttgataacatatcaaaactttctgagcaagttgtgctcactagcataagcacactcccagcagccaatggagcaggaccacttcaaaactggtag

SEQ ID NO: 884 - DNA, 4041 bp, Homo sapiens
atgaaatccccaaggagaaccactttgtgcctcatgtttattgtgatttattcttccaaagctgcactgaactggaattacgagtctactattcatcctttgagtcttcatgaacatgaaccagctggtgaagaggcactgaggcaaaaacgagccgttgccacaaaaagtcctacggctgaagaatacactgttaatattgagatcagttttgaaaatgcatccttcctggatcctatcaaagcctacttgaacagcctcagttttccaattcatgggaataacactgaccaaattaccgacattttgagcataaatgtgacaacagtctgcagacctgctggaaatgaaatctggtgctcctgcgagacaggttatgggtggcctcgggaaaggtgtcttcacaatctcatttgtcaagagcgtgacgtcttcctcccagggcaccattgcagttgccttaaagaactgcctcccaatggacctttttgcctgcttcaggaagatgttaccctgaacatgagagtcagactaaatgtaggctttcaagaagacctcatgaacacttcctccgccctctataggtcctacaagaccgacttggaaacagcgttccggaagggttacggaattttaccaggcttcaagggcgtgactgtgacagggttcaagtctggaagtgtggttgtgacatatgaagtcaagactacaccaccatcacttgagttaatacataaagccaatgaacaagttgtacagagcctcaatcagacctacaaaatggactacaactcctttcaagcagttactatcaatgaaagcaatttctttgtcacaccagaaatcatctttgaaggggacacagtcagtctggtgtgtgaaaaggaagttttgtcctccaatgtgtcttggcgctatgaagaacagcagttggaaatccagaacagcagcagattctcgatttacaccgcacttttcaacaacatgacttcggtgtccaagctcaccatccacaacatcactccaggtgatgcaggtgaatatgtttgcaaactgatattagacatttttgaatatgagtgcaagaagaaaatagatgttatgcccatccaaattttggcaaatgaagaaatgaaggtgatgtgcgacaacaatcctgtatctttgaactgctgcagtcagggtaatgttaattggagcaaagtagaatggaagcaggaaggaaaaataaatattccaggaacccctgagacagacatagattctagctgcagcagatacaccctcaaggctgatggaacccagtgcccaagcgggtcgtctggaacaacagtcatctacacttgtgagttcatcagtgcctatggagccagaggcagtgcaaacataaaagtgacattcatctctgtggccaatctaacaataaccccggacccaatttctgtttctgagggacaaaacttttctataaaatgcatcagtgatgtgagtaactatgatgaggtttattggaacacttctgctggaattaaaatataccaaagattttataccacgaggaggtatcttgatggagcagaatcagtactgacagtcaagacctcgaccagggagtggaatggaacctatcactgcatatttagatataagaattcatacagtattgcaaccaaagacgtcattgttcacccgctgcctctaaagctgaacatcatggttgatcctttggaagctactgtttcatgcagtggttcccatcacatcaagtgctgcatagaggaggatggagactacaaagttactttccatacgggttcctcatcccttcctgctgcaaaagaagttaacaaaaaacaagtgtgctacaaacacaatttcaatgcaagctcagtttcctggtgttcaaaaactgttgatgtgtgttgtcactttaccaatgctgctaataattcagtctggagcccatctatgaagctgaatctggttcctggggaaaacatcacatgccaggatcccgtaataggtgtcggagagccggggaaagtcatccagaagctatgccggttctcaaacgttcccagcagccctgagagtcccattggcgggaccatcacttacaaatgtgtaggctcccagtgggaggagaagagaaatgactgcatctctgccccaataaacagtctgctccagatggctaaggctttgatcaagagcccctctcaggatgagatgctccctacatacctgaaggatctttctattagcatagacaaagcggaacatgaaatcagctcttctcctgggagtctgggagccattattaacatccttgatctgctctcaacagttccaacccaagtaaattcagaaatgatgacgcacgtgctctctacggttaatgtcatccttggcaagcccgtcttgaacacctggaaggttttacaacagcaatggaccaatcagagttcacagctactacattcagtggaaagattttcccaagcattacagtcgggagatagccctcctttgtccttctcccaaactaatgtgcagatgagcagcatggtaatcaagtccagccacccagaaacctatcaacagaggtttgttttcccatactttgacctctggggcaatgtggtcattgacaagagctatctagaaaacttgcagtcggattcgtctattgtcaccatggctttcccaactctccaagccatccttgcccaggatatccaggaaaataactttgcagagagcttagtgatgacaaccactgtcagccacaatacaactatgccattcaggatttcaatgacttttaagaacaatagcccttcaggcggcgaaacgaagtgtgtcttctggaacttcaggcttgccaacaacacaggggggtgggacagcagtgggtgctatgtagaagaaggtgatggggacaatgtcacctgtatctgtgaccacctaacatcattctccatcctcatgtcccctgactccccagatcctagttctctcctgggaatactcctggatattatttcttatgttggggtgggcttttccatcttgagcttggcagcctgtctagttgtggaagctgtggtgtggaaatcggtgaccaagaaccggacttcttatatgcgccacacctgcatagtgaatatcgctgcctcccttctggtcgccaacacctggttcattgtggtcgctgccatccaggacaatcgctacatactctgcaagacagcctgtgtggctgccaccttcttcatccacttcttctacctcagcgtcttcttctggatgctgacactgggcctcatgctgttctatcgcctggttttcattctgcatgaaacaagcaggtccactcagaaagccattgccttctgtcttggctatggctgcccacttgccatctcggtcatcacgctgggagccacccagccccgggaagtctatacgaggaagaatgtctgttggctcaactgggaggacaccaaggccctgctggctttcgccatcccagcactgatcattgtggtggtgaacataaccatcactattgtggtcatcaccaagatcctgaggccttccattggagacaagccatgcaagcaggagaagagcagcctgtttcagatcagcaagagcattggggtcctcacaccactcttgggcctcacttggggttttggtctcaccactgtgttcccagggaccaaccttgtgttccatatcatatttgccatcctcaatgtcttccagggattattcattttactctttggatgcctctgggatctgaaggtacaggaagctttgctgaataagttttcattgtcgagatggtcttcacagcactcaaagtcaacatccctgggttcatccacacctgtgttttctatgagttctccaatatcaaggagatttaacaatttgtttggtaaaacaggaacgtataatgtttccaccccagaagcaaccagctcatccctggaaaactcatccagtgcttcttcgttgctcaactaa

SEQ ID NO: 885 - DNA, 4212 bp, Homo sapiens
atggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagacgttcccttccccaaccagtatcagtatattgctgcagtggattacaatccaagagataaccaactttacgtgtggaacaataacttcattttacgatattctctggagtttggtccacctgatcctgcccaagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaaggcaattgttgacacagtggacaaccttctgagacctgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaagtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaa

SEQ ID NO: 886 - DNA, 4410 bp, Homo sapiens
atggcccgcctagccgcagtgctctggaatctgtgtgtcaccgccgtcctggtcacctcggccacccaaggcctgagccgggccgggctcccgttcgggctgatgcgccgggagctggcgtgtgaaggctaccccatcgagctgcggtgccccggcagcgacgtcatcatggtggagaatgccaactacgggcgcacggacgacaagatttgcgatgctgaccctttccagatggagaatgtgcagtgctacctgccggacgccttcaagatcatgtcacagaggtgtaacaaccgcacccagtgcgtggtggtcgccggctcggatgcctttcctgacccctgtcctgggacctacaagtacctggaggtgcagtacgactgtgtcccctacatcttcgtgtgcccagggaccctgcagaaggtgctggagcccacctcgacacacgagtcagagcaccagtctggcgcatggtgcaaggacccgctgcaggcgggtgaccgcatctacgtgatgccctggatcccctaccgcacggacacactgactgagtatgcctcgtgggaggactacgtggccgcccgccacaccaccacctaccgcctgcccaaccgcgtggatggcacaggctttgtggtctacgatggtgccgtcttctacaacaaggagcgcacgcgcaacatcgtcaagtatgacctacggacgcgcatcaagagcggggagacggtcatcaataccgccaactaccatgacacctcgccctaccgctggggcggaaagaccgacattgacctggcggtggacgagaacgggctgtgggtcatctacgccactgagggcaacaacgggcggctggtggtgagccagctgaacccctacacactgcgctttgagggcacgtgggagacgggttacgacaagcgctcggcatccaacgccttcatggtgtgtggggtcctgtacgtcctgcgttccgtgtacgtggatgatgacagcgaggcggctggcaaccgcgtggactatgccttcaacaccaatgccaaccgcgaggagcctgtcagcctcaccttccccaacccctaccagttcatctcctccgttgactacaaccctcgcgacaaccagctgtacgtctggaacaactatttcgtggtgcgctacagcctggagttcgggccgcccgaccccagtgctggcccagccacttccccacccctcagcacgaccaccacagccaggcccacgcccctcaccagcacagcctcgcccgcagccaccaccccgctccgccgggcacccctcaccacgcacccagtgggtgccatcaaccagctgggacctgatctgcctccagccacagccccagtccccagcacccggcggcccccagccccgaatctacacgtgtcccctgagctcttctgcgagccccgagaggtacggcgggtccagtggccggccacccagcagggcatgctggtggagaggccctgccccaaggggactcgaggaattgcctccttccagtgtctaccagccttggggctctggaacccccggggccctgacctcagcaactgcacctccccctgggtcaaccaggtggcccagaagatcaagagtggggagaacgcggccaacatcgccagcgagctggcccgacacacccggggctccatctacgcgggggacgtctcctcctctgtgaagctgatggagcagctgctggacatcctggatgcccagctgcaggccctgcggcccatcgagcgcgagtcagccggcaagaactacaacaagatgcacaagcgagagagaacttgtaaggattatatcaaggccgtggtggagacagtggacaatctgctccggccagaagctctggagtcctggaaggacatgaatgccacggagcaggtgcacacggccaccatgctcctcgacgtcctggaggagggcgccttcctgctggccgacaatgtcagggagcctgcccgcttcctggctgccaaggagaacgtggtcctggaggtcacagtcctgaacacagagggccaggtgcaggagctggtgttcccccaggaggagtacccgagaaagaactccatccagctgtctgccaaaaccatcaagcagaacagccgcaatggggtggtcaaagttgtcttcatcctctacaacaacctgggcctcttcctgtccacggagaatgccacagtgaagctggccggcgaagcaggcccgggtggccctgggggcgcctctctagtggtgaactcacaggtcatcgcagcatccatcaacaaggagtccagccgcgtcttcctcatggaccctgtcatcttcaccgtggcccacctggaggacaagaaccacttcaatgctaactgctccttctggaactactcggagcgttccatgctgggctactggtcgacccaaggctgccgcctggtggagtccaacaagacccataccacgtgtgcctgcagccacctcaccaacttcgctgtgctcatggctcaccgtgagatctaccagggccgcatcaacgagctgctgctgtcggtcatcacctgggtgggcattgtgatctccctggtctgcttggccatctgcatctccaccttctgcttcctgcgggggctgcagaccgaccgcaacaccatccacaagaacctgtgcatcaacctcttcctggctgagctgctcttcctggtcgggatcgacaagactcagtatgagattgcctgccccatcttcgccggcctgctgcactatttcttcctggctgccttctcctggctgtgcctggagggcgtgcacctctacctgctactagtggaggtgtttgagagcgagtattcccgcaccaagtactactacctgggtggctactgcttcccggccctggtggtgggcatcgcggctgccattgactaccgcagctacggcaccgagaaggcctgctggctccgagtggacaattacttcatctggagtttcatcgggccagtctccttcgttatcgtggtcaacctggtgttcctcatggtgaccctgcacaagatgatccgaagctcatctgtgctcaagcccgactccagccgcctggacaacattaaatcctgggcgctgggggccatcgcgctgctgttcctgctgggcctcacctgggctttcggcctcctcttcatcaacaaggagtcggtggtcatggcctatctcttcaccaccttcaacgccttccagggggtcttcatcttcgtctttcactgcgccttacagaagaaggtgcacaaggagtacagcaagtgcctgcgtcactcctactgctgcatccgctccccacccgggggcactcacggatccctcaagacctcagccatgcgaagcaacacccgctactacacagggacccagagccgaattcggaggatgtggaatgacactgtgaggaaacagacggagtcctccttcatggcgggtgacatcaacagcacccccaccctgaaccgaggtaccatggggaaccacctgctgaccaaccccgtgctgcagccccgtgggggcaccagtccctacaacaccctcatcgccgagtcagtgggcttcaatccctcctcgccccctgtcttcaactccccagggagctaccgggaacccaagcaccccttgggaggccgggaagcctgtggcatggacaccctgcccctgaacggcaacttcaataacagttactccttgcgaagtggggatttccctcccggggatgggggccctgagccgccccgaggccggaacctagccgatgcggcggcctttgagaagatgatcatctcagagctggtgcacaacaacctgcgggggagcagcagcgcggccaagggccctccaccgcctgagccccctgtgccacctgtgccagggggcgggggcgaggaagaggcgggcgggcccgggggtgctgaccgggccgagattgaacttctctataaggccctggaggagcctctgctgctgccccgggcccagtcggtgctgtaccagagcgatctggacgagtcggagagctgcacggccgaggacggcgccaccagccggcccctctcctcccctcctggccgggactccctctatgccagcggggccaacctgcgggactcaccctcctacccggacagcagccctgaggggcccagtgaggccctgcccccaccccctcccgcaccccccggcccccccgaaatctactacacctcgcgcccgccagccctggtggcccggaatcccctgcagggctactaccaggtgcggcgtcctagccacgagggctacctggcagccccaggccttgaggggccagggcccgatggggacgggcagatgcagctggtcaccagtctctga

SEQ ID NO: 887 - DNA, 3723 bp, Homo sapiens
atgtggccatcgcagctactaattttcatgatgctcttagctccaataattcatgctttcagccgtgccccaattccaatggctgtggtccgcagagagctatcctgtgagagctatcctatagagcttcgctgtccaggaacagacgtcatcatgatagaaagtgccaactatggcaggactgatgacaaaatttgtgactctgaccctgctcagatggagaatatccgatgttatctgccagatgcctataagattatgtctcaaagatgcaataacagaacccagtgtgcagtggtggcaggtcctgatgtttttccagacccgtgtccaggaacctataaataccttgaagtgcagtatgaatgtgtcccttacaaagtggaacaaaaagtttttctttgtcctggactactaaaaggagtataccagagtgaacatttgtttgagtccgaccaccaatctggggcgtggtgcaaagaccctctgcaggcatctgacaagatttattatatgccctggactccctacagaactgataccctgactgagtattcatccaaggatgacttcattgctggaagaccaactacaacctacaagctccctcatagggtggatggcacaggatttgtagtgtatgatggagctttgttcttcaacaaagagcgcaccaggaacatagtaaagtttgatttgcggactaggataaagagtggagaggctatcatagcaaatgccaattaccatgatacctccccttaccgatggggaggcaaatctgacatagacctggcagtagatgagaatgggctatgggtaatctatgcaacagaacaaaacaatggtaaaattgtcattagtcaattgaacccttacaccctacggatcgaaggaacatgggatactgcatatgataaaaggtcagcttccaatgcctttatgatttgtggaattctgtatgtggtcaaatctgtatatgaggatgatgacaatgaggctactggaaataagattgactacatttacaacactgaccaaagcaaggatagtttggtggatgtaccctttcctaattcataccagtacattgcagctgtggattacaaccccagggacaacctactttatgtatggaataactatcacgtcgtgaaatattctttggattttggacctctggatagtagatcagggcaggcacatcatggacaagtttcatacatttctccgccaattcaccttgactctgagctagaaagaccctctgttaaagatatctctaccacaggacctcttggcatgggaagcactaccaccagtaccacccttcggaccacaactttgagcccaggaaggagtaccaccccgtcagtgtcaggaagaagaaaccggagtactagtaccccatctccagctgtcgaggtacttgatgacatgaccacacaccttccatcagcatcgtcccaaatcccagctctcgaagagagctgtgaggctgtggaagcccgagaaatcatgtggtttaagactcgtcaaggacagatagcaaagcagccatgccctgcaggaactataggtgtatcaacttatctatgccttgctcctgatggaatttgggatccccaaggtccagatctcagcaactgttcttctccttgggtcaatcatataacacagaagttgaaatctggtgaaacagctgccaacattgctagagagctggctgaacagacaagaaatcacttgaatgctggggacatcacctactctgtccgggccatggaccagctggtaggcctcctagatgtacagcttcggaacttgaccccaggtggaaaagatagtgctgcccggagtttgaacaagcttcagaaaagagagcgctcttgcagagcctatgtccaggcaatggtcgagacagttaacaacctccttcagccacaagctttgaatgcatggagagacctgactacgagtgatcagctgcgtgcggccaccatgttgcttcatactgtggaggaaagtgcttttgtgctggctgataaccttttgaagactgacattgtcagggagaatacagacaatattaaattggaagttgcaagactgagcacagaaggaaacttagaagacctaaaatttccagaaaacatgggccatggaagcactatccagctgtctgcaaataccttaaagcaaaatggccgaaatggagagatcagagtggcctttgtcctgtataacaacttgggtccttatttatccacggagaatgccagtatgaagttgggaacggaagctttgtccacaaatcattctgttattgtcaattcccctgttattacggcagcaataaacaaagagttcagtaacaaggtttatttggctgatcctgtggtatttactgttaaacatatcaagcagtcagaggaaaatttcaaccctaactgttcattttggagctactccaagcgtacaatgacaggttattggtcaacacaaggctgtcggctcctgacaacaaataagacacatactacatgctcttgtaaccacctaacaaattttgcagtactgatggcacatgtggaagttaagcacagtgatgcggtccatgacctccttctggatgtgatcacgtgggttggaattttgctgtcccttgtttgtctcctgatttgcatcttcacattttgctttttccgcgggctccagagtgaccgtaacaccatccacaagaacctctgcatcagtctctttgtagcagagctgctcttcctgattgggatcaaccgaactgaccaaccaattgcctgtgctgttttcgctgccctgttacatttcttcttcttggctgccttcacctggatgttcctggagggggtgcagctttatatcatgctggtggaggtttttgagagtgaacattcacgtaggaaatacttttatctggtcggctatgggatgcctgcactcattgtggctgtgtcagctgcagtagactacaggagttatggaacagataaagtatgttggctccgacttgacacctacttcatttggagttttataggaccagcaactttgataattatgcttaatgtaatcttccttgggattgctttatataaaatgtttcatcatactgctatactgaaacctgaatcaggctgtcttgataacatcaactatgaggataacagacccttcatcaagtcatgggttataggtgcaatagctcttctctgcctattaggattgacctgggcctttggactcatgtatattaatgaaagcacagtcatcatggcctatctcttcaccattttcaattctctacagggaatgtttatatttattttccattgtgtcctacagaagaaggtacgaaaagagtatgggaaatgcctgcgaacacattgctgtagtggcaaaagtacagagagttccattggttcagggaaaacatctggttctcgaactcctggacgctactccacaggctcacagagccgaatccgtagaatgtggaatgacacggttcgaaagcagtcagagtcttcctttattactggagacataaacagttcagcgtcactcaacagagagccctacagagagacaagtatgggagtaaagctaaacattgcatatcaaataggggcttctgaacaatgccagggatacaagtgtcatggatactctaccactgaatggtaa

SEQ ID NO: 888 - DNA, 2484 bp, Homo sapiens
atgcgcttggagggagagggccgctcagcgagggcgggacagaatctctcccgggctgggagtgcacggcgcggtgcgcccagggacctcagcatgaacaacctcacagagcttcagcctggcctcttccaccacctgcgcttcttggaggagctgcgtctctctgggaaccatctctcacacatcccaggacaagcattctctggtctctacagcctgaaaatcctgatgctgcagaacaatcagctgggaggaatccccgcagaggcgctgtgggagctgccgagcctgcagtcgctagacctgaattataacaagctgcaggagttccctgtggccatccggaccctgggcagactgcaggaactggggttccataacaacaacatcaaggccatcccagaaaaggccttcatggggaaccctctgctacagacgatacacttttatgataacccaatccagtttgtgggaagatcggcattccagtacctgcctaaactccacacactatctctgaatggtgccatggacatccaggagtttccagatctcaaaggcaccaccagcctggagatcctgaccctgacccgcgcaggcatccggctgctcccatcggggatgtgccaacagctgcccaggctccgagtcctggaactgtctcacaatcaaattgaggagctgcccagcctgcacaggtgtcagaaattggaggaaatcggcctccaacacaaccgcatctgggaaattggagctgacaccttcagccagctgagctccctgcaagccctggatcttagctggaacgccatccggtccatccaccccgaggccttctccaccctgcactccctggtcaagctggacctgacagacaaccagctgaccacactgcccctggctggacttgggggcttgatgcatctgaagctcaaagggaaccttgctctctcccaggccttctccaaggacagtttcccaaaactgaggatcctggaggtgccttatgcctaccagtgctgtccctatgggatgtgtgccagcttcttcaaggcctctgggcagtgggaggctgaagaccttcaccttgatgatgaggagtcttcaaaaaggcccctgggcctccttgccagacaagcagagaaccactatgaccaggacctggatgagctccagctggagatggaggactcaaagccacaccccagtgtccagtgtagccctactccaggccccttcaagccctgtgagtacctctttgaaagctggggcatccgcctggccgtgtgggccatcgtgttgctctccgtgctctgcaatggactggtgctgctgaccgtgttcgctggcgggcctgtccccctgcccccggtcaagtttgtggtaggtgcgattgcaggcgccaacaccttgactggcatttcctgtggccttctagcctcagtcgatgccctgacctttggtcagttctctgagtacggagcccgctgggagacggggctaggctgccgggccactggcttcctggcagtacttgggtcggaggcatcggtgctgctgctcactctggccgcagtgcagtgcagcgtctccgtctcctgtgtccgggcctatgggaagtccccctccctgggcagcgttcgagcaggggtcctaggctgcctggcactggcagggctggccgccgcactgcccctggcctcagtgggagaatacggggcctccccactctgcctgccctacgcgccacctgagggtcagccagcagccctgggcttcaccgtggccctggtgatgatgaactccttctgtttcctggtcgtggccggtgcctacatcaaactgtactgtgacctgccgcggggcgactttgaggccgtgtgggactgcgccatggtgaggcacgtggcctggctcatcttcgcagacgggctcctctactgtcccgtggccttcctcagcttcgcctccatgctgggcctcttccctgtcacgcccgaggccgtcaagtctgtcctgctggtggtgctgcccctgcctgcctgcctcaacccactgctgtacctgctcttcaacccccacttccgggatgaccttcggcggcttcggccccgcgcaggggactcagggcccctagcctatgctgcggccggggagctggagaagagctcctgtgattctacccaggccctggtagccttctctgatgtggatctcattctggaagcttctgaagctgggcggccccctgggctggagacctatggcttcccctcagtgaccctcatctcctgtcagcagccaggggcccccaggctggagggcagccattgtgtagagccagaggggaaccactttgggaacccccaaccctccatggatggagaactgctgctgagggcagagggatctacgccagcaggtggaggcttgtcagggggtggcggctttcagccctctggcttggccttgcttcacacgtat

SEQ ID NO: 889 - DNA, 2274 bp, Homo sapiens
atgacatctggttctgtcttcttctacatcttaatttttggaaaatatttttctcatgggggtggacaggatgtcaagtgctcccttggctatttcccctgtgggaacatcacaaagtgcttgcctcagctcctgcactgtaacggtgtggacgactgcgggaatcaggccgatgaggacaactgtggagacaacaatggatggtccatgcaatttgacaaatattttgccagttactacaaaatgacttcccaatatccttttgaggcagaaacacctgaatgtttggtcggttctgtgccagtgcaatgtctttgccaaggtctggagcttgactgtgatgaaaccaatttacgagctgttccatcggtttcttcaaatgtgactgcaatgtcacttcagtggaacttaataagaaagcttcctcctgattgcttcaagaattatcatgatcttcagaagctgtacctgcaaaacaataagattacatccatctccatctatgctttcagaggactgaatagccttactaaactgtatctcagtcataacagaataaccttcctgaagccgggtgtttttgaagatcttcacagactagaatggctgataattgaagataatcacctcagtcgaatttccccaccaacattttatggactaaattctcttattctcttagtcctgatgaataacgtcctcacccgtttacctgataaacctctctgtcaacacatgccaagactacattggctggaccttgaaggcaaccatatccataatttaagaaatttgacttttatttcctgcagtaatttaactgttttagtgatgaggaaaaacaaaattaatcacttaaatgaaaatacttttgcacctctccagaaactggatgaattggatttaggaagtaataagattgaaaatcttccaccgcttatattcaaggacctgaaggagctgtcacaattgaatctttcctataatccaatccagaaaattcaagcaaaccaatttgattatcttgtcaaactcaagtctctcagcctagaagggattgaaatttcaaatatccaacaaaggatgtttagacctcttatgaatctctctcacatatattttaagaaattccagtactgtgggtatgcaccacatgttcgcagctgtaaaccaaacactgatggaatttcatctctagagaatctcttggcaagcattattcagagagtatttgtctgggttgtatctgcagttacctgctttggaaacatttttgtcatttgcatgcgaccttatatcaggtctgagaacaagctgtatgccatgtcaatcatttctctctgctgtgccgactgcttaatgggaatatatttattcgtgatcggaggctttgacctaaagtttcgtggagaatacaataagcatgcgcagctgtggatggagagtactcattgtcagcttgtaggatctttggccattctgtccacagaagtatcagttttactgttaacatttctgacattggaaaaatacatctgcattgtctatccttttagatgtgtgagacctggaaaatgcagaacaattacagttctgattctcatttggattactggttttatagtggctttcattccattgagcaataaggaatttttcaaaaactactatggcaccaatggagtatgcttccctcttcattcagaagatacagaaagtattggagcccagatttattcagtggcaatttttcttggtattaatttggccgcatttatcatcatagttttttcctatggaagcatgttttatagtgttcatcaaagtgccataacagcaactgaaatacggaatcaagttaaaaaagagatgatccttgccaaacgttttttctttatagtatttactgatgcattatgctggatacccatttttgtagtgaaatttctttcactgcttcaggtagaaataccaggtaccataacctcttgggtagtgatttttattctgcccattaacagtgctttgaacccaattctctatactctgaccacaagaccatttaaagaaatgattcatcggttttggtataactacagacaaagaaaatctatggacagcaaaggtcagaaaacatatgctccatcattcatctgggtggaaatgtggccactgcaggagatgccacctgagttaatgaagccggaccttttcacatacccctgtgaaatgtcactgatttctcaatcaacgagactcaattcctattcatga

SEQ ID NO: 890 - DNA, 1089 bp, Homo sapiens
atgtcagagaacggctccttcgccaactgctgcgaggcgggcgggtgggcagtgcgcccgggctggtcgggggctggcagcgcgcggccctccaggacccctcgacctccctgggtggctccagcgctgtccgcggtgctcatcgtcaccaccgccgtggacgtcgtgggcaacctcctggtgatcctctccgtgctcaggaaccgcaagctccggaacgcaggtaatttgttcttggtgagtctggcattggctgacctggtggtggccttctacccctacccgctaatcctcgtggccatcttctatgacggctgggccctgggggaggagcactgcaaggccagcgcctttgtgatgggcctgagcgtcatcggctctgtcttcaatatcactgccatcgccattaaccgctactgctacatctgccacagcatggcctaccaccgaatctaccggcgctggcacacccctctgcacatctgcctcatctggctcctcaccgtggtggccttgctgcccaacttctttgtggggtccctggagtacgacccacgcatctattcctgcaccttcatccagaccgccagcacccagtacacggcggcagtggtggtcatccacttcctcctccctatcgctgtcgtgtccttctgctacctgcgcatctgggtgctggtgcttcaggcccgcaggaaagccaagccagagagcaggctgtgcctgaagcccagcgacttgcggagctttctaaccatgtttgtggtgtttgtgatctttgccatctgctgggctccacttaactgcatcggcctcgctgtggccatcaacccccaagaaatggctccccagatccctgaggggctatttgtcactagctacttactggcttatttcaacagctgcctgaatgccattgtctatgggctcttgaaccaaaacttccgcagggaatacaagaggatcctcttggccctttggaacccacggcactgcattcaagatgcttccaagggcagccacgcggaggggctgcagagcccagctccacccatcattggtgtgcagcaccaggcagatgctctctag

SEQ ID NO: 891 - DNA, 1293 bp, Homo sapiens
atggagggggagccctcccagcctcccaacagcagttggcccctaagtcagaatgggactaacactgaggccaccccggctacaaacctcaccttctcctcctactatcagcacacctcccctgtggcggccatgttcattgtggcctatgcgctcatcttcctgctctgcatggtgggcaacaccctggtctgtttcatcgtgctcaagaaccggcacatgcatactgtcaccaacatgttcatcctcaacctggctgtcagtgacctgctggtgggcatcttctgcatgcccaccacccttgtggacaacctcatcactgggtggcccttcgacaatgccacatgcaagatgagcggcttggtgcagggcatgtctgtgtcggcttccgttttcacactggtggccattgctgtggaaaggttccgctgcatcgtgcaccctttccgcgagaagctgaccctgcggaaggcgctcgtcaccatcgccgtcatctgggccctggcgctgctcatcatgtgtccctcggccgtcacgctgaccgtcacccgtgaggagcaccacttcatggtggacgcccgcaaccgctcctaccctctctactcctgctgggaggcctggcccgagaagggcatgcgcagggtctacaccactgtgctcttctcgcacatctacctggcgccgctggcgctcatcgtggtcatgtacgcccgcatcgcgcgcaagctctgccaggccccgggcccggcccccgggggcgaggaggctgcggacccgcgagcatcgcggcgcagagcgcgcgtggtgcacatgctggtcatggtggcgctgttcttcacgctgtcctggctgccgctctgggcgctgctgctgctcatcgactacgggcagctcagcgcgccgcagctgcacctggtcaccgtctacgccttccccttcgcgcactggctggccttcttcaacagcagcgccaaccccatcatctacggctacttcaacgagaacttccgccgcggcttccaggccgccttccgcgcccgcctctgcccgcgcccgtcggggagccacaaggaggcctactccgagcggcccggcgggcttctgcacaggcgggtcttcgtggtggtgcggcccagcgactccgggctgccctctgagtcgggccctagcagtggggcccccaggcccggccgcctcccgctgcggaatgggcgggtggctcaccacggcttgcccagggaagggcctggctgctcccacctgcccctcaccattccagcctgggatatctga

SEQ ID NO: 892 - DNA, 1224 bp, Homo sapiens
atgagcctcaactcctccctcagctgcaggaaggagctgagtaatctcactgaggaggagggtggcgaagggggcgtcatcatcacccagttcatcgccatcattgtcatcaccatttttgtctgcctgggaaacctggtcatcgtggtcaccttgtacaagaagtcctacctcctcaccctcagcaacaagttcgtcttcagcctgactctgtccaacttcctgctgtccgtgttggtgctgccttttgtggtgacgagctccatccgcagggaatggatctttggtgtagtgtggtgcaacttctctgccctcctctacctgctgatcagctctgccagcatgctaaccctcggggtcattgccatcgaccgctactatgctgtcctgtaccccatggtgtaccccatgaagatcacagggaaccgggctgtgatggcacttgtctacatctggcttcactcgctcatcggctgcctgccacccctgtttggttggtcatccgtggagtttgacgagttcaaatggatgtgtgtggctgcttggcaccgggagcctggctacacggccttctggcagatctggtgtgccctcttcccctttctggtcatgctggtgtgctatggcttcatcttccgcgtggccagggtcaaggcacgcaaggtgcactgtggcacagtcgtcatcgtggaggaggatgctcagaggaccgggaggaagaactccagcacctccacctcctcttcaggcagcaggaggaatgcctttcagggtgtggtctactcggccaaccagtgcaaagccctcatcaccatcctggtggtcctcggtgccttcatggtcacctggggcccctacatggttgtcatcgcctctgaggccctctgggggaaaagctccgtctccccgagcctggagacttgggccacatggctgtcctttgccagcgctgtctgccaccccctgatctatggactctggaacaagacagttcgcaaagaactactgggcatgtgctttggggaccggtattatcgggaaccatttgtgcaacgacagaggacttccaggctcttcagcatttccaacaggatcacagacctgggcctgtccccacacctcactgcgctcatggcaggtggacagcccctggggcacagcagcagcacgggggacactggcttcagctgctcccaggactcaggtaacctgcgtgctttataa

SEQ ID NO: 893 - DNA, 1323 bp, Homo sapiens
atgcgtccccacctgtcgccgccgctgcagcagctactactgccggtgctgctcgcctgcgccgcgcactcgactggagcccttccccgactatgtgacgtgctacaagtgctgtgggaagagcaagaccagtgcctgcaggaactctccagagagcagacaggagacctgggcacggagcagccagtgccaggttgtgaggggatgtgggacaacataagctgctggccctcttctgtgccgggccggatggtggaggtggaatgcccgagattcctccggatgctcaccagcagaaatggttccttgttccgaaactgcacacaggatggctggtcagaaaccttccccaggcctaatctggcctgtggcgttaatgtgaacgactcttccaacgagaagcggcactcctacctgctgaagctgaaagtcatgtacaccgtgggctacagctcctccctggtcatgctcctggtcgcccttggcatcctctgtgctttccggaggctccactgcactcgcaactacatccacatgcacctgttcgtgtccttcatccttcgtgccctgtccaacttcatcaaggacgccgtgctcttctcctcagatgatgtcacctactgcgatgcccacagggcgggctgcaagctggtcatggtgctgttccagtactgcatcatggccaactactcctggctgctggtggaaggcctctaccttcacacactcctcgccatctccttcttctctgaaagaaagtacctccagggatttgtggcattcggatggggttctccagccatttttgttgctttgtgggctattgccagacactttctggaagatgttgggtgctgggacatcaatgccaacgcatccatctggtggatcattcgtggtcctgtgatcctctccatcctgtttaatttcatccttttcataaacattctaagaatcctgatgagaaaacttagaacccaagaaacaagaggaaatcaagtcagccattataagcgcctggccaggtccactctcctgctgatccccctctttggcatccactacatcgtcttcgccttctccccagaggacgctatggagatccagctgttttttgaactagcccttggctcattccagggactggtggtggccgtcctctactgcttcctcaatggggaggtgcagctggaggttcagaagaagtggcagcaatggcacctccgtgagttcccactgcaccccgtggcctccttcagcaacagcaccaaggccagccacttggagcagagccagggcacctgcaggaccagcatcatctga

SEQ ID NO: 894 - DNA, 1122 bp, Homo sapiens
atggccaacactaccggagagcctgaggaggtgagcggcgctctgtccccaccgtccgcatcagcttatgtgaagctggtactgctgggactgattatgtgcgtgagcctggcgggtaacgccatcttgtccctgctggtgctcaaggagcgtgccctgcacaaggctccttactacttcctgctggacctgtgcctggccgatggcatacgctctgccgtctgcttcccctttgtgctggcttctgtgcgccacggctcttcatggaccttcagtgcactcagctgcaagattgtggcctttatggccgtgctcttttgcttccatgcggccttcatgctgttctgcatcagcgtcacccgctacatggccatcgcccaccaccgcttctacgccaagcgcatgacactctggacatgcgcggctgtcatctgcatggcctggaccctgtctgtggccatggccttcccacctgtctttgacgtgggcacctacaagtttattcgggaggaggaccagtgcatctttgagcatcgctacttcaaggccaatgacacgctgggcttcatgcttatgttggctgtgctcatggcagctacccatgctgtctacggcaagctgctcctcttcgagtatcgtcaccgcaagatgaagccagtgcagatggtgccagccatcagccagaactggacattccatggtcccggggccaccggccaggctgctgccaactggatcgccggctttggccgtgggcccatgccaccaaccctgctgggtatccggcagaatgggcatgcagccagccggcggctactgggcatggacgaggtcaagggtgaaaagcagctgggccgcatgttctacgcgatcacactgctctttctgctcctctggtcaccctacatcgtggcctgctactggcgagtgtttgtgaaagcctgtgctgtgccccaccgctacctggccactgctgtttggatgagcttcgcccaggctgccgtcaacccaattgtctgcttcctgctcaacaaggacctcaagaagtgcctgaggactcacgccccctgctggggcacaggaggtgccccggctcccagagaaccctactgtgtcatgtga

SEQ ID NO: 895 - DNA, 1047 bp, Homo sapiens
atggtgaataatttctcccaagctgaggctgtggagctgtgttacaagaacgtgaacgaatcctgcattaaaactccttactcgccaggtcctcgatctatcctctacgccgtccttggttttggggctgtgctggcagcgtttggaaacttactggtcatgattgctatccttcacttcaaacaactgcacacacctacaaactttctgattgcgtcgctggcctgtgctgacttcttggtgggagtcactgtgatgcccttcagcacagtgaggtctgtggagagctgttggtactttggggacagttactgtaaattccatacatgttttgacacatccttctgttttgcttctttatttcatttatgctgtatctctgttgatagatacattgctgttactgatcctctgacctatccaaccaagtttactgtgtcagtttcagggatatgcattgttctttcctggttcttttctgtcacatacagcttttcgatcttttacacgggagccaacgaagaaggaattgaggaattagtagttgctctaacctgtgtaggaggctgccaggctccactgaatcaaaactgggtcctactttgttttcttctattctttatacccaatgtcgccatggtgtttatatacagtaagatatttttggtggccaagcatcaggctaggaagatagaaagtacagccagccaagctcagtcctcctcagagagttacaaggaaagagtagcaaaaagagagagaaaggctgccaaaaccttgggaattgctatggcagcatttcttgtctcttggctaccatacctcgttgatgcagtgattgatgcttatatgaattttataactcctccttatgtttatgagattttagtttggtgtgtttattataattcagctatgaaccccttgatttatgctttcttttaccaatggtttgggaaggcaataaaacttattgtaagcggcaaggtcttaaggactgattcgtcaacaactaatttattttctgaagaagtagagacagattaa

SEQ ID NO: 896 - DNA, 3264 bp, Homo sapiens
agtgcggagcgagcgcctcaaatgctcgggtttctcagctgattgtctccagccgagagttgttttttgcagctacggagccgagccgcagcaggaggagccgagacccccggggggtggggggaaagaggaggcggggtccgggggagccgcggctgctttgcgctggactccgggtcccgtcacggcgcttcctggggttagaggctggggtgggtggggggtaagggggcagtccttctccccttcgacggcggctccgagtccagccccttccttcccgcgctcgctcgcccggcccccagccccctcatgagggtgtccgtgccgggtccggcggccgctgccgcccccgcagccggccgcgagccctccacgcccggcgggggcagcggaggcggaggcgccgtcgctgcagcctcaggcgccgcggtgccgggctccgtgcagttggcgctgagcgtcctgcacgccctgctctacgccgcgctgttcgcctttgcctacctgcagctgtggcggctgctcctgtaccgcgagcggcggctgagttaccagagcctctgcctcttcctctgtctcctgtgggcagcgctcaggaccaccctcttctccgccgccttctcgctcagcggctccctgcccttgctccggccgcccgctcacctgcacttcttcccccactggctgctctactgcttcccctcctgtctccagttctccacgctctgtctcctcaacctctacctggcggaggttatatgtaaagtcagatgtgccactgaacttgacagacacaaaattctactgcatttgggctttataatggcaagcctgctctttttagtggtgaacttgacttgcgcaatgctagttcatggagatgtcccagaaaatcagttgaagtggactgtgtttgttcgagcattaattaatgatagcctgtttattctttgtgccatctctttagtgtgttacatatgcaaaattaccaaaatgtcatcagctaatgtctacctcgaatcaaagattacaggatctcattctttcttatggctgaatagtactccattgtgtggtatgtctctgtgccagactgtcatcgtgggctctgtagtcattcttctgtactcttccagagcttgttataatttggtggtggtcaccatatctcaggatacattagaaagtccatttaattatggctgggataatctttcagataaggctcatgtagaagacataagtggagaagagtatatagtatttggaatggtcctctttctgtgggaacatgtgccagcatggtcggtggtactgtttttccgggcacagagattaaaccagaatttggcacctgctggcatgataaatagtcacagttatagttccagagcttactttttcgacaatccaagacgatatgatagtgatgatgacctgccaagactgggaagttcaagagaaggaagtttaccaaattcgcaaagtttgggctggtatggcaccatgactgggtgtggcagcagcagttacacagtcactccccacctgaatggacctatgacagatactgctcctttgctctttacttgtagtaatttagatttgaacaatcatcatagcttatatgtgacaccacaaaactgacagcatcaccaagtcatgattcttgagttgtttttcataaatgtgtatattcaatgtgtttaaattccatctacataaacattccattatctgttgcaactgaaaacaaaatctggaagtgtggctgtgtttggtaaataacacagctattatttttgacctcttcatagtaaaatgaagtaaaatggaaagtttggagtaggagaaaagagagattagatcttaaggcacttgatggcctccaaaaatcctgactttggaacatcaaatgcatatgtgcacttttatctttgttctgagtcactgcagtccccaaagtcatatgccaatgttcacactgaaatactgtattgtacaccaaactggaaggcaattttcctatgaaaatcaaagccggtatattcattggtatgctctatacagatatcttaataaaaattttatagtgtgaacagtgcacagagttaaggcataaaaatgtatcattctttataaaaatctactgaaaatgtgtaatcattgaagacagttcttttaagcatgattttaaaatagcaactgaaattcaatcattttaaacaaatgatggtagtaatccattagttatggccagcagtgttctttggagagccacaataatttcaagaggaaaatataccagtgaaaattgtgtggctattttgagtagaattggtcagttgattattttgtgtaattgagatatatgtagtagtttaagcatgattcttgaagaaagcaatagtgacttttgcatagggagattttggtagaaacttcttgggactaaacaagtttagagatgcatttaagaattattcacaaaatgtgtaattctaaatttaaacataaatatattttcaaaagcatttgattctctgaagcatgatatagctggtctacctagtgaatcaggattgtcctcaggtaaatgaaatcatgatacattattgcagtgaactcaagtgcaatactttgtaagacatataattcctatgattttcacatttttatatcttatatatgggaaaagccaaattaaattgaattcagattaattccagcattagactaaatgagcaaacttaagtaaatgtacaaactaggtaagtataaaaccacaggttaacaatattggagtacttttagaattacattaaaactgtcttaaatgtcctatcccaaatctaaaaaaaaagaaaatggcaggctgagataatacagaattttaaaatgcactttgtaccagtgtctatatggaaagaagtagatgctgaatacctcaagatgccaagggaacaagcaacattgggaagttgtcacaacatgctcaaagacaaactacaattgtctgctagctatttcttcagaactggaactaatacgactatccttttctgttttatactttgattagaatgttatttcctcgcttacttaaaatgtacttcaactttttaacaactgatacaataacttcataaaagtataacactaggttgaaaccttaaggaaaaattgaaattgttaatgctttcgatcttttgggaggccagtacacagacaaataaatttcttctttttatgataaaaaaa

SEQ ID NO: 897 - DNA, 1664 bp, Homo sapiens
agcccagagacacattggggctgacctgccgctgctgtcagtgggaggccagtggtgctggccaagaagtgtcatggctggtgtcgtgcacgtttccctggctgctcactgcggggcctgtccgtggggccggggcagactccgcaaaggacgcgcagcctgcaagtccgcggcccagagacacattggggctgacctgccgctgctgtcagtgggaggccagtggtgctggccaagaagtgtcatggctggtgtcgtgcacgtttccctggctgctctcctcctgctgcctatggcccctgccatgcattctgactgcatcttcaagaaggagcaagccatgtgcctggagaagatccagagggccaatgagctgatgggcttcaatgattcctctccaggctgtcctgggatgtgggacaacatcacgtgttggaagcccgcccatgtgggtgagatggtcctggtcagctgccctgagctcttccgaatcttcaacccagaccaagtctgggagaccgaaaccattggagagtctgattttggtgacagtaactccttagatctctcagacatgggagtggtgagccggaactgcacggaggatggctggtcggaacccttccctcattactttgatgcctgtgggtttgatgaatatgaatctgagactggggaccaggattattactacctgtcagtgaaggccctctacacggttggctacagcacatccctcgtcaccctcaccactgccatggtcatcctttgtcgcttccggaagctgcactgcacacgcaacttcatccacatgaacctgtttgtgtcgttcatgctgagggcgatctccgtcttcatcaaagactggattctgtatgcggagcaggacagcaaccactgcttcatctccactgtggaatgtaaggccgtcatggttttcttccactactgtgttgtgtccaactacttctggctgttcatcgagggcctgtacctcttcactctgctggtggagaccttcttccctgaaaggagatacttctactggtacaccatcattggctgggggaccccaactgtgtgtgtgacagtgtgggctacgctgagactctactttgatgacacaggctgctgggatatgaatgacagcacagctctgtggtgggtgatcaaaggccctgtggttggctctatcatggttaactttgtgctttttattggcattatcgtcatccttgtgcagaaacttcagtctccagacatgggaggcaatgagtccagcatctacttgcgactggcccggtccaccctgctgctcatcccactattcggaatccactacacagtatttgccttctccccagagaatgtcagcaaaagggaaagactcgtgtttgagctggggctgggctccttccagggctttgtggtggctgttctctactgttttctgaatggtgaggtacaagcggagatcaagcgaaaatggcgaagctggaaggtgaaccgttacttcgctgtggacttcaagcaccgacacccgtctctggccagcagtggggtgaatgggggcacccagctctccatcctgagcaagagcagctcccaaatccgcatgtctggcctccctgctgacaatctggccacctgagccatgctcccct

SEQ ID NO: 898 - DNA, 1215 bp, Homo sapiens
atgtcagtgaaacccagctgggggcctggcccctcggagggggtcaccgcagtgcctaccagtgaccttggagagatccacaactggaccgagctgcttgacctcttcaaccacactttgtctgagtgccacgtggagctcagccagagcaccaagcgcgtggtcctctttgccctctacctggccatgtttgtggttgggctggtggagaacctcctggtgatatgcgtcaactggcgcggctcaggccgggcagggctgatgaacctctacatcctcaacatggccatcgcggacctgggcattgtcctgtctctgcccgtgtggatgctggaggtcacgctggactacacctggctctggggcagcttctcctgccgcttcactcactacttctactttgtcaacatgtatagcagcatcttcttcctggtgtgcctcagtgtcgaccgctatgtcaccctcaccagcgcctccccctcctggcagcgttaccagcaccgagtgcggcgggccatgtgtgcaggcatctgggtcctctcggccatcatcccgctgcctgaggtggtccacatccagctggtggagggccctgagcccatgtgcctcttcatggcaccttttgaaacgtacagcacctgggccctggcggtggccctgtccaccaccatcctgggcttcctgctgcccttccctctcatcacagtcttcaatgtgctgacagcctgccggctgcggcagccaggacaacccaagagccggcgccactgcttgctgctgtgcgcctacgtggccgtctttgtcatgtgctggctgccctatcatgtgaccctgctgctgctcacactgcatgggacccacatctccctccactgccacctggtccacctgctctacttcttctatgatgtcattgactgcttctccatgctgcactgtgtcatcaaccccatcctttacaactttctcagcccacacttccggggccggctcctgaatgctgtagtccattaccttcctaaggaccagaccaaggcgggcacatgcgcctcctcttcctcctgttccacccagcattccatcatcatcaccaagggtgatagccagcctgctgcagcagccccccaccctgagccaagcctgagctttcaggcacaccatttgcttccaaatacttcccccatctctcccactcagcctcttacacccagctga

SEQ ID NO: 899 - DNA, 981 bp, Homo sapiens
atgccgccctccatctcagctttccaggccgcctacatcggcatcgaggtgctcatcgccctggtctctgtgcccgggaacgtgctggtgatctgggcggtgaaggtgaaccaggcgctgcgggatgccaccttctgcttcatcgtgtcgctggcggtggctgatgtggccgtgggtgccctggtcatccccctcgccatcctcatcaacattgggccacagacctacttccacacctgcctcatggttgcctgtccggtcctcatcctcacccagagctccatcctggccctgctggcaattgctgtggaccgctacctccgggtcaagatccctctccggtacaagatggtggtgaccccccggagggcggcggtggccatagccggctgctggatcctctccttcgtggtgggactgacccctatgtttggctggaacaatctgagtgcggtggagcgggcctgggcagccaacggcagcatgggggagcccgtgatcaagtgcgagttcgagaaggtcatcagcatggagtacatggtctacttcaacttctttgtgtgggtgctgcccccgcttctcctcatggtcctcatctacctggaggtcttctacctaatccgcaagcagctcaacaagaaggtgtcggcctcctccggcgacccgcagaagtactatgggaaggagctgaagatcgccaagtcgctggccctcatcctcttcctctttgccctcagctggctgcctttgcacatcctcaactgcatcaccctcttctgcccgtcctgccacaagcccagcatccttacctacattgccatcttcctcacgcacggcaactcggccatgaaccccattgtctatgccttccgcatccagaagttccgcgtcaccttccttaagatttggaatgaccatttccgctgccagcctgcacctcccattgacgaggatctcccagaagagaggcctgatgactag

SEQ ID NO: 900 - DNA, 1239 bp, Homo sapiens
atgcccatcatgggctcctcggtgtacatcacggtggagctggccattgctgtgctggccatcctgggcaatgtgctggtgtgctgggccgtgtggctcaacagcaacctgcagaacgtcaccaactactttgtggtgtcactggcggcggccgacatcgcagtgggtgtgctcgccatcccctttgccatcaccatcagcaccgggttctgcgctgcctgccacggctgcctcttcattgcctgcttcgtcctggtcctcacgcagagctccatcttcagtctcctggccatcgccattgaccgctacattgccatccgcatcccgctccggtacaatggcttggtgaccggcacgagggctaagggcatcattgccatctgctgggtgctgtcgtttgccatcggcctgactcccatgctaggttggaacaactgcggtcagccaaaggagggcaagaaccactcccagggctgcggggagggccaagtggcctgtctctttgaggatgtggtccccatgaactacatggtgtacttcaacttctttgcctgtgtgctggtgcccctgctgctcatgctgggtgtctatttgcggatcttcctggcggcgcgacgacagctgaagcagatggagagccagcctctgccgggggagcgggcacggtccacactgcagaaggaggtccatgctgccaagtcactggccatcattgtggggctctttgccctctgctggctgcccctacacatcatcaactgcttcactttcttctgccccgactgcagccacgcccctctctggctcatgtacctggccatcgtcctctcccacaccaattcggttgtgaatcccttcatctacgcctaccgtatccgcgagttccgccagaccttccgcaagatcattcgcagccacgtcctgaggcagcaagaacctttcaaggcagctggcaccagtgcccgggtcttggcagctcatggcagtgacggagagcaggtcagcctccgtctcaacggccacccgccaggagtgtgggccaacggcagtgctccccaccctgagcggaggcccaatggctatgccctggggctggtgagtggagggagtgcccaagagtcccaggggaacacgggcctcccagacgtggagctccttagccatgagctcaagggagtgtgcccagagccccctggcctagatgaccccctggcccaggatggagcaggagtgtcctga

SEQ ID NO: 901 - DNA, 999 bp, Homo sapiens
atgctgctggagacacaggacgcgctgtacgtggcgctggagctggtcatcgccgcgctttcggtggcgggcaacgtgctggtgtgcgccgcggtgggcacggcgaacactctgcagacgcccaccaactacttcctggtgtccctggctgcggccgacgtggccgtggggctcttcgccatcccctttgccatcaccatcagcctgggcttctgcactgacttctacggctgcctcttcctcgcctgcttcgtgctggtgctcacgcagagctccatcttcagccttctggccgtggcagtcgacagatacctggccatctgtgtcccgctcaggtataaaagtttggtcacggggacccgagcaagaggggtcattgctgtcctctgggtccttgcctttggcatcggattgactccattcctggggtggaacagtaaagacagtgccaccaacaactgcacagaaccctgggatggaaccacgaatgaaagctgctgccttgtgaagtgtctctttgagaatgtggtccccatgagctacatggtatatttcaatttctttgggtgtgttctgcccccactgcttataatgctggtgatctacattaagatcttcctggtggcctgcaggcagcttcagcgcactgagctgatggaccactcgaggaccaccctccagcgggagatccatgcagccaagtcactggccatgattgtggggatttttgccctgtgctggttacctgtgcatgctgttaactgtgtcactcttttccagccagctcagggtaaaaataagcccaagtgggcaatgaatatggccattcttctgtcacatgccaattcagttgtcaatcccattgtctatgcttaccggaaccgagacttccgctacacttttcacaaaattatctccaggtatcttctctgccaagcagatgtcaagagtgggaatggtcaggctggggtacagcctgctctcggtgtgggcctatga

SEQ ID NO: 902 - DNA, 957 bp, Homo sapiens
atgcccaacaacagcactactctgtcattggccaatgttacctacatcaccatggaaattttcattggactctgcgccatagtgggcaacgtgctggtcatctgcgtggtcaagctgaaccccagcctgcagaccaccaccttctatttcattgtctctctagccctggctgacattgctgttggggtgctggtcatgcctttggccattgttgtcagcctgggcatcacaatccacttctacagctgcctttttatgacttgcctactgcttatctttacccacgcctccatcatgtccttgctggccatcgctgtggaccgatacttgcgggtcaagcttaccgtcagatacaagagggtcaccactcacagaagaatatggctggccctgggcctttgctggctggtgtcattcctggtgggattgacccccatgtttggctggaacatgaaactgacctcagagtaccacagaaatgtcaccttcctttcatgccaatttgtttccgtcatgagaatggactacatggtatacttcagcttcctcacctggattttcatccccctggttgtcatgtgcgccatctatcttgacatcttttacatcattcggaacaaactcagtctgaacttatctaactccaaagagacaggtgcattttatggacgggagttcaagacggctaagtccttgtttctggttcttttcttgtttgctctgtcatggctgcctttatctatcatcaactgcatcatctactttaatggtgaggtaccacagcttgtgctgtacatgggcatcctgctgtcccatgccaactccatgatgaaccctatcgtctatgcctataaaataaagaagttcaaggaaacctaccttttgatcctcaaagcctgtgtggtctgccatccctctgattctttggacacaagcattgagaagaattctgagtag

SEQ ID NO: 903 - DNA, 1401 bp, Homo sapiens
atggtgtttctctcgggaaatgcttccgacagctccaactgcacccaaccgccggcaccggtgaacatttccaaggccattctgctcggggtgatcttggggggcctcattcttttcggggtgctgtgtaacatcctagtgatcctctccgtagcctgtcaccgacacctgcactcagtcacgcactactacatcgtcaacctggcggtggccgacctcctgctcacctccacggtgctgcccttctccgccatcttcgaggtcctaggctactgggccttcggcagggtcttctgcaacatctgggcggcagtggatgtgctgtgctgcaccgcgtccatcatgggcctctgcatcatctccatcgaccgctacatcggcgtgacgtacccgctgcgctacccaaccatcgtcacccagaggaggggtctcatggctctgctctgcgtctgggcactctccctggtcatatccattggacccctgttcggctggaggcagccggcccccgaggacgagaccatctgccagatcaacgaggagccgggctacgtgctcttctcagcgctgggctccttctacctgcctctggccatcatcctggtcatgtactgccgcgtctacgtggtggccaagagggagagccggggcctcaagtctggcctcaagaccgacaagtcggactcggagcaagtgacgctccgcatccatcggaaaaacgccccggcaggaggcagcgggatggccagcgccaagaccaagacgcacttctcagtgaggctcctcaagttctcccgggagaagaaagcggccaaaacgctgggcatcgtggtcggctgcttcgtcctctgctggctgccttttttcttagtcatgcccattgggtctttcttccctgatttcaagccctctgaaacagtttttaaaatagtattttggctcggatatctaaacagctgcatcaaccccatcatatacccatgctccagccaagagttcaaaaaggcctttcagaatgtcttgagaatccagtgtctctgcagaaagcagtcttccaaacatgccctgggctaccccctgcacccgcccagccaggccgtggaagggcaacacaaggacatggtgcgcatccccgtgggatcaagagagaccttctacaggatctccaagacggatggcgtttgtgaatggaaatttttctcttccatgccccgtggatctgccaggattacagtgtccaaagaccaatcctcctgtaccacagcccgggtgagaagtaaaagctttttgcaggtctgctgctgtgtagggccctcaaccccctgccttgacaagaaccatcaagttccaaccattaaggtccacaccatctccctcagtgagaacggggaggaagtctag

SEQ ID NO: 904 - DNA, 1563 bp, Homo sapiens
atgaatcccgacctggacaccggccacaacacatcagcacctgcccactggggagagttgaaaaatgccaacttcactggccccaaccagacctcgagcaactccacactgccccagctggacatcaccagggccatctctgtgggcctggtgctgggcgccttcatcctctttgccatcgtgggcaacatcctagtcatcttgtctgtggcctgcaaccggcacctgcggacgcccaccaactacttcattgtcaacctggccatggccgacctgctgttgagcttcaccgtcctgcccttctcagcggccctagaggtgctcggctactgggtgctggggcggatcttctgtgacatctgggcagccgtggatgtcctgtgctgcacagcgtccattctgagcctgtgcgccatctccatcgatcgctacatcggggtgcgctactctctgcagtatcccacgctggtcacccggaggaaggccatcttggcgctgctcagtgtctgggtcttgtccaccgtcatctccatcgggcctctccttgggtggaaggagccggcacccaacgatgacaaggagtgcggggtcaccgaagaacccttctatgccctcttctcctctctgggctccttctacatccctctggcggtcattctagtcatgtactgccgtgtctatatagtggccaagagaaccaccaagaacctagaggcaggagtcatgaaggagatgtccaactccaaggagctgaccctgaggatccattccaagaactttcacgaggacacccttagcagtaccaaggccaagggccacaaccccaggagttccatagctgtcaaactttttaagttctccagggaaaagaaagcagctaagacgttgggcattgtggtcggtatgttcatcttgtgctggctacccttcttcatcgctctaccgcttggctccttgttctccaccctgaagccccccgacgccgtgttcaaggtggtgttctggctgggctacttcaacagctgcctcaaccccatcatctacccatgctccagcaaggagttcaagcgcgctttcgtgcgcatcctcgggtgccagtgccgcggccgcggccgccgccgacgccgccgccgccgtcgcctgggcggctgcgcctacacctaccggccgtggacgcgcggcggctcgctggagcgctcgcagtcgcgcaaggactcgctggacgacagcggcagctgcctgagcggcagccagcggaccctgccctcggcctcgccgagcccgggctacctgggccgcggcgcgccaccgccagtcgagctgtgcgccttccccgagtggaaggcgcccggcgccctcctgagcctgcccgcgcctgagccccccggccgccgcggccgccacgactcgggcccgctcttcaccttcaagctcctgaccgagcccgagagccccgggaccgacggcggcgccagcaacggaggctgcgaggccgcggccgacgtggccaacgggcagccgggcttcaaaagcaacatgcccctggcgcccgggcagttttag

SEQ ID NO: 905 - DNA, 1719 bp, Homo sapiens
atgactttccgcgatctcctgagcgtcagtttcgagggaccccgcccggacagcagcgcagggggctccagcgcgggcggcggcgggggcagcgcgggcggcgcggccccctcggagggcccggcggtgggcggcgtgccggggggcgcgggcggcggcggcggcgtggtgggcgcaggcagcggcgaggacaaccggagctccgcgggggagccggggagcgcgggcgcgggcggcgacgtgaatggcacggcggccgtcgggggactggtggtgagcgcgcagggcgtgggcgtgggcgtcttcctggcagccttcatccttatggccgtggcaggtaacctgcttgtcatcctctcagtggcctgcaaccgccacctgcagaccgtcaccaactatttcatcgtgaacctggccgtggccgacctgctgctgagcgccaccgtactgcccttctcggccaccatggaggttctgggcttctgggcctttggccgcgccttctgcgacgtatgggccgccgtggacgtgctgtgctgcacggcctccatcctcagcctctgcaccatctccgtggaccggtacgtgggcgtgcgccactcactcaagtacccagccatcatgaccgagcgcaaggcggccgccatcctggccctgctctgggtcgtagccctggtggtgtccgtagggcccctgctgggctggaaggagcccgtgccccctgacgagcgcttctgcggtatcaccgaggaggcgggctacgctgtcttctcctccgtgtgctccttctacctgcccatggcggtcatcgtggtcatgtactgccgcgtgtacgtggtcgcgcgcagcaccacgcgcagcctcgaggcaggcgtcaagcgcgagcgaggcaaggcctccgaggtggtgctgcgcatccactgtcgcggcgcggccacgggcgccgacggggcgcacggcatgcgcagcgccaagggccacaccttccgcagctcgctctccgtgcgcctgctcaagttctcccgtgagaagaaagcggccaagactctggccatcgtcgtgggtgtcttcgtgctctgctggttccctttcttctttgtcctgccgctcggctccttgttcccgcagctgaagccatcggagggcgtcttcaaggtcatcttctggctcggctacttcaacagctgcgtgaacccgctcatctacccctgttccagccgcgagttcaagcgcgccttcctccgtctcctgcgctgccagtgccgtcgtcgccggcgccgccgccctctctggcgtgtctacggccaccactggcgggcctccaccagcggcctgcgccaggactgcgccccgagttcgggcgacgcgccccccggagcgccgctggccctcaccgcgctccccgaccccgaccccgaacccccaggcacgcccgagatgcaggctccggtcgccagccgtcgaaagccacccagcgccttccgcgagtggaggctgctggggccgttccggagacccacgacccagctgcgcgccaaagtctccagcctgtcgcacaagatccgcgccgggggcgcgcagcgcgcagaggcagcgtgcgcccagcgctcagaggtggaggctgtgtccctaggcgtcccacacgaggtggccgagggcgccacctgccaggcctacgaattggccgactacagcaacctacgggagaccgatatttaa

SEQ ID NO: 906 - DNA, 3653 bp, Homo sapiens
gcgctcggcgcccaccaggcggacgcccaggagaacccctgcctccgtcgcggctcctggagagctgatcgttcacctgccccggcccgcctgaggacgggggtgccttcatgcggcccccacactcctcaccccgccgccgccgccgtccccgagctccgcacagtgcgccccagccccagcagggcgcacaactttggaagtctcgcggcgctccgagaggcggcagagtccgcgccccagccccgggccgggccgggccagaaccgcagcgtctgggggaagccagagagtcggtaatcgcttcggggatgtaaggcgacagacataggacccccgagctcgcatcagcacccttcggctgcctcccggggtgggggcgggccccgcacacggtaagacctcttgctttcgctcaggctcaagattcaagatacagatattgatatgtatatatatatttaatttcctgtcatccttccaagttatcaggccaccgatgatttttgttctcccttcttgaagaataaatctctctttacccatcggctctccctactctctcccgccgcttagaaataaaacttggctgtattaggagctcggagcaagaaggcgcccaccgagagcgtctgaagcgcgagccaggcgcagttcgcgggacccgggccatgggccgctagcggtcctccagttcgggcccggcctccctgcggccccctccctatgtgagccgcagccaggcgagcggggcgccggaggaagaggaggacccacgggcgccgggccggaaggcagctggcagcaggcccaggccagcgggcgcccgcgttcatgttccgccaggagcagccgttggccgagggcagctttgcgcccatgggctccctgcagccggacgcgggcaacgcgagctggaacgggaccgaggcgccggggggcggcgcccgggccaccccttactccctgcaggtgacgctgacgctggtgtgcctggccggcctgctcatgctgctcaccgtgttcggcaacgtgctcgtcatcatcgccgtgttcacgagccgcgcgctcaaggcgccccaaaacctcttcctggtgtctctggcctcggccgacatcctggtggccacgctcgtcatccctttctcgctggccaacgaggtcatgggctactggtacttcggcaaggcttggtgcgagatctacctggcgctcgacgtgctcttctgcacgtcgtccatcgtgcacctgtgcgccatcagcctggaccgctactggtccatcacacaggccatcgagtacaacctgaagcgcacgccgcgccgcatcaaggccatcatcatcaccgtgtgggtcatctcggccgtcatctccttcccgccgctcatctccatcgagaagaagggcggcggcggcggcccgcagccggccgagccgcgctgcgagatcaacgaccagaagtggtacgtcatctcgtcgtgcatcggctccttcttcgctccctgcctcatcatgatcctggtctacgtgcgcatctaccagatcgccaagcgtcgcacccgcgtgccacccagccgccggggtccggacgccgtcgccgcgccgccggggggcaccgagcgcaggcccaacggtctgggccccgagcgcagcgcgggcccggggggcgcagaggccgaaccgctgcccacccagctcaacggcgcccctggcgagcccgcgccggccgggccgcgcgacaccgacgcgctggacctggaggagagctcgtcttccgaccacgccgagcggcctccagggccccgcagacccgagcgcggtccccggggcaaaggcaaggcccgagcgagccaggtgaagccgggcgacagcctgccgcggcgcgggccgggggcgacggggatcgggacgccggctgcagggccgggggaggagcgcgtcggggctgccaaggcgtcgcgctggcgcgggcggcagaaccgcgagaagcgcttcacgttcgtgctggccgtggtcatcggagtgttcgtggtgtgctggttccccttcttcttcacctacacgctcacggccgtcgggtgctccgtgccacgcacgctcttcaaattcttcttctggttcggctactgcaacagctcgttgaacccggtcatctacaccatcttcaaccacgatttccgccgcgccttcaagaagatcctctgtcggggggacaggaagcggatcgtgtgaggtttccgctggcgcccgcgtagactcacgctgactgcaggcagcggggggcatcgaggggtgcttagccccagggcactcagaaacccgggcgctgcctgctctgcgtttcctcgtctggggtggctctgcagcctcctgcgggcgggcgtctgctgctcctacaagggaagcttcttgctgccaggcccacacatccccagttgttggtttggccactcttgacctggagccatcttcctagtgggccacccctaatcactattgcttcctaaaggtattttcaccctcttcgcctggtacagccctcacagctcttcagagcaagcactggactacaagggcatggctcacaaaaggttaatggatgggggttacctagccctggctaattccccttccattcccaactctctctctctttttgaagaaaaatgctaagggcagccctgcctgccctccccatcccccgctgtaaatatacactatttttgatagcacacatggggcccccatatctcttggccttggttttgatgttgaaatcctggccttgggagagatgccttccaggcagacacagctgtctggttcaggccaagcccctttgcaatgcaagccctttctggtgttatgaagtccctctatgtcgtcgttttcaccagcaactggtgactgtcccttcgacacggacctgctttgagatttcctgacagggaaaagatttctgtccatttttttcctgtgcctaacagcataattgccttttcctatgtaaatattatgatggtggatcaagacataagtaaatgagcctttctgcctcacatcagccctgtgtataaagccattattctctgatgcactgtttgccccagtaactcactttaaaacctctctttccagtgttccctctctccctccagggccactgcttgaagaagaatatgtatgtttctatcttgtatgtctgtgtgcccctcctgccccgaaagtgctgactatggggaaatcttttagctgctgtttttagactccaaggagtggaaattatgtggaagaagcaaacctgatacaatttgcccaaggtaaacagtttgaaaagacaaatgggcctgccaaactgtacagtttcttccccaagagctgttaggtatcaaaatgttgtcctttcccccctccgtgcttttctggttgagatcatgtcattgatgaactgccaaagtcaggggaggagggcagagactttgtgtttacatctgcatttctacatgttttagacagagacaatttaaggcctgcactcttatttcactaaagaaaaactaatgtcagcacatgttgctaatgacagtggatttttttttaaataaaaaagtttacagatcaaatgtgaaataaatatgaatggagtggtcaaa

SEQ ID NO: 907 - DNA, 3274 bp, Homo sapiens
atggaccaccaggacccctactccgtgcaggccacagcggccatagcggcggccatcaccttcctcattctctttaccatcttcggcaacgctctggtcatcctggctgtgttgaccagccgctcgctgcgcgcccctcagaacctgttcctggtgtcgctggccgccgccgacatcctggtggccacgctcatcatccctttctcgctggccaacgagctgctgggctactggtacttccggcgcacgtggtgcgaggtgtacctggcgctcgacgtgctcttctgcacctcgtccatcgtgcacctgtgcgccatcagcctggaccgctactgggccgtgagccgcgcgctggagtacaactccaagcgcaccccgcgccgcatcaagtgcatcatcctcactgtgtggctcatcgccgccgtcatctcgctgccgcccctcatctacaagggcgaccagggcccccagccgcgcgggcgcccccagtgcaagctcaaccaggaggcctggtacatcctggcctccagcatcggatctttctttgctccttgcctcatcatgatccttgtctacctgcgcatctacctgatcgccaaacgcagcaaccgcagaggtcccagggccaagggggggcctgggcagggtgagtccaagcagccccgacccgaccatggtggggctttggcctcagccaaactgccagccctggcctctgtggcttctgccagagaggtcaacggacactcgaagtccactggggagaaggaggagggggagacccctgaagatactgggacccgggccttgccacccagttgggctgcccttcccaactcaggccagggccagaaggagggtgtttgtggggcatctccagaggatgaagctgaagaggaggaagaggaggaggaggaggaggaagagtgtgaaccccaggcagtgccagtgtctccggcctcagcttgcagccccccgctgcagcagccacagggctcccgggtgctggccaccctacgtggccaggtgctcctgggcaggggcgtgggtgctataggtgggcagtggtggcgtcgaagggcgcacgtgacccgggagaagcgcttcaccttcgtgctggctgtggtcattggcgtttttgtgctctgctggttccccttcttcttcagctacagcctgggcgccatctgcccgaagcactgcaaggtgccccatggcctcttccagttcttcttctggatcggctactgcaacagctcactgaaccctgttatctacaccatcttcaaccaggacttccgccgtgccttccggaggatcctgtgccgcccgtggacccagacggcctggtgagcccgcctgcgctgcccctgtggggttggtgcggtggcgccggggtcaccctgcttcttgccctgctgtgtgtggctgcctcccctgggctttctgctccctgcccagatcctgtaggcctcatcttaggaaccccttgggaggggtgggcaggggggctgctagcaagggtcccagtgaagcttccccttgccggcttagctgtgggggaccccttctccaccctctccctgagcacaggccgatggaggtggttcaaatcctctggaacatagccaagaccaggagaagagagagcactttcttcccagagccccatgctctccagaccaatgtctgggcttccctttcttgaggaccttgtgttcctggcaggtcacttgcttgtggtgttttcgtttctttttcatctcccccccacccacaaagagcacggagccagccttccacttttcccagtggggcctgctgctgagggggaggaagaaacgaagactgatcacccacgctaggcactcgcggtcccggcaggcgctgggatgggggcttatggggtggcatcgtctctgggccctcctttccccctttgcctgtttcggatctgtggttcctttgaaagccagaacaatggatcggcttccttacccagcacccctccggtaggtgggtggccacgtggatgcctcgctggggaggtcttggaggcctggtctctgcctcgacgggagatccccgatcactggcattcaccccctgcaaaaatcggggcgacaatagctcactgcctacttgctgcagggagatgaaaggctttgcagaaagctttgagctctgtgggggaacacactagagaaccaaaaatgtgattatatggtgatataaaaatccctttcctctgtgtttaccaccacctgtcttcctgtagacttttgttctgtccctggggtgtgtgaattcctaccccgaactggaagccgggagtggcagacagaatcactatttcaagttaaaggatctctttgagaatgtgttcttctggctgcaaaggtctgagttattacgctacatgacaacgtttcgacatttcaccggcaacaccaagagggtttttagtggcttgggtctccccagtgggggataagtcttttgtcatcaaggaggcaaattgtctccccaagacagctcaaaatatccacacctcggcaacagtctaagatgagagcctgtgacaggtggcagcgcccccaggtggggtactggcatcagagcctggtgcgcccctaggggagcctcccactggagtgcccggccaggtctccaagccccaaatgagtccttgtgaaccacaactgatccccccaggtgggtgcttgtggactgcctcggacccagccacgctgctccccgcaatgctgatggggctgtgcattgaggacccctgcttcctggttctcagtcccaccccaaaacctggcacccagaacagttggaagtgtggaaaggaggtttatcggccttcccttggagagggcctggcttcaacattgggccagtaggcatcttagcttggcaggtgtcgggggaatgggccagatggacctgctagatttggaagggcaccgagggagttttctgggtgtagagagaatggaggggaccaaaaagagtccttcctggggtgtgggaggcttcccagcttggtcctcagtgggttgttgaggccagagtatcgccctgggatgtggtggggagctgggccaggagagggactgactgtgaccctctgctggccggtcttgtgtgcgccccatgggacccccagtgttcttgcctgtgacctcttattgcgacatgcaggtggtgtttttttttttttttaaactctgagctattttatcaataaaggatattttgtaataag

SEQ ID NO: 908 - DNA, 1386 bp, Homo sapiens
atggcgtccccggcgctggcggcggcgctggcggtggcggcagcggcgggccccaatgcgagcggcgcgggcgagaggggcagcggcggggttgccaatgcctcgggggcttcctgggggccgccgcgcggccagtactcggcgggcgcggtggcagggctggctgccgtggtgggcttcctcatcgtcttcaccgtggtgggcaacgtgctggtggtgatcgccgtgctgaccagccgggcgctgcgcgcgccacagaacctcttcctggtgtcgctggcctcggccgacatcctggtggccacgctggtcatgcccttctcgttggccaacgagctcatggcctactggtacttcgggcaggtgtggtgcggcgtgtacctggcgctcgatgtgctgttttgcacctcgtcgatcgtgcatctgtgtgccatcagcctggaccgctactggtcggtgacgcaggccgtcgagtacaacctgaagcgcacaccacgccgcgtcaaggccaccatcgtcgccgtgtggctcatctcggccgtcatctccttcccgccgctggtctcgctctaccgccagcccgacggcgccgcctacccgcagtgcggcctcaacgacgagacctggtacatcctgtcctcctgcatcggctccttcttcgcgccctgcctcatcatgggcctggtctacgcgcgcatctaccgagtggccaagcgtcgcacgcgcacgctcagcgagaagcgcgcccccgtgggccccgacggtgcgtccccgactaccgaaaacgggctgggcgcggcggcaggcgaggcgagaacgggcactgcgcgcccccgcccgccgacgtggagccggacgagagcagcgcagcggccgagaggcggcgcgccggggccgttgcggcggggcgggcggcggcgagcgggcgcggaggggggcgcgggcggtgcggacgggcagggggcggggccgggggcggctcagtcgggggcgctgaccgcctccaggtccccggggcccggtggccgcctctcgcgcgccagctcgcgctccgtcgagttcttcctgtcgcgccggcgccgggcgcgcagcagcgtgtgccgccgcaaggtggcccaggcgcgcgagaagcgcttcacctttgtgctggctgtggtcatgggcgtgttcgtgctctgctggttccccttcttcttcatctacagcctgtacggcatctgccgcgaggcctgccaggtgcccggcccgctcttcaagttcttcttctggatcggctactgcaacagctcgctcaacccggtcatctacacggtcttcaaccaggatttccggccatccttcaagcacatcctcttccgacggaggagaaggggcttcaggcagtga

SEQ ID NO: 909 - DNA, 1434 bp, Homo sapiens
atgggcgcgggggtgctcgtcctgggcgcctccgagcccggtaacctgtcgtcggccgcaccgctccccgacggcgcggccaccgcggcgcggctgctggtgcccgcgtcgccgcccgcctcgttgctgcctcccgccagcgaaagccccgagccgctgtctcagcagtggacagcgggcatgggtctgctgatggcgctcatcgtgctgctcatcgtggcgggcaatgtgctggtgatcgtggccatcgccaagacgccgcggctgcagacgctcaccaacctcttcatcatgtccctggccagcgccgacctggtcatggggctgctggtggtgccgttcggggccaccatcgtggtgtggggccgctgggagtacggctccttcttctgcgagctgtggacctcagtggacgtgctgtgcgtgacggccagcatcgagaccctgtgtgtcattgccctggaccgctacctcgccatcacctcgcccttccgctaccagagcctgctgacgcgcgcgcgggcgcggggcctcgtgtgcaccgtgtgggccatctcggccctggtgtccttcctgcccatcctcatgcactggtggcgggcggagagcgacgaggcgcgccgctgctacaacgaccccaagtgctgcgacttcgtcaccaaccgggcctacgccatcgcctcgtccgtagtctccttctacgtgcccctgtgcatcatggccttcgtgtacctgcgggtgttccgcgaggcccagaagcaggtgaagaagatcgacagctgcgagcgccgtttcctcggcggcccagcgcggccgccctcgccctcgccctcgcccgtccccgcgcccgcgccgccgcccggacccccgcgccccgccgccgccgccgccaccgccccgctggccaacgggcgtgcgggtaagcggcggccctcgcgcctcgtggccctacgcgagcagaaggcgctcaagacgctgggcatcatcatgggcgtcttcacgctctgctggctgcccttcttcctggccaacgtggtgaaggccttccaccgcgagctggtgcccgaccgcctcttcgtcttcttcaactggctgggctacgccaactcggccttcaaccccatcatctactgccgcagccccgacttccgcaaggccttccagggactgctctgctgcgcgcgcagggctgcccgccggcgccacgcgacccacggagaccggccgcgcgcctcgggctgtctggcccggcccggacccccgccatcgcccggggccgcctcggacgacgacgacgacgatgtcgtcggggccacgccgcccgcgcgcctgctggagccctgggccggctgcaacggcggggcggcggcggacagcgactcgagcctggacgagccgtgccgccccggcttcgcctcggaatccaaggtgtag

SEQ ID NO: 910 - DNA, 1242 bp, Homo sapiens
atggggcaacccgggaacggcagcgccttcttgctggcacccaatggaagccatgcgccggaccacgacgtcacgcagcaaagggacgaggtgtgggtggtgggcatgggcatcgtcatgtctctcatcgtcctggccatcgtgtttggcaatgtgctggtcatcacagccattgccaagttcgagcgtctgcagacggtcaccaactacttcatcacttcactggcctgtgctgatctggtcatgggcctggcagtggtgccctttggggccgcccatattcttatgaaaatgtggacttttggcaacttctggtgcgagttttggacttccattgatgtgctgtgcgtcacggccagcattgagaccctgtgcgtgatcgcagtggatcgctactttgccattacttcacctttcaagtaccagagcctgctgaccaagaataaggcccgggtgatcattctgatggtgtggattgtgtcaggccttacctccttcttgcccattcagatgcactggtaccgggccacccaccaggaagccatcaactgctatgccaatgagacctgctgtgacttcttcacgaaccaagcctatgccattgcctcttccatcgtgtccttctacgttcccctggtgatcatggtcttcgtctactccagggtctttcaggaggccaaaaggcagctccagaagattgacaaatctgagggccgcttccatgtccagaaccttagccaggtggagcaggatgggcggacggggcatggactccgcagatcttccaagttctgcttgaaggagcacaaagccctcaagacgttaggcatcatcatgggcactttcaccctctgctggctgcccttcttcatcgttaacattgtgcatgtgatccaggataacctcatccgtaaggaagtttacatcctcctaaattggataggctatgtcaattctggtttcaatccccttatctactgccggagcccagatttcaggattgccttccaggagcttctgtgcctgcgcaggtcttctttgaaggcctatgggaatggctactccagcaacggcaacacaggggagcagagtggatatcacgtggaacaggagaaagaaaataaactgctgtgtgaagacctcccaggcacggaagactttgtgggccatcaaggtactgtgcctagcgataacattgattcacaagggaggaattgtagtacaaatgactcactgctgtaa

SEQ ID NO: 911 - DNA, 2644 bp, Homo sapiens
gctactcctcccccaagagcggtggcaccgagggagttggggtggggggaggctgagcgctctggctgggacagctagagaagatggcccaggctggggaagtcgctctcatgccttgctgtcccctcccctgagccaggtgatttgggagaccccctccttccttctttccctaccgccccacgcgcgacccggggatggctccgtggcctcacgagaacagctctcttgccccatggccggacctccccaccctggcgcccaataccgccaacaccagtgggctgccaggggttccgtgggaggcggccctagccggggccctgctggcgctggcggtgctggccaccgtgggaggcaacctgctggtcatcgtggccatcgcctggactccgagactccagaccatgaccaacgtgttcgtgacttcgctggccgcagccgacctggtgatgggactcctggtggtgccgccggcggccaccttggcgctgactggccactggccgttgggcgccactggctgcgagctgtggacctcggtggacgtgctgtgtgtgaccgccagcatcgaaaccctgtgcgccctggccgtggaccgctacctggctgtgaccaacccgctgcgttacggcgcactggtcaccaagcgctgcgcccggacagctgtggtcctggtgtgggtcgtgtcggccgcggtgtcgtttgcgcccatcatgagccagtggtggcgcgtaggggccgacgccgaggcgcagcgctgccactccaacccgcgctgctgtgccttcgcctccaacatgccctacgtgctgctgtcctcctccgtctccttctaccttcctcttctcgtgatgctcttcgtctacgcgcgggttttcgtggtggctacgcgccagctgcgcttgctgcgcggggagctgggccgctttccgcccgaggagtctccgccggcgccgtcgcgctctctggccccggccccggtggggacgtgcgctccgcccgaaggggtgcccgcctgcggccggcggcccgcgcgcctcctgcctctccgggaacaccgggccctgtgcaccttgggtctcatcatgggcaccttcactctctgctggttgcccttctttctggccaacgtgctgcgcgccctggggggcccctctctagtcccgggcccggctttccttgccctgaactggctaggttatgccaattctgccttcaacccgctcatctactgccgcagcccggactttcgcagcgccttccgccgtcttctgtgccgctgcggccgtcgcctgcctccggagccctgcgccgccgcccgcccggccctcttcccctcgggcgttcctgcggcccggagcagcccagcgcagcccaggctttgccaacggctcgacggggcttcttggggagtttcttaggcctgaaggacaagaagcaacaactctgttgatcagaacctgtggaaaacctctggcctctgttcagaatgagtcccatgggattccccggctgtgacactctaccctccagaacctgacgactgggccatgtgacccaaggagggatccttaccaagtgggttttcaccatcctcttgctctctgtctgagagatgttttctaaaccccagccttgaacttcactcctccctcagtggtagtgtccaggtgccgtggagcagcaggctggctttggtaggggcacccatcacccggcttgcctgtgcagtcagtgagtgcttagggcaaagagagctcccctggttccattccttctgccacccaaaccctgatgagaccttagtgttctccaggctctgtggcccaggctgagagcagcagggtagaaaagaccaagatttggggttttatctctggttcccttattactgctctcaagcagtggcctctctcactttagccatggaatggctccgatctacctcacagcagtgtcagaaggacttcgccagggttttgggagctccagggttcataagaaggtgaaccattagaacagatcccttcttttccttttgcaatcagataaataaatatcactgaatgcagttcatcctcggcccactttccctccgtttgttttcttttcataatccacttactcccttcccttctactctgcgctggcttttgacagaggcagtaaattaggcctaatcctcactcttttcttcctaatcttcatcaaacaaaaaatgaaaagtctgtctggacgaaggggagtgagcttgagcctttgatatcttgctcccccacccttcctgaaactcttgaaatccagttgccattgagtagcaaagccacgctccccacaggacttggacagagggcccacagggggatgggctggctgtggccaggtttagggcagggggcatttgtcccctccatgctataatccagtggtgccttacatggtgtgtgtgtgtgtgtgtgcgtgtgtgtgtgtgtgtgtgtgtctggaggcacaggcacaaagcattgcttgggttggtcaaatgtcttgtgtcataaatatattctgatgtttcccagcctttccacaacctctaccttcccactcaccttccccagctacaaaaatctgtattatcctcttaaagtaaaactggagttac

SEQ ID NO: 912 - DNA, 1080 bp, Homo sapiens
atgattctcaactcttctactgaagatggtattaaaagaatccaagatgattgtcccaaagctggaaggcataattacatatttgtcatgattcctactttatacagtatcatctttgtggtgggaatatttggaaacagcttggtggtgatagtcatttacttttatatgaagctgaagactgtggccagtgtttttcttttgaatttagcactggctgacttatgctttttactgactttgccactatgggctgtctacacagctatggaataccgctggccctttggcaattacctatgtaagattgcttcagccagcgtcagtttcaacctgtacgctagtgtgtttctactcacgtgtctcagcattgatcgatacctggctattgttcacccaatgaagtcccgccttcgacgcacaatgcttgtagccaaagtcacctgcatcatcatttggctgctggcaggcttggccagtttgccagctataatccatcgaaatgtatttttcattgagaacaccaatattacagtttgtgctttccattatgagtcccaaaattcaaccctcccgatagggctgggcctgaccaaaaatatactgggtttcctgtttccttttctgatcattcttacaagttatactcttatttggaaggccctaaagaaggcttatgaaattcagaagaacaaaccaagaaatgatgatatttttaagataattatggcaattgtgcttttctttttcttttcctggattccccaccaaatattcacttttctggatgtattgattcaactaggcatcatacgtgactgtagaattgcagatattgtggacacggccatgcctatcaccatttgtatagcttattttaacaattgcctgaatcctcttttttatggctttctggggaaaaaatttaaaagatattttctccagcttctaaaatatattcccccaaaagccaaatcccactcaaacctttcaacaaaaatgagcacgctttcctaccgcccctcagataatgtaagctcatccaccaagaagcctgcaccatgttttgaggttgagtga

SEQ ID NO: 913 - DNA, 1092 bp, Homo sapiens
atgaagggcaactccacccttgccactactagcaaaaacattaccagcggtcttcacttcgggcttgtgaacatctctggcaacaatgagtctaccttgaactgttcacagaaaccatcagataagcatttagatgcaattcctattctttactacattatatttgtaattggatttctggtcaatattgtcgtggttacactgttttgttgtcaaaagggtcctaaaaaggtttctagcatatacatcttcaacctcgctgtggctgatttactccttttggctactcttcctctatgggcaacctattattcttatagatatgactggctctttggacctgtgatgtgcaaagtttttggttcttttcttaccctgaacatgtttgcaagcattttttttatcacctgcatgagtgttgataggtaccaatctgtcatctacccctttctgtctcaaagaagaaatccctggcaagcatcttatatagttccccttgtttggtgtatggcctgtttgtcctcattgccaacattttattttcgagacgtcagaaccattgaatacttaggagtgaatgcttgcattatggctttcccacctgagaaatatgcccaatggtcagctgggattgccttaatgaaaaatatccttggttttattatccctttaatattcatagcaacatgctattttggaattagaaaacacttactgaagacgaatagctatgggaagaacaggataacccgtgaccaagtcctgaagatggcagctgctgttgttctggccttcatcatttgctggcttcccttccatgttctgaccttcctggatgctctggcctggatgggtgtcattaatagctgcgaagttatagcagtcattgacctggcacttccttttgccatcctcttgggattcaccaacagctgcgttaatccgtttctgtattgttttgttggaaaccggttccaacagaagctccgcagtgtgtttagggttccaattacttggctccaagggaaaagagagagtatgtcttgccggaaaagcagttctcttagagaaatggagacctttgtgtcttaa

SEQ ID NO: 914 - DNA, 1143 bp, Homo sapiens
atggaggaaggtggtgattttgacaactactatggggcagacaaccagtctgagtgtgagtacacagactggaaatcctcgggggccctcatccctgccatctacatgttggtcttcctcctgggcaccacgggaaacggtctggtgctctggaccgtgtttcggagcagccgggagaagaggcgctcagctgatatcttcattgctagcctggcggtggctgacctgaccttcgtggtgacgctgcccctgtgggctacctacacgtaccgggactatgactggccctttgggaccttcttctgcaagctcagcagctacctcatcttcgtcaacatgtacgccagcgtcttctgcctcaccggcctcagcttcgaccgctacctggccatcgtgaggccagtggccaatgctcggctgaggctgcgggtcagcggggccgtggccacggcagttctttgggtgctggccgccctcctggccatgcctgtcatggtgttacgcaccaccggggacttggagaacaccactaaggtgcagtgctacatggactactccatggtggccactgtgagctcagagtgggcctgggaggtgggccttggggtctcgtccaccaccgtgggctttgtggtgcccttcaccatcatgctgacctgttacttcttcatcgcccaaaccatcgctggccacttccgcaaggaacgcatcgagggcctgcggaagcggcgccggctgctcagcatcatcgtggtgctggtggtgacctttgccctgtgctggatgccctaccacctggtgaagacgctgtacatgctgggcagcctgctgcactggccctgtgactttgacctcttcctcatgaacatcttcccctactgcacctgcatcagctacgtcaacagctgcctcaaccccttcctctatgcctttttcgacccccgcttccgccaggcctgcacctccatgctctgctgtggccagagcaggtgcgcaggcacctcccacagcagcagtggggagaagtcagccagctactcttcggggcacagccaggggcccggccccaacatgggcaagggtggagaacagatgcacgagaaatccatcccctacagccaggagacccttgtggttgactag

SEQ ID NO: 915 - DNA, 1257 bp, Homo sapiens
atgcgtctctccgccggtcccgacgcggggccctcgggcaactccagcccatggtggcctctggccaccggcgctggcaacacaagccgggaggccgaagccctcggggagggcaacggcccaccgagggacgtgcgcaacgaggagctggccaaactggagatcgccgtgctggcggtgactttcgcggtggccgtgctgggcaacagcagcgtactgctggctctgcaccggacgccgcgcaagacgtcccgcatgcacctcttcatccgacacctcagcctggccgacctggccgtggcattcttccaggtgctgccgcaaatgtgctgggacatcacctaccgcttccgcggccccgactggctgtgccgcgtggtgaagcacctgcaggtgttcggcatgtttgcgtcggcctacatgctggtagtcatgacagccgaccgctacatcgcggtgtgccacccgctcaagactctgcaacagcccgcgcgccgctcgcgcctcatgatcgcggccgcctgggtgctgagcttcgtgctgagcacgccgcagtacttcgtcttctccatgatcgaggtgaacaatgtcaccaaggcccgcgactgctgggccaccttcatccagccctggggttctcgtgcctacgtgacctggatgacgggcggcatctttgtggcgcccgtggtcatcttgggtacctgctacggcttcatctgctacaacatctggtgcaacgtccgcgggaagacggcgtcgcgccagagcaagggtgcagagcaagcgggtgtggccttccaaaaggggttcctgctcgcaccctgtgtcagcagcgtgaagtccatttcccgggccaagatccgcacggtgaagatgacttttgtgatcgtgacggcttacatcgtctgctgggcgcctttcttcatcatccagatgtggtctgtctgggatcccatgtccgtctggaccgaatcggaaaaccctaccatcaccatcactgcattactgggttccttgaatagctgctgtaatccctggatatacatgttttttagtggccatctccttcaagactgtgttcaaagcttcccatgctgccaaaacatgaaggaaaaattcaacaaagaagatactgacagtatgagcagaagacagactttttattctaacaatcgaagcccaacaaacagtacgggtatgtggaaggactcgcctaaatcttccaagtccatcaaattcattcctgtttcaacttga

SEQ ID NO: 916 - DNA, 1275 bp, Homo sapiens
atggattctgggcctctgtgggatgccaaccccacccctcggggcaccctctctgcccccaatgccacaacaccctggctgggccgggatgaggagctggccaaggtggagatcggagtcctggccactgtcctggtgctggcgaccgggggcaacctggctgtgctgctgaccctgggccagctgggccgcaagcgctcccgcatgcacctgttcgtgctgcacttagccctgacagacctggccgtggcgctcttccaggtgctgccacagctgctgtgggacatcacctaccgcttccagggccccgacctcctgtgcagggccgtcaagtacctgcaggtgctcagcatgtttgcctccacctacatgctgctggccatgacgctggaccgctacctggctgtctgtcaccccctgcgcagcctccagcagccaggccagtccacctacctgctcatcgctgctccctggctgctggccgccatcttcagcctccctcaagtcttcattttttccctgcgggaggtgatccagggctcaggggtgctggactgctgggcagacttcggcttcccttgggggccacgggcctacctcacctggaccaccctggctatcttcgttctgccggtgaccatgctcacggcctgctacagcctcatctgccatgagatctgtaaaaacctaaaagtcaagacacaggcctggcgggtgggaggagggggctggaggacttgggacaggccctcaccttccaccttagctgccaccactcgggggctgccatctcgggtcagcagcatcaacaccatctcacgggccaagatccgaacagtgaagatgacctttgtcatcgtgctggcctacatcgcttgctgggctcccttcttcagtgtccagatgtggtccgtgtgggacaagaatgcccctgatgaagattccaccaatgtggctttcaccatctctatgcttttgggcaacctcaacagctgctgcaacccctggatctacatgggcttcaacagccacctgttaccgcggcccctgcgtcaccttgcctgctgtgggggtccccagcccaggatgcgccggcggctctccgacggcagcctctcgagccgccacaccacgctgctgacccgctccagctgcccggccaccctcagcctcagcctcagcctaaccctcagtgggaggcccaggcctgaagagtcaccaagggacttggagctggcagatggggaaggcaccgctgagaccatcatcttttag

SEQ ID NO: 917 - DNA, 1116 bp, Homo sapiens
atgctcatggcgtccaccacttccgctgtgcctgggcatccctctctgcccagcctgcccagcaacagcagccaggagaggccactggacacccgggacccgctgctagcccgggcggagctggcgctgctctccatagtctttgtggctgtggccctgagcaatggcctggtgctggcggccctagctcggcggggccggcggggccactgggcacccatacacgtcttcattggccacttgtgcctggccgacctggccgtggctctgttccaagtgctgccccagctggcctggaaggccaccgaccgcttccgtgggccagatgccctgtgtcgggccgtgaagtatctgcagatggtgggcatgtatgcctcctcctacatgatcctggccatgacgctggaccgccaccgtgccatctgccgtcccatgctggcgtaccgccatggaagtggggctcactggaaccggccggtgctagtggcttgggccttctcgctccttctcagcctgccccagctcttcatcttcgcccagcgcaacgtggaaggtggcagcggggtcactgactgctgggcctgctttgcggagccctggggccgtcgcacctatgtcacctggattgccctgatggtgttcgtggcacctaccctgggtatcgccgcctgccaggtgctcatcttccgggagattcatgccagtctggtgccagggccatcagagaggcctggggggcgccgcaggggacgccggacaggcagccccggtgagggagcccacgtgtcagcagctgtggccaagactgtgaggatgacgctagtgattgtggtcgtctatgtgctgtgctgggcacccttcttcctggtgcagctgtgggccgcgtgggacccggaggcacctctggaaggggcgccctttgtgctactcatgttgctggccagcctcaacagctgcaccaacccctggatctatgcatctttcagcagcagcgtgtcctcagagctgcgaagcttgctctgctgtgcccggggacgcaccccacccagcctgggtccccaagatgagtcctgcaccaccgccagctcctccctggccaaggacacttcatcgtga

SEQ ID NO: 918 - DNA, 1062 bp, Homo sapiens
atggcatcatcctggccccctctagagctccaatcctccaaccagagccagctcttccctcaaaatgctacggcctgtgacaatgctccagaagcctgggacctgctgcacagagtgctgccgacatttatcatctccatctgtttcttcggcctcctagggaacctttttgtcctgttggtcttcctcctgccccggcggcaactgaacgtggcagaaatctacctggccaacctggcagcctctgatctggtgtttgtcttgggcttgcccttctgggcagagaatatctggaaccagtttaactggcctttcggagccctcctctgccgtgtcatcaacggggtcatcaaggccaatttgttcatcagcatcttcctggtggtggccatcagccaggaccgctaccgcgtgctggtgcaccctatggccagcggaaggcagcagcggcggaggcaggcccgggtcacctgcgtgctcatctgggttgtggggggcctcttgagcatccccacattcctgctgcgatccatccaagccgtcccagatctgaacatcaccgcctgcatcctgctcctcccccatgaggcctggcactttgcaaggattgtggagttaaatattctgggtttcctcctaccactggctgcgatcgtcttcttcaactaccacatcctggcctccctgcgaacgcgggaggaggtcagcaggacaagagtgcgggggccgaaggatagcaagaccacagcgctgatcctcacgctcgtggttgccttcctggtctgctgggccccttaccacttctttgccttcctggaattcttattccaggtgcaagcagtccgaggctgcttttgggaggacttcattgacctgggcctgcaattggccaacttctttgccttcactaacagctccctgaatccagtaatttatgtctttgtgggccggctcttcaggaccaaggtctgggaactttataaacaatgcacccctaaaagtcttgctccaatatcttcatcccataggaaagaaatcttccaacttttctggcggaattaa

SEQ ID NO: 919 - DNA, 1176 bp, Homo sapiens
atgttctctccctggaagatatcaatgtttctgtctgtttgtgaggactccgtgcccaccacggcctctttcagcgccgacatgctcaatgtcaccttgcaagggcccactcttaacgggacctttgcccagagcaaatgcccccaagtggagtggctgggctggctcaacaccatccagccccccttcctctgggtgctgttcgtgctggccaccctagagaacatctttgtcctcagcgtcttctgcctgcacaagagcagctgcacggtggcagagatctacctggggaacctggccgcagcagacctgatcctggcctgcgggctgcccttctgggccatcaccatctccaacaacttcgactggctctttggggagacgctctgccgcgtggtgaatgccattatctccatgaacctgtacagcagcatctgtttcctgatgctggtgagcatcgaccgctacctggccctggtgaaaaccatgtccatgggccggatgcgcggcgtgcgctgggccaagctctacagcttggtgatctgggggtgtacgctgctcctgagctcacccatgctggtgttccggaccatgaaggagtacagcgatgagggccacaacgtcaccgcttgtgtcatcagctacccatccctcatctgggaagtgttcaccaacatgctcctgaatgtcgtgggcttcctgctgcccctgagtgtcatcaccttctgcacgatgcagatcatgcaggtgctgcggaacaacgagatgcagaagttcaaggagatccagacggagaggagggccacggtgctagtcctggttgtgctgctgctattcatcatctgctggctgcccttccagatcagcaccttcctggatacgctgcatcgcctcggcatcctctccagctgccaggacgagcgcatcatcgatgtaatcacacagatcgcctccttcatggcctacagcaacagctgcctcaacccactggtgtacgtgatcgtgggcaagcgcttccgaaagaagtcttgggaggtgtaccagggagtgtgccagaaagggggctgcaggtcagaacccattcagatggagaactccatgggcacactgcggacctccatctccgtggaacgccagattcacaaactgcaggactgggcagggagcagacagtga

SEQ ID NO: 920 - DNA, 1119 bp, Homo sapiens
atgaactacccgctaacgctggaaatggacctcgagaacctggaggacctgttctgggaactggacagattggacaactataacgacacctccctggtggaaaatcatctctgccctgccacagagggtcccctcatggcctccttcaaggccgtgttcgtgcccgtggcctacagcctcatcttcctcctgggcgtgatcggcaacgtcctggtgctggtgatcctggagcggcaccggcagacacgcagttccacggagaccttcctgttccacctggccgtggccgacctcctgctggtcttcatcttgccctttgccgtggccgagggctctgtgggctgggtcctggggaccttcctctgcaaaactgtgattgccctgcacaaagtcaacttctactgcagcagcctgctcctggcctgcatcgccgtggaccgctacctggccattgtccacgccgtccatgcctaccgccaccgccgcctcctctccatccacatcacctgtgggaccatctggctggtgggcttcctccttgccttgccagagattctcttcgccaaagtcagccaaggccatcacaacaactccctgccacgttgcaccttctcccaagagaaccaagcagaaacgcatgcctggttcacctcccgattcctctaccatgtggcgggattcctgctgcccatgctggtgatgggctggtgctacgtgggggtagtgcacaggttgcgccaggcccagcggcgccctcagcggcagaaggcagtcagggtggccatcctggtgacaagcatcttcttcctctgctggtcaccctaccacatcgtcatcttcctggacaccctggcgaggctgaaggccgtggacaatacctgcaagctgaatggctctctccccgtggccatcaccatgtgtgagttcctgggcctggcccactgctgcctcaaccccatgctctacactttcgccggcgtgaagttccgcagtgacctgtcgcggctcctgaccaagctgggctgtaccggccctgcctccctgtgccagctcttccctagctggcgcaggagcagtctctctgagtcagagaatgccacctctctcaccacgttctag

SEQ ID NO: 921 - DNA, 1200 bp, Homo sapiens
atggctcaaaggcagcctcactcacctaatcagactttaatttcaatcacaaatgacacagaatcatcaagctctgtggtttctaacgataacacaaataaaggatggagcggggacaactctccaggaatagaagcattgtgtgccatctatattacttatgctgtgatcatttcagtgggcatccttggaaatgctattctcatcaaagtctttttcaagaccaaatccatgcaaacagttccaaatattttcatcaccagcctggcttttggagatcttttacttctgctaacttgtgtgccagtggatgcaactcactaccttgcagaaggatggctgttcggaagaattggttgtaaggtgctctctttcatccggctcacttctgttggtgtgtcagtgttcacattaacaattctcagcgctgacagatacaaggcagttgtgaagccacttgagcgacagccctccaatgccatcctgaagacttgtgtaaaagctggctgcgtctggatcgtgtctatgatatttgctctacctgaggctatattttcaaatgtatacacttttcgagatcccaataaaaatatgacatttgaatcatgtacctcttatcctgtctctaagaagctcttgcaagaaatacattctctgctgtgcttcttagtgttctacattattccactctctattatctctgtctactattccttgattgctaggaccctttacaaaagcaccctgaacatacctactgaggaacaaagccatgcccgtaagcagattgaatcccgaaagagaattgccagaacggtattggtgttggtggctctgtttgccctctgctggttgccaaatcacctcctgtacctctaccattcattcacttctcaaacctatgtagacccctctgccatgcatttcattttcaccattttctctcgggttttggctttcagcaattcttgcgtaaacccctttgctctctactggctgagcaaaagcttccagaagcattttaaagctcagttgttctgttgcaaggcggagcggcctgagcctcctgttgctgacacctctcttaccaccctggctgtgatgggaacggtcccgggcactgggagcatacagatgtctgaaattagtgtgacctcgttcactgggtgtagtgtgaagcaggcagaggacagattctag

SEQ ID NO: 922 - DNA, 1449 bp, Homo sapiens
atggcgtctttctctgctgagaccaattcaactgacctactctcacagccatggaatgagcccccagtaattctctccatggtcattctcagccttacttttttactgggattgccaggcaatgggctggtgctgtgggtggctggcctgaagatgcagcggacagtgaacacaatttggttcctccacctcaccttggcggacctcctctgctgcctctccttgcccttctcgctggctcacttggctctccagggacagtggccctacggcaggttcctatgcaagctcatcccctccatcattgtcctcaacatgtttgccagtgtcttcctgcttactgccattagcctggatcgctgtcttgtggtattcaagccaatctggtgtcagaatcatcgcaatgtagggatggcctgctctatctgtggatgtatctgggtggtggcttttgtgatgtgcattcctgtgttcgtgtaccgggaaatcttcactacagacaaccataatagatgtggctacaaatttggtctctccagctcattagattatccagacttttatggagatccactagaaaacaggtctcttgaaaacattgttcagcggcctggagaaatgaatgataggttagatccttcctctttccaaacaaatgatcatccttggacagtccccactgtcttccaacctcaaacatttcaaagaccttctgcagattcactccctaggggttctgctaggttaacaagtcaaaatctgtattctaatgtatttaaacctgctgatgtggtctcacctaaaatccccagtgggtttcctattgaagatcacgaaaccagcccactggataactctgatgcttttctctctactcatttaaagctgttccctagcgcttctagcaattccttctacgagtctgagctaccacaaggtttccaggattattacaatttaggccaattcacagatgacgatcaagtgccaacacccctcgtggcaataacgatcactaggctagtggtgggtttcctgctgccctctgttatcatgatagcctgttacagcttcattgtcttccgaatgcaaaggggccgcttcgccaagtctcagagcaaaacctttcgagtggccgtggtggtggtggctgtctttcttgtctgctggactccataccacatttttggagtcctgtcattgcttactgacccagaaactcccttggggaaaactctgatgtcctgggatcatgtatgcattgctctagcatctgccaatagttgctttaatcccttcctttatgccctcttggggaaagattttaggaagaaagcaaggcagtccattcagggaattctggaggcagccttcagtgaggagctcacacgttccacccactgtccctcaaacaatgtcatttcagaaagaaatagtacaactgtgtga

SEQ ID NO: 923 - DNA, 1053 bp, Homo sapiens
atgaactccttcaattataccacccctgattatgggcactatgatgacaaggataccctggacctcaacacccctgtggataaaacttctaacacgctgcgtgttccagacatcctggccttggtcatctttgcagtcgtcttcctggtgggagtgctgggcaatgccctggtggtctgggtgacggcattcgaggccaagcggaccatcaatgccatctggttcctcaacttggcggtagccgacttcctctcctgcctggcgctgcccatcttgttcacgtccattgtacagcatcaccactggccctttggcggggccgcctgcagcatcctgccctccctcatcctgctcaacatgtacgccagcatcctgctcctggccaccatcagcgccgaccgctttctgctggtgtttaaacccatctggtgccagaacttccgaggggccggcttggcctggatcgcctgtgccgtggcttggggtttagccctgctgctgaccataccctccttcctgtaccgggtggtccgggaggagtactttccaccaaaggtgttgtgtggcgtggactacagccacgacaaacggcgggagcgagccgtggccatcgtccggctggtcctgggcttcctgtggcctctactcacgctcacgatttgttacactttcatcctgctccggacgtggagccgcagggccacgcggtccaccaagacactcaaggtggtggtggcagtggtggccagtttctttatcttctggttgccctaccaggtgacggggataatgatgtccttcctggagccatcgtcacccaccttcctgctgctgaataagctggactccctgtgtgtctcctttgcctacatcaactgctgcatcaaccccatcatctacgtggtggccggccagggcttccagggccgactgcggaaatccctccccagcctcctccggaacgtgttgactgaagagtccgtggttagggagagcaagtcattcacgcgctccacagtggacactatggcccagaagacccaggcagtgtag

SEQ ID NO: 924 - DNA, 1473 bp, Homo sapiens
atgaggttcacatttacaagccggtgcttggcactgtttcttcttctaaatcacccaaccccaattcttcctgccttttcaaatcaaacctatccaacaatagagcccaagccatttctttacgtcgtaggacgaaagaagatgatggatgcacagtacaaatgctatgaccgaatgcagcagttacccgcataccaaggagaaggtccatattgcaatcgcacctgggatggatggctgtgctgggatgacacaccggctggagtattgtcctatcagttctgcccagattattttccggattttgatccatcagaaaaggttacaaaatactgtgatgaaaaaggtgtttggtttaaacatcctgaaaacaatcgaacctggtccaactatactatgtgcaatgctttcactcctgagaaactgaagaatgcatatgttctgtactatttggctattgtgggtcattctttgtcaattttcaccctagtgatttccctggggattttcgtgtttttcagaaaattgacaactatttttcctttgaattggaaatataggaaggcattgagccttggctgccaaagggtaaccctgcacaagaacatgtttcttacttacattctgaattctatgattatcatcatccacctggttgaagtagtacccaatggagagctcgtgcgaagggacccggtgagctgcaagattttgcattttttccaccagtacatgatggcctgcaactatttctggatgctctgtgaagggatctatcttcatacactcattgtcgtggctgtgtttactgagaagcaacgcttgcggtggtattatctcttgggctgggggttcccgctggtgccaaccactatccatgctattaccagggccgtgtacttcaatgacaactgctggctgagtgtggaaacccatttgctttacataatccatggacctgtcatggcggcacttgtggtcaatttcttctttttgctcaacattgtccgggtgcttgtgaccaaaatgagggaaacccatgaggcggaatcccacatgtacctgaaggctgtgaaggccaccatgatccttgtgcccctgctgggaatccagtttgtcgtctttccctggagaccttccaacaagatgcttgggaagatatatgattacgtgatgcactctctgattcatttccagggcttctttgttgcgaccatctactgcttctgcaacaatgaggtccaaaccaccgtgaagcgccaatgggcccaattcaaaattcagtggaaccagcgttgggggaggcgcccctccaaccgctctgctcgcgctgcagccgctgctgcggaggctggcgacatcccaatttacatctgccatcaggagctgaggaatgaaccagccaacaaccaaggcgaggagagtgctgagatcatccctttgaatatcatagagcaagagtcatctgcttga

SEQ ID NO: 925 - DNA, 1386 bp, Homo sapiens
atggagaaaaagtgtaccctgtattttctggttctcttgcctttttttatgattcttgttacagcagaattagaagagagtcctgaggactcaattcagttgggagttactagaaataaaatcatgacagctcaatatgaatgttaccaaaagattatgcaagaccccattcaacaagcagaaggcgtttactgcaacagaacctgggatggatggctctgctggaacgatgttgcagcaggaactgaatcaatgcagctctgccctgattactttcaggactttgatccatcagaaaaagttacaaagatctgtgaccaagatggaaactggtttagacatccagcaagcaacagaacatggacaaattatacccagtgtaatgttaacacccacgagaaagtgaagactgcactaaatttgttttacctgaccataattggacacggattgtctattgcatcactgcttatctcgcttggcatattcttttatttcaagagcctaagttgccaaaggattaccttacacaaaaatctgttcttctcatttgtttgtaactctgttgtaacaatcattcacctcactgcagtggccaacaaccaggccttagtagccacaaatcctgttagttgcaaagtgtcccagttcattcatctttacctgatgggctgtaattacttttggatgctctgtgaaggcatttacctacacacactcattgtggtggccgtgtttgcagagaagcaacatttaatgtggtattattttcttggctggggatttccactgattcctgcttgtatacatgccattgctagaagcttatattacaatgacaattgctggatcagttctgatacccatctcctctacattatccatggcccaatttgtgctgctttactggtgaatctttttttcttgttaaatattgtacgcgttctcatcaccaagttaaaagttacacaccaagcggaatccaatctgtacatgaaagctgtgagagctactcttatcttggtgccattgcttggcattgaatttgtgctgattccatggcgacctgaaggaaagattgcagaggaggtatatgactacatcatgcacatccttatgcacttccagggtcttttggtctctaccattttctgcttctttaatggagaggttcaagcaattctgagaagaaactggaatcaatacaaaatccaatttggaaacagcttttccaactcagaagctcttcgtagtgcgtcttacacagtgtcaacaatcagtgatggtccaggttatagtcatgactgtcctagtgaacacttaaatggaaaaagcatccatgatattgaaaatgttctcttaaaaccagaaaatttatataattga

SEQ ID NO: 926 - DNA, 3237 bp, Homo sapiens
atggcattttatagctgctgctgggtcctcttggcactcacctggcacacctctgcctacgggccagaccagcgagcccaaaagaagggggacattatccttggggggctctttcctattcattttggagtagcagctaaagatcaagatctcaaatcaaggccggagtctgtggaatgtatcaggtataatttccgtgggtttcgctggttacaggctatgatatttgccatagaggagataaacagcagcccagcccttcttcccaacttgacgctgggatacaggatatttgacacttgcaacaccgtttctaaggccttggaagccaccctgagttttgttgctcaaaacaaaattgattctttgaaccttgatgagttctgcaactgctcagagcacattccctctacgattgctgtggtgggagcaactggctcaggcgtctccacggcagtggcaaatctgctggggctcttctacattccccaggtcagttatgcctcctccagcagactcctcagcaacaagaatcaattcaagtctttcctccgaaccatccccaatgatgagcaccaggccactgccatggcagacatcatcgagtatttccgctggaactgggtgggcacaattgcagctgatgacgactatgggcggccggggattgagaaattccgagaggaagctgaggaaagggatatctgcatcgacttcagtgaactcatctcccagtactctgatgaggaagagatccagcatgtggtagaggtgattcaaaattccacggccaaagtcatcgtggttttctccagtggcccagatcttgagcccctcatcaaggagattgtccggcgcaatatcacgggcaagatctggctggccagcgaggcctgggccagctcctccctgatcgccatgcctcagtacttccacgtggttggcggcaccattggattcgctctgaaggctgggcagatcccaggcttccgggaattcctgaagaaggtccatcccaggaagtctgtccacaatggttttgccaaggagttttgggaagaaacatttaactgccacctccaagaaggtgcaaaaggacctttacctgtggacacctttctgagaggtcacgaagaaagtggcgacaggtttagcaacagctcgacagccttccgacccctctgtacaggggatgagaacatcagcagtgtcgagaccccttacatagattacacgcatttacggatatcctacaatgtgtacttagcagtctactccattgcccacgccttgcaagatatatatacctgcttacctgggagagggctcttcaccaatggctcctgtgcagacatcaagaaagttgaggcgtggcaggtcctgaagcacctacggcatctaaactttacaaacaatatgggggagcaggtgacctttgatgagtgtggtgacctggtggggaactattccatcatcaactggcacctctccccagaggatggctccatcgtgtttaaggaagtcgggtattacaacgtctatgccaagaagggagaaagactcttcatcaacgaggagaaaatcctgtggagtgggttctccagggaggtgcccttctccaactgcagccgagactgcctggcagggaccaggaaagggatcattgagggggagcccacctgctgctttgagtgtgtggagtgtcctgatggggagtatagtgatgagacagatgccagtgcctgtaacaagtgcccagatgacttctggtccaatgagaaccacacctcctgcattgccaaggagatcgagtttctgtcgtggacggagccctttgggatcgcactcaccctctttgccgtgctgggcattttcctgacagcctttgtgctgggtgtgtttatcaagttccgcaacacacccattgtcaaggccaccaaccgagagctctcctacctcctcctcttctccctgctctgctgcttctccagctccctgttcttcatcggggagccccaggactggacgtgccgcctgcgccagccggcctttggcatcagcttcgtgctctgcatctcatgcatcctggtgaaaaccaaccgtgtcctcctggtgtttgaggccaagatccccaccagcttccaccgcaagtggtgggggctcaacctgcagttcctgctggttttcctctgcaccttcatgcagattgtcatctgtgtgatctggctctacaccgcgcccccctcaagctaccgcaaccaggagctggaggatgagatcatcttcatcacgtgccacgagggctccctcatggccctgggcttcctgatcggctacacctgcctgctggctgccatctgcttcttctttgccttcaagtcccggaagctgccggagaacttcaatgaagccaagttcatcaccttcagcatgctcatcttcttcatcgtctggatctccttcattccagcctatgccagcacctatggcaagtttgtctctgccgtagaggtgattgccatcctggcagccagctttggcttgctggcgtgcatcttcttcaacaagatctacatcattctcttcaagccatcccgcaacaccatcgaggaggtgcgttgcagcaccgcagctcacgctttcaaggtggctgcccgggccacgctgcgccgcagcaacgtctcccgcaagcggtccagcagccttggaggctccacgggatccaccccctcctcctccatcagcagcaagagcaacagcgaagacccattcccacagcccgagaggcagaagcagcagcagccgctggccctaacccagcaagagcagcagcagcagcccctgaccctcccacagcagcaacgatctcagcagcagcccagatgcaagcagaaggtcatctttggcagcggcacggtcaccttctcactgagctttgatgagcctcagaagaacgccatggcccacgggaattctacgcaccagaactccctggaggcccagaaaagcagcgatacgctgacccgacaccagccattactcccgctgcagtgcggggaaacggacttagatctgaccgtccaggaaacaggtctgcaaggacctgtgggtggagaccagcggccagaggtggaggaccctgaagagttgtccccagcacttgtagtgtccagttcacagagctttgtcatcagtggtggaggcagcactgttacagaaaacgtagtgaattcataa

SEQ ID NO: 927 - DNA, 1155 bp, Homo sapiens
atggccgccactgcctctccgcagccactcgccactgaggatgccgatgctgagaatagcagcttctattactatgactacctggatgaagtggccttcatgctctgcaggaaggatgcagtggtgtcctttggcaaagtcttcctcccagtcttctatagcctgatttttgtgttgggcctcagcgggaacctccttcttctcatggtcttgctccgttacgtgcctcgcaggcggatggttgagatctatctgctgaatctggccatctccaaccttctgtttctggtgacactgcccttctggggcatctccgtggcctggcattgggtcttcgggagtttcttgtgcaagatggtgagcactctttatactattaacttttacagtggcatctttttcattagctgcatgagcctggacaagtacctggagatcgttcatgctcagccctaccacaggctgaggacccgggccaagaacctgctccttgctaccatagtatgggctgtgtccctggccgtctccatccctgatatggtctttgtacagacacatgaaaatcccaagggtgtgtggaactgccacgcagatttcggcgggcatgggaccatttggaagctcttcctccgcttccagcagaacctcctagggtttctccttccactccttgccatgatcttcttctactcccgtattggttgtgtcttggtgaggctgaggcccgcaggccagggccgggctttaaaaatagctgcagccttggtggtggccttcttcgtgctatggttcccatacaatctcaccttgtttctgcatacgctgttggacctgcaagtattcgggaactgtgaggtcagccagcatctagactacgcactccaggtaacagagagcatcgccttccttcactgctgcttttcccccatcctgtatgccttctccagtcaccgcttccgccagtacctgaaggctttcctggctgccgtgcttggatggcacctggcacctggcactgcccaggcctcattatccagctgttctgagagcagcatacttactgcccttgaggaaatgactggcatgaatgaccttggagagaggcagtctgagaactaccctaacaaggaggatgtggggaataaatcagcctga

SEQ ID NO: 928 - DNA, 1287 bp, Homo sapiens
atggatgtggttgacagccttcttgtgaatggaagcaacatcactcctccctgtgaactcgggctcgaaaatgagacgcttttctgcttggatcagccccgtccttccaaagagtggcagccagcggtgcagattctcttgtactccttgatattcctgctcagcgtgctgggaaacacgctggtcatcaccgtgctgattcggaacaagcggatgcggacggtcaccaacatcttcctcctctccctggctgtcagcgacctcatgctctgtctcttctgcatgccgttcaacctcatccccaatctgctcaaggatttcatcttcgggagcgccgtttgcaagaccaccacctacttcatgggcacctctgtgagtgtatctacctttaatctggtagccatatctctagagagatatggtgcgatttgcaaacccttacagtcccgggtctggcagacaaaatcccatgctttgaaggtgattgctgctacctggtgcctttcctttaccatcatgactccgtaccccatttatagcaacttggtgccttttaccaaaaataacaaccagaccgcgaatatgtgccgctttctactgccaaatgatgttatgcagcagtcctggcacacattcctgttactcatcctctttcttattcctggaattgtgatgatggtggcatatggattaatctctttggaactctaccagggaataaaatttgaggctagccagaagaagtctgctaaagaaaggaaacctagcaccaccagcagcggcaaatatgaggacagcgatgggtgttacctgcaaaagaccaggcccccgaggaagctggagctccggcagctgtccaccggcagcagcagcagggccaaccgcatccggagtaacagctccgcagccaacctgatggccaagaaaagggtgatccgcatgctcatcgtcatcgtggtcctcttcttcttgtgctggatgcccatcttcagcgccaacgcctggcgggcctacgacaccgcctccgcagagcgccgcctctcaggaacccccatttccttcatcctcctcctgtcctacacctcctcctgcgtcaaccccatcatctactgcttcatgaacaaacgcttccgcctcggcttcatggccaccttcccctgctgccccaatcctggtcccccaggggcgaggggagaggtgggggaggaggaggaaggcgggaccacaggagcctctctgtccaggttctcgtacagccatatgagtgcctcggtgccaccccagtga

SEQ ID NO: 929 - DNA, 1344 bp, Homo sapiens
atggagctgctaaagctgaaccggagcgtgcagggaaccggacccgggccgggggcttccctgtgccgcccgggggcgcctctcctcaacagcagcagtgtgggcaacctcagctgcgagccccctcgcattcgcggagccgggacacgagaattggagctggccattagaatcactctttacgcagtgatcttcctgatgagcgttggaggaaatatgctcatcatcgtggtcctgggactgagccgccgcctgaggactgtcaccaatgccttcctcctctcactggcagtcagcgacctcctgctggctgtggcttgcatgcccttcaccctcctgcccaatctcatgggcacattcatctttggcaccgtcatctgcaaggcggtttcctacctcatgggggtgtctgtgagtgtgtccacgctaagcctcgtggccatcgcactggagcggtacagcgccatctgccgaccactgcaggcacgagtgtggcagacgcgctcccacgcggctcgcgtgattgtagccacgtggctgctgtccggactactcatggtgccctaccccgtgtacactgtcgtgcaaccagtggggcctcgtgtgctgcagtgcgtgcatcgctggcccagtgcgcgggtccgccagacctggtccgtactgctgcttctgctcttgttcttcatcccgggtgtggttatggccgtggcctacgggcttatctctcgcgagctctacttagggcttcgctttgacggcgacagtgacagcgacagccaaagcagggtccgaaaccaaggcgggctgccaggggctgttcaccagaacgggcgttgccggcctgagactggcgcggttggcgaagacagcgatggctgctacgtgcaacttccacgttcccggcctgccctggagctgacggcgctgacggctcctgggccgggatccggctcccggcccacccaggccaagctgctggctaagaagcgcgtggtgcgaatgttgctggtgatcgttgtgcttttttttctgtgttggttgccagtttatagtgccaacacgtggcgcgcctttgatggcccgggtgcacaccgagcactctcgggtgctcctatctccttcattcacttgctgagctacgcctcggcctgtgtcaaccccctggtctactgcttcatgcaccgtcgctttcgccaggcctgcctggaaacttgcgctcgctgctgcccccggcctccacgagctcgccccagggctcttcccgatgaggaccctcccactccctccattgcttcgctgtccaggcttagctacaccaccatcagcacactgggccctggctga

SEQ ID NO: 930 - DNA, 1068 bp, Homo sapiens
atggaaactccaaacaccacagaggactatgacacgaccacagagtttgactatggggatgcaactccgtgccagaaggtgaacgagagggcctttggggcccaactgctgccccctctgtactccttggtatttgtcattggcctggttggaaacatcctggtggtcctggtccttgtgcaatacaagaggctaaaaaacatgaccagcatctacctcctgaacctggccatttctgacctgctcttcctgttcacgcttcccttctggatcgactacaagttgaaggatgactgggtttttggtgatgccatgtgtaagatcctctctgggttttattacacaggcttgtacagcgagatctttttcatcatcctgctgacgattgacaggtacctggccatcgtccacgccgtgtttgccttgcgggcacggaccgtcacttttggtgtcatcaccagcatcatcatttgggccctggccatcttggcttccatgccaggcttatacttttccaagacccaatgggaattcactcaccacacctgcagccttcactttcctcacgaaagcctacgagagtggaagctgtttcaggctctgaaactgaacctctttgggctggtattgcctttgttggtcatgatcatctgctacacagggattataaagattctgctaagacgaccaaatgagaagaaatccaaagctgtccgtttgatttttgtcatcatgatcatcttttttctcttttggaccccctacaatttgactatacttatttctgttttccaagacttcctgttcacccatgagtgtgagcagagcagacatttggacctggctgtgcaagtgacggaggtgatcgcctacacgcactgctgtgtcaacccagtgatctacgccttcgttggtgagaggttccggaagtacctgcggcagttgttccacaggcgtgtggctgtgcacctggttaaatggctccccttcctctccgtggacaggctggagagggtcagctccacatctccctccacaggggagcatgaactctctgctgggttctga

SEQ ID NO: 931 - DNA, 1125 bp, Homo sapiens
atgctgtccacatctcgttctcggtttatcagaaataccaacgagagcggtgaagaagtcaccaccttttttgattatgattacggtgctccctgtcataaatttgacgtgaagcaaattggggcccaactcctgcctccgctctactcgctggtgttcatctttggttttgtgggcaacatgctggtcgtcctcatcttaataaactgcaaaaagctgaagtgcttgactgacatttacctgctcaacctggccatctctgatctgctttttcttattactctcccattgtgggctcactctgctgcaaatgagtgggtctttgggaatgcaatgtgcaaattattcacagggctgtatcacatcggttattttggcggaatcttcttcatcatcctcctgacaatcgatagatacctggctattgtccatgctgtgtttgctttaaaagccaggacggtcacctttggggtggtgacaagtgtgatcacctggttggtggctgtgtttgcttctgtcccaggaatcatctttactaaatgccagaaagaagattctgtttatgtctgtggcccttattttccacgaggatggaataatttccacacaataatgaggaacattttggggctggtcctgccgctgctcatcatggtcatctgctactcgggaatcctgaaaaccctgcttcggtgtcgaaacgagaagaagaggcatagggcagtgagagtcatcttcaccatcatgattgtttactttctcttctggactccctataacattgtcattctcctgaacaccttccaggaattcttcggcctgagtaactgtgaaagcaccagtcaactggaccaagccacgcaggtgacagagactcttgggatgactcactgctgcatcaatcccatcatctatgccttcgttggggagaagttcagaagcctttttcacatagctcttggctgtaggattgccccactccaaaaaccagtgtgtggaggtccaggagtgagaccaggaaagaatgtgaaagtgactacacaaggactcctcgatggtcgtggaaaaggaaagtcaattggcagagcccctgaagccagtcttcaggacaaagaaggagcctag

SEQ ID NO: 932 - DNA, 1068 bp, Homo sapiens
atgacaacctcactagatacagttgagacctttggtaccacatcctactatgatgacgtgggcctgctctgtgaaaaagctgataccagagcactgatggcccagtttgtgcccccgctgtactccctggtgttcactgtgggcctcttgggcaatgtggtggtggtgatgatcctcataaaatacaggaggctccgaattatgaccaacatctacctgctcaacctggccatttcggacctgctcttcctcgtcacccttccattctggatccactatgtcagggggcataactgggtttttggccatggcatgtgtaagctcctctcagggttttatcacacaggcttgtacagcgagatctttttcataatcctgctgacaatcgacaggtacctggccattgtccatgctgtgtttgcccttcgagcccggactgtcacttttggtgtcatcaccagcatcgtcacctggggcctggcagtgctagcagctcttcctgaatttatcttctatgagactgaagagttgtttgaagagactctttgcagtgctctttacccagaggatacagtatatagctggaggcatttccacactctgagaatgaccatcttctgtctcgttctccctctgctcgttatggccatctgctacacaggaatcatcaaaacgctgctgaggtgccccagtaaaaaaaagtacaaggccatccggctcatttttgtcatcatggcggtgtttttcattttctggacaccctacaatgtggctatccttctctcttcctatcaatccatcttatttggaaatgactgtgagcggagcaagcatctggacctggtcatgctggtgacagaggtgatcgcctactcccactgctgcatgaacccggtgatctacgcctttgttggagagaggttccggaagtacctgcgccacttcttccacaggcacttgctcatgcacctgggcagatacatcccattccttcctagtgagaagctggaaagaaccagctctgtctctccatccacagcagagccggaactctctattgtgttttag

SEQ ID NO: 933 - DNA, 1083 bp, Homo sapiens
atgaaccccacggatatagcagataccaccctcgatgaaagcatatacagcaattactatctgtatgaaagtatccccaagccttgcaccaaagaaggcatcaaggcatttggggagctcttcctgcccccactgtattccttggtttttgtatttggtctgcttggaaattctgtggtggttctggtcctgttcaaatacaagcggctcaggtccatgactgatgtgtacctgctcaaccttgccatctcggatctgctcttcgtgttttccctccctttttggggctactatgcagcagaccagtgggtttttgggctaggtctgtgcaagatgatttcctggatgtacttggtgggcttttacagtggcatattctttgtcatgctcatgagcattgatagatacctggcgatagtgcacgcggtgttttccttgagggcaaggaccttgacttatggggtcatcaccagtttggctacatggtcagtggctgtgttcgcctcccttcctggctttctgttcagcacttgttatactgagcgcaaccatacctactgcaaaaccaagtactctctcaactccacgacgtggaaggttctcagctccctggaaatcaacattctcggattggtgatccccttagggatcatgctgttttgctactccatgatcatcaggaccttgcagcattgtaaaaatgagaagaagaacaaggcggtgaagatgatctttgccgtggtggtcctcttccttgggttctggacaccttacaacatagtgctcttcctagagaccctggtggagctagaagtccttcaggactgcacctttgaaagatacttggactatgccatccaggccacagaaactctggcttttgttcactgctgccttaatcccatcatctacttttttctgggggagaaatttcgcaagtacatcctacagctcttcaaaacctgcaggggcctttttgtgctctgccaatactgtgggctcctccaaatttactctgctgacacccccagctcatcttacacgcagtccaccatggatcatgatcttcatgatgctctgtag

SEQ ID NO: 934 - DNA, 1056 bp, Homo sapiens
atggattatcaagtgtcaagtccaatctatgacatcaattattatacatcggagccctgccaaaaaatcaatgtgaagcaaatcgcagcccgcctcctgcctccgctctactcactggtgttcatctttggttttgtgggcaacatgctggtcatcctcatcctgataaactgcaaaaggctgaagagcatgactgacatctacctgctcaacctggccatctctgacctgtttttccttcttactgtccccttctgggctcactatgctgccgcccagtgggactttggaaatacaatgtgtcaactcttgacagggctctattttataggcttcttctctggaatcttcttcatcatcctcctgacaatcgataggtacctggctgtcgtccatgctgtgtttgctttaaaagccaggacggtcacctttggggtggtgacaagtgtgatcacttgggtggtggctgtgtttgcgtctctcccaggaatcatctttaccagatctcaaaaagaaggtcttcattacacctgcagctctcattttccatacagtcagtatcaattctggaagaatttccagacattaaagatagtcatcttggggctggtcctgccgctgcttgtcatggtcatctgctactcgggaatcctaaaaactctgcttcggtgtcgaaatgagaagaagaggcacagggctgtgaggcttatcttcaccatcatgattgtttattttctcttctgggctccctacaacattgtccttctcctgaacaccttccaggaattctttggcctgaataattgcagtagctctaacaggttggaccaagctatgcaggtgacagagactcttgggatgacgcactgctgcatcaaccccatcatctatgcctttgtcggggagaagttcagaaactacctcttagtcttcttccaaaagcacattgccaaacgcttctgcaaatgctgttctattttccagcaagaggctcccgagcgagcaagctcagtttacacccgatccactggggagcaggaaatatctgtgggcttg

SEQ ID NO: 935 - DNA, 1125 bp, Homo sapiens
atgagcggggaatcaatgaatttcagcgatgttttcgactccagtgaagattattttgtgtcagtcaatacttcatattactcagttgattctgagatgttactgtgctccttgcaggaggtcaggcagttctccaggctatttgtaccgattgcctactccttgatctgtgtctttggcctcctggggaatattctggtggtgatcacctttgctttttataagaaggccaggtctatgacagacgtctatctcttgaacatggccattgcagacatcctctttgttcttactctcccattctgggcagtgagtcatgccactggtgcgtgggttttcagcaatgccacgtgcaagttgctaaaaggcatctatgccatcaactttaactgcgggatgctgctcctgacttgcattagcatggaccggtacatcgccattgtacaggcgactaagtcattccggctccgatccagaacactaccgcgcagcaaaatcatctgccttgttgtgtgggggctgtcagtcatcatctccagctcaacttttgtcttcaaccaaaaatacaacacccaaggcagcgatgtctgtgaacccaagtaccagactgtctcggagcccatcaggtggaagctgctgatgttggggcttgagctactctttggtttctttatccctttgatgttcatgatattttgttacacgttcattgtcaaaaccttggtgcaagctcagaattctaaaaggcacaaagccatccgtgtaatcatagctgtggtgcttgtgtttctggcttgtcagattcctcataacatggtcctgcttgtgacggctgcaaatttgggtaaaatgaaccgatcctgccagagcgaaaagctaattggctatacgaaaactgtcacagaagtcctggctttcctgcactgctgcctgaaccctgtgctctacgcttttattgggcagaagttcagaaactactttctgaagatcttgaaggacctgtggtgtgtgagaaggaagtacaagtcctcaggcttctcctgtgccgggaggtactcagaaaacatttctcggcagaccagtgagaccgcagataacgacaatgcgtcgtccttcactatgtga

SEQ ID NO: 936 - DNA, 1137 bp, Homo sapiens
atggacctggggaaaccaatgaaaagcgtgctggtggtggctctccttgtcattttccaggtatgcctgtgtcaagatgaggtcacggacgattacatcggagacaacaccacagtggactacactttgttcgagtctttgtgctccaagaaggacgtgcggaactttaaagcctggttcctccctatcatgtactccatcatttgtttcgtgggcctactgggcaatgggctggtcgtgttgacctatatctatttcaagaggctcaagaccatgaccgatacctacctgctcaacctggcggtggcagacatcctcttcctcctgacccttcccttctgggcctacagcgcggccaagtcctgggtcttcggtgtccacttttgcaagctcatctttgccatctacaagatgagcttcttcagtggcatgctcctacttctttgcatcagcattgaccgctacgtggccatcgtccaggctgtctcagctcaccgccaccgtgcccgcgtccttctcatcagcaagctgtcctgtgtgggcatctggatactagccacagtgctctccatcccagagctcctgtacagtgacctccagaggagcagcagtgagcaagcgatgcgatgctctctcatcacagagcatgtggaggcctttatcaccatccaggtggcccagatggtgatcggctttctggtccccctgctggccatgagcttctgttaccttgtcatcatccgcaccctgctccaggcacgcaactttgagcgcaacaaggccatcaaggtgatcatcgctgtggtcgtggtcttcatagtcttccagctgccctacaatggggtggtcctggcccagacggtggccaacttcaacatcaccagtagcacctgtgagctcagtaagcaactcaacatcgcctacgacgtcacctacagcctggcctgcgtccgctgctgcgtcaaccctttcttgtacgccttcatcggcgtcaagttccgcaacgatctcttcaagctcttcaaggacctgggctgcctcagccaggagcagctccggcagtggtcttcctgtcggcacatccggcgctcctccatgagtgtggaggccgagaccaccaccaccttctccccatag

SEQ ID NO: 937 - DNA, 1068 bp, Homo sapiens
atggattatacacttgacctcagtgtgacaacagtgaccgactactactaccctgatatcttctcaagcccctgtgatgcggaacttattcagacaaatggcaagttgctccttgctgtcttttattgcctcctgtttgtattcagtcttctgggaaacagcctggtcatcctggtccttgtggtctgcaagaagctgaggagcatcacagatgtatacctcttgaacctggccctgtctgacctgctttttgtcttctccttcccctttcagacctactatctgctggaccagtgggtgtttgggactgtaatgtgcaaagtggtgtctggcttttattacattggcttctacagcagcatgtttttcatcaccctcatgagtgtggacaggtacctggctgttgtccatgccgtgtatgccctaaaggtgaggacgatcaggatgggcacaacgctgtgcctggcagtatggctaaccgccattatggctaccatcccattgctagtgttttaccaagtggcctctgaagatggtgttctacagtgttattcattttacaatcaacagactttgaagtggaagatcttcaccaacttcaaaatgaacattttaggcttgttgatcccattcaccatctttatgttctgctacattaaaatcctgcaccagctgaagaggtgtcaaaaccacaacaagaccaaggccatcaggttggtgctcattgtggtcattgcatctttacttttctgggtcccattcaacgtggttcttttcctcacttccttgcacagtatgcacatcttggatggatgtagcataagccaacagctgacttatgccacccatgtcacagaaatcatttcctttactcactgctgtgtgaaccctgttatctatgcttttgttggggagaagttcaagaaacacctctcagaaatatttcagaaaagttgcagccaaatcttcaactacctaggaagacaaatgcctagggagagctgtgaaaagtcatcatcctgccagcagcactcctcccgttcctccagcgtagactacattttgtga

SEQ ID NO: 938 - DNA, 1074 bp, Homo sapiens
atggctgatgactatggctctgaatccacatcttccatggaagactacgttaacttcaacttcactgacttctactgtgagaaaaacaatgtcaggcagtttgcgagccatttcctcccacccttgtactggctcgtgttcatcgtgggtgccttgggcaacagtcttgttatccttgtctactggtactgcacaagagtgaagaccatgaccgacatgttccttttgaatttggcaattgctgacctcctctttcttgtcactcttcccttctgggccattgctgctgctgaccagtggaagttccagaccttcatgtgcaaggtggtcaacagcatgtacaagatgaacttctacagctgtgtgttgctgatcatgtgcatcagcgtggacaggtacattgccattgcccaggccatgagagcacatacttggagggagaaaaggcttttgtacagcaaaatggtttgctttaccatctgggtattggcagctgctctctgcatcccagaaatcttatacagccaaatcaaggaggaatccggcattgctatctgcaccatggtttaccctagcgatgagagcaccaaactgaagtcagctgtcttgaccctgaaggtcattctggggttcttccttcccttcgtggtcatggcttgctgctataccatcatcattcacaccctgatacaagccaagaagtcttccaagcacaaagccctaaaagtgaccatcactgtcctgaccgtctttgtcttgtctcagtttccctacaactgcattttgttggtgcagaccattgacgcctatgccatgttcatctccaactgtgccgtttccaccaacattgacatctgcttccaggtcacccagaccatcgccttcttccacagttgcctgaaccctgttctctatgtttttgtgggtgagagattccgccgggatctcgtgaaaaccctgaagaacttgggttgcatcagccaggcccagtgggtttcatttacaaggagagagggaagcttgaagctgtcgtctatgttgctggagacaacctcaggagcactctccctctga

SEQ ID NO: 939 - DNA, 1053 bp, Homo sapiens
atggctttggagcagaaccagtcaacagattattattatgaggaaaatgaaatgaatggcacttatgactacagtcaatatgaactgatctgtatcaaagaagatgtcagagaatttgcaaaagttttcctccctgtattcctcacaatagttttcgtcattggacttgcaggcaattccatggtagtggcaatttatgcctattacaagaaacagagaaccaaaacagatgtgtacatcctgaatttggctgtagcagatttactccttctattcactctgcctttttgggctgttaatgcagttcatgggtgggttttagggaaaataatgtgcaaaataacttcagccttgtacacactaaactttgtctctggaatgcagtttctggcttgtatcagcatagacagatatgtggcagtaactaaagtccccagccaatcaggagtgggaaaaccatgctggatcatctgtttctgtgtctggatggctgccatcttgctgagcataccccagctggttttttatacagtaaatgacaatgctaggtgcattcccattttcccccgctacctaggaacatcaatgaaagcattgattcaaatgctagagatctgcattggatttgtagtaccctttcttattatgggggtgtgctactttatcacagcaaggacactcatgaagatgccaaacattaaaatatctcgacccctaaaagttctgctcacagtcgttatagttttcattgtcactcaactgccttataacattgtcaagttctgccgagccatagacatcatctactccctgatcaccagctgcaacatgagcaaacgcatggacatcgccatccaagtcacagaaagcatcgcactctttcacagctgcctcaacccaatcctttatgtttttatgggagcatctttcaaaaactacgttatgaaagtggccaagaaatatgggtcctggagaagacagagacaaagtgtggaggagtttccttttgattctgagggtcctacagagccaaccagtacttttagcatttaa

SEQ ID NO: 940 - DNA, 1002 bp, Homo sapiens
atggagtcctcaggcaacccagagagcaccacctttttttactatgaccttcagagccagccgtgtgagaaccaggcctgggtctttgctaccctcgccaccactgtcctgtactgcctggtgtttctcctcagcctagtgggcaacagcctggtcctgtgggtcctggtgaagtatgagagcctggagtccctcaccaacatcttcatcctcaacctgtgcctctcagacctggtgttcgcctgcttgttgcctgtgtggatctccccataccactggggctgggtgctgggagacttcctctgcaaactcctcaatatgatcttctccatcagcctctacagcagcatcttcttcctgaccatcatgaccatccaccgctacctgtcggtagtgagccccctctccaccctgcgcgtccccaccctccgctgccgggtgctggtgaccatggctgtgtgggtagccagcatcctgtcctccatcctcgacaccatcttccacaaggtgctttcttcgggctgtgattattccgaactcacgtggtacctcacctccgtctaccagcacaacctcttcttcctgctgtccctggggattatcctgttctgctacgtggagatcctcaggaccctgttccgctcacgctccaagcggcgccaccgcacggtcaagctcatcttcgccatcgtggtggcctacttcctcagctggggtccctacaacttcaccctgtttctgcagacgctgtttcggacccagatcatccggagctgcgaggccaaacagcagctagaatacgccctgctcatctgccgcaacctcgccttctcccactgctgctttaacccggtgctctatgtcttcgtgggggtcaagttccgcacacacctgaaacatgttctccggcagttctggttctgccggctgcaggcacccagcccagcctcgatcccccactcccctggtgccttcgcctatgagggcgcctccttctactga

SEQ ID NO: 941 - DNA, 2921 bp, Homo sapiens
agcctgtggagacgggacagccctgtcccactcactctttcccctgccgctcctgccggcagctccaaccatgggaggccgcgtctttctcgcattctgtgtctggctgactctgccgggagctgaaacccaggactccaggggctgtgcccggtggtgccctcagaactcctcgtgtgtcaatgccaccgcctgtcgctgcaatccagggttcagctctttttctgagatcatcaccaccccgacggagacttgtgacgacatcaacgagtgtgcaacaccgtcgaaagtgtcatgcggaaaattctcggactgctggaacacagaggggagctacgactgcgtgtgcagcccgggatatgagcctgtttctggggcaaaaacattcaagaatgagagcgagaacacctgtcaagatgtggacgagtgcagctccgggcagcatcagtgtgacagctccaccgtctgcttcaacaccgtgggttcatacagctgccgctgccgcccaggctggaagcccagacacggaatcccgaataaccaaaaggacactgtctgtgaagatatgactttctccacctggaccccgccccctggagtccacagccagacgctttcccgattcttcgacaaagtccaggacctgggcagagactccaagacaagctcagccgaggtcaccatccagaatgtcatcaaattggtggatgaactgatggaagctcctggagacgtagaggccctggcgccacctgtccggcacctcatagccacccagctgctctcaaaccttgaagatatcatgaggatcctggccaagagcctgcctaaaggccccttcacctacatttccccttcgaacacagagctgaccctgatgatccaggagcggggggacaagaacgtcactatgggtcagagcagcgcacgcatgaagctgaattgggctgtggcagctggagccgaggatccaggccccgccgtggcgggcatcctctccatccagaacatgacgacattgctggccaatgcctccttgaacctgcattccaagaagcaagccgaactggaggagatatatgaaagcagcatccgtggtgtccaactcagacgcctctctgccgtcaactccatctttctgagccacaacaacaccaaggaactcaactcccccatccttttcgccttctcccaccttgagtcctccgatggggaggcgggaagagaccctcctgccaaggacgtgatgcctgggccacggcaggagctgctctgtgccttctggaagagtgacagcgacaggggagggcactgggccaccgagggctgccaggtgctgggcagcaagaacggcagcaccacctgccaatgcagccacctgagcagctttgcgatccttatggctcattatgacgtggaggactggaagctgaccctgatcaccagggtgggactggcgctgtcactcttctgcctgctgctgtgcatcctcactttcctgctggtgcggcccatccagggctcgcgcaccaccatacacctgcacctctgcatctgcctcttcgtgggctccaccatcttcctggccggcatcgagaacgaaggcggccaggtggggctgcgctgccgcctggtggccgggctgctgcactactgtttcctggccgccttctgctggatgagcctcgaaggcctggagctctactttcttgtggtgcgcgtgttccaaggccagggcctgagtacgcgctggctctgcctgatcggctatggcgtgcccctgctcatcgtgggcgtctcggctgccatctacagcaagggctacggccgccccagatactgctggttggactttgagcagggcttcctctggagcttcttgggacctgtgaccttcatcattttgtgcaatgctgtcattttcgtgactaccgtctggaagctcactcagaagttttctgaaatcaatccagacatgaagaaattaaagaaggcgagggcgctgaccatcacggccatcgcgcagctcttcctgttgggctgcacctgggtctttggcctgttcatcttcgacgatcggagcttggtgctgacctatgtgtttaccatcctcaactgcctgcagggcgccttcctctacctgctgcactgcctgctcaacaagaaggttcgggaagaataccggaagtgggcctgcctagttgctggggggagcaagtactcagaattcacctccaccacgtctggcactggccacaatcagacccgggccctcagggcatcagagtccggcatatgaaggcgcatggttctggacggcccagcagctcctgtggccacagcagctttgtacacgaagaccatccatcctcccttcgtccaccactctactccctccaccctccctccctgatcccgtgtgccaccaggagggagtggcagctatagtctggcaccaaagtccaggacacccagtggggtggagtcggagccactggtcctgctgctggctgcctctctgctccaccttgtgacccagggtggggacaggggctggcccagggctgcaatgcagcatgttgccctggcacctgtggccagtactcgggacagactaagggcgcttgtcccatcctggacttttcctctcatgtctttgctgcagaactgaagagactaggcgctggggctcagcttccctcttaagctaagactgatgtcagaggccccatggcgaggccccttggggccactgcctgaggctcacggtacagaggcctgccctgcctggccgggcaggaggttctcactgttgtgaaggttgtagacgttgtgtaatgtgtttttatctgttaaaatttttcagtgttgacacttaaaattaaacacatgcatacagaaaaaaaaaaaaaaaaaaaaaa

SEQ ID NO: 942 - DNA, 9045 bp, Homo sapiens
atggcgccgccgccgccgcccgtgctgcccgtgctgctgctcctggccgccgccgccgccctgccggcgatggggctgcgagcggccgcctgggagccgcgcgtacccggcgggacccgcgccttcgccctccggcccggctgtacctacgcggtgggcgccgcttgcacgccccgggcgccgcgggagctgctggacgtgggccgcgatgggcggctggcaggacgtcggcgcgtctcgggcgcggggcgcccgctgccgctgcaagtccgcttggtggcccgcagtgccccgacggcgctgagccgccgcctgcgggcgcgcacgcaccttcccggctgcggagcccgtgcccggctctgcggaaccggtgcccggctctgcggggcgctctgcttccccgtccccggcggctgcgcggccgcgcagcattcggcgctcgcagctccgaccaccttacccgcctgccgctgcccgccgcgccccaggccccgctgtcccggccgtcccatctgcctgccgccgggcggctcggtccgcctgcgtctgctgtgcgccctgcggcgcgcggctggcgccgtccgggtgggactggcgctggaggccgccaccgcggggacgccctccgcgtcgccatccccatcgccgcccctgccgccgaacttgcccgaagcccgggcggggccggcgcgacgggcccggcggggcacgagcggcagagggagcctgaagtttccgatgcccaactaccaggtggcgttgtttgagaacgaaccggcgggcaccctcatcctccagctgcacgcgcactacaccatcgagggcgaggaggagcgcgtgagctattacatggaggggctgttcgacgagcgctcccggggctacttccgaatcgactctgccacgggcgccgtgagcacggacagcgtactggaccgcgagaccaaggagacgcacgtcctcagggtgaaagccgtggactacagtacgccgccgcgctcggccaccacctacatcactgtcttggtcaaagacaccaacgaccacagcccggtcttcgagcagtcggagtaccgcgagcgcgtgcgggagaacctggaggtgggctacgaggtgctgaccatccgcgccagcgaccgcgactcgcccatcaacgccaacttgcgttaccgcgtgttggggggcgcgtgggacgtcttccagctcaacgagagctctggcgtggtgagcacacgggcggtgctggaccgggaggaggcggccgagtaccagctcctggtggaggccaacgaccaggggcgcaatccgggcccgctcagtgccacggccaccgtgtacatcgaggtggaggacgagaacgacaactacccccagttcagcgagcagaactacgtggtccaggtgcccgaggacgtggggctcaacacggctgtgctgcgagtgcaggccacggaccgggaccagggccagaacgcggccattcactacagcatcctcagcgggaacgtggccggccagttctacctgcactcgctgagcgggatcctggatgtgatcaaccccttggatttcgaggatgtccagaaatactcgctgagcattaaggcccaggatgggggccggcccccgctcatcaattcttcaggggtggtgtctgtgcaggtgctggatgtcaacgacaacgagcctatctttgtgagcagccccttccaggccacggtgctggagaatgtgcccctgggctaccccgtggtgcacattcaggcggtggacgcggactctggagagaacgcccggctgcactatcgcctggtggacacggcctccacctttctggggggcggcagcgctgggcctaagaatcctgcccccacccctgacttccccttccagatccacaacagctccggttggatcacagtgtgtgccgagctggaccgcgaggaggtggagcactacagcttcggggtggaggcggtggaccacggctcgccccccatgagctcctccaccagcgtgtccatcacggtgctggacgtgaatgacaacgacccggtgttcacgcagcccacctacgagcttcgtctgaatgaggatgcggccgtggggagcagcgtgctgaccctgcaggcccgcgaccgtgacgccaacagtgtgattacctaccagctcacaggcggcaacacccggaaccgctttgcactcagcagccagagagggggcggcctcatcaccctggcgctacctctggactacaagcaggagcagcagtacgtgctggcggtgacagcatccgacggcacacggtcgcacactgcgcatgtcctaatcaacgtcactgatgccaacacccacaggcctgtctttcagagctcccattacacagtgagtgtcagtgaggacaggcctgtgggcacctccattgctaccctcagtgccaacgatgaggacacaggagagaatgcccgcatcacctacgtgattcaggaccccgtgccgcagttccgcattgaccccgacagtggcaccatgtacaccatgatggagctggactatgagaaccaggtcgcctacacgctgaccatcatggcccaggacaacggcatcccgcagaaatcagacaccaccaccctagagatcctcatcctcgatgccaatgacaatgcaccccagttcctgtgggatttctaccagggttccatctttgaggatgctccaccctcgaccagcatcctccaggtctctgccacggaccgggactcaggtcccaatgggcgtctgctgtacaccttccagggtggggacgacggcgatggggacttctacatcgagcccacgtccggtgtgattcgcacccagcgccggctggaccgggagaatgtggccgtgtacaacctttgggctctggctgtggatcggggcagtcccactccccttagcgcctcggtagaaatccaggtgaccatcttggacattaatgacaatgcccccatgtttgagaaggacgaactggagctgtttgttgaggagaacaacccagtggggtcggtggtggcaaagattcgtgctaacgaccctgatgaaggccctaatgcccagatcatgtatcagattgtggaaggggacatgcggcatttcttccagctggacctgctcaacggggacctgcgtgccatggtggagctggactttgaggtccggcgggagtatgtgctggtggtgcaggccacgtcggctccgctggtgagccgagccacggtgcacatccttctcgtggaccagaatgacaacccgcctgtgctgcccgacttccagatcctcttcaacaactatgtcaccaacaagtccaacagtttccccaccggcgtgatcggctgcatcccggcccatgaccccgacgtgtcagacagcctcaactacaccttcgtgcagggcaacgagctgcgcctgttgctgctggaccccgccacgggcgaactgcagctcagccgcgacctggacaacaaccggccgctggaggcgctcatggaggtgtctgtgtctgatggcatccacagcgtcacggccttctgcaccctgcgtgtcaccatcatcacggacgacatgctgaccaacagcatcactgtccgcctggagaacatgtcccaggagaagttcctgtccccgctgctggccctcttcgtggagggggtggccgccgtgctgtccaccaccaaggacgacgtcttcgtcttcaacgtccagaacgacaccgacgtcagctccaacatcctgaacgtgaccttctcggcgctgctgcctggcggcgtccgcggccagttcttcccgtcggaggacctgcaggagcagatctacctgaatcggacgctgctgaccaccatctccacgcagcgcgtgctgcccttcgacgacaacatctgcctgcgcgagccctgcgagaactacatgaagtgcgtgtccgttctgcgattcgacagctccgcgcccttcctcagctccaccaccgtgctcttccggcccatccaccccatcaacggcctgcgctgccgctgcccgcccggcttcaccggcgactactgcgagacggagatcgacctctgctactccgacccgtgcggcgccaacggccgctgccgcagccgcgagggcggctacacctgcgagtgcttcgaggacttcactggagagcactgtgaggtggatgcccgctcaggccgctgtgccaacggggtgtgcaagaacgggggcacctgcgtgaacctgctcatcggcggcttccactgcgtgtgtcctcctggcgagtatgagaggccctactgtgaggtgaccaccaggagcttcccgccccagtccttcgtcaccttccggggcctgagacagcgcttccacttcaccatctccctcacgtttgccactcaggaaaggaacggcttgcttctctacaacggccgcttcaatgagaagcacgacttcatcgccctggagatcgtggacgagcaggtgcagctcaccttctctgcaggcgagacaacaacgaccgtggcaccgaaggttcccagtggtgtgagtgacgggcggtggcactctgtgcaggtgcagtactacaacaagcccaatattggccacctgggcctgccccatgggccgtccggggaaaagatggccgtggtgacagtggatgattgtgacacaaccatggctgtgcgctttggaaaggacatcgggaactacagctgcgctgcccagggcactcagaccggctccaagaagtccctggatctgaccggccctctactcctggggggtgtccccaacctgccagaagacttcccagtgcacaaccggcagttcgtgggctgcatgcggaacctgtcagtcgacggcaaaaatgtggacatggccggattcatcgccaacaatggcacccgggaaggctgcgctgctcggaggaacttctgcgatgggaggcggtgtcagaatggaggcacctgtgtcaacaggtggaatatgtatctgtgtgagtgtccactccgattcggcgggaagaactgtgagcaagccatgcctcacccccagctcttcagcggtgagagcgtcgtgtcctggagtgacctgaacatcatcatctctgtgccctggtacctggggctcatgttccggacccggaaggaggacagcgttctgatggaggccaccagtggtgggcccaccagctttcgcctccagatcctgaacaactacctccagtttgaggtgtcccacggcccctccgatgtggagtccgtgatgctgtccgggttgcgggtgaccgacggggagtggcaccacctgctgatcgagctgaagaatgttaaggaggacagtgagatgaagcacctggtcaccatgaccttggactatgggatggaccagaacaaggcagatatcgggggcatgcttcccgggctgacggtaaggagcgtggtggtcggaggcgcctctgaagacaaggtctccgtgcgccgtggattccgaggctgcatgcagggagtgaggatgggggggacgcccaccaacgtcgccaccctgaacatgaacaacgcactcaaggtcagggtgaaggacggctgtgatgtggacgacccctgtacctcgagcccctgtccccccaatagccgctgccacgacgcctgggaggactacagctgcgtctgtgacaaagggtaccttggaataaactgtgtggatgcctgtcacctgaacccctgcgagaacatgggggcctgcgtgcgctcccccggctccccgcagggctacgtgtgcgagtgtgggcccagtcactacgggccgtactgtgagaacaaactcgaccttccgtgccccagaggctggtgggggaaccccgtctgtggaccctgccactgtgccgtcagcaaaggctttgatcccgactgtaataagaccaacggccagtgccaatgcaaggagaattactacaagctcctagcccaggacacctgtctgccctgcgactgcttcccccatggctcccacagccgcacttgcgacatggccaccgggcagtgtgcctgcaagcccggcgtcatcggccgccagtgcaaccgctgcgacaacccgtttgccgaggtcaccacgctcggctgtgaagtgatctacaatggctgtcccaaagcatttgaggccggcatctggtggccacagaccaagttcgggcagccggctgcggtgccatgccctaagggatccgttggaaatgcggtccgacactgcagcggggagaagggctggctgcccccagagctctttaactgtaccaccatctccttcgtggacctcagggccatgaatgagaagctgagccgcaatgagacgcaggtggacggcgccagggccctgcagctggtgagggcgctgcgcagtgctacacagcacacgggcacgctctttggcaatgacgtgcgcacggcctaccagctgctgggccacgtccttcagcacgagagctggcagcagggcttcgacctggcagccacgcaggacgccgactttcacgaggacgtcatccactcgggcagcgccctcctggccccagccaccagggcggcgtgggagcagatccagcggagcgagggcggcacggcacagctgctccggcgcctcgagggctacttcagcaacgtggcacgcaacgtgcggcggacgtacctgcggcccttcgtcatcgtcaccgccaacatgattcttgctgtcgacatctttgacaagttcaactttacgggagccagggtcccgcgattcgacaccatccatgaagagttccccagggagctggagtcctccgtctccttcccagccgacttcttcagaccacctgaagaaaaagaaggccccctgctgaggccggctggccggaggaccaccccgcagaccacgcgcccggggcctggcaccgagagggaggccccgatcagcaggcggaggcgacaccctgatgacgctggccagttcgccgtcgctctggtcatcatttaccgcaccctggggcagctcctgcccgagcgctacgaccccgaccgtcgcagcctccggttgcctcaccggcccatcattaataccccgatggtgagcacgctggtgtacagcgagggggctccgctcccgagacccctggagaggcccgtcctggtggagttcgccctgctggaggtggaggagcgaaccaagcctgtctgcgtgttctggaaccactccctggccgttggtgggacgggagggtggtctgcccggggctgcgagctcctgtccaggaaccggacacatgtcgcctgccagtgcagccacacagccagctttgcggtgctcatggatatctccaggcgtgagaacggggaggtcctgcctctgaagattgtcacctatgccgctgtgtccttgtcactggcagccctgctggtggccttcgtcctcctgagcctggtccgcatgctgcgctccaacctgcacagcattcacaagcacctcgccgtggcgctcttcctctctcagctggtgttcgtgattgggatcaaccagacggaaaacccgtttctgtgcacagtggttgccatcctcctccactacatctacatgagcacctttgcctggaccctcgtggagagcctgcatgtctaccgcatgctgaccgaggtgcgcaacatcgacacggggcccatgcggttctactacgtcgtgggctggggcatcccggccattgtcacaggactggcggtcggcctggacccccagggctacgggaaccccgacttctgctggctgtcgcttcaagacaccctgatttggagctttgcggggcccatcggagctgttataatcatcaacacagtcacttctgtcctatctgcaaaggtttcctgccaaagaaagcaccattattatgggaaaaaagggatcgtctccctgctgaggaccgcattcctcctgctgctgctcatcagcgccacctggctgctggggctgctggctgtgaaccgcgatgcactgagctttcactacctcttcgccatcttcagcggcttacagggccccttcgtcctccttttccactgcgtgctcaaccaggaggtccggaagcacctgaagggcgtgctcggcgggaggaagctgcacctggaggactccgccaccaccagggccaccctgctgacgcgctccctcaactgcaacaccaccttcggtgacgggcctgacatgctgcgcacagacttgggcgagtccaccgcctcgctggacagcatcgtcagggatgaagggatccagaagctcggcgtgtcctctgggctggtgaggggcagccacggagagccagacgcgtccctcatgcccaggagctgcaaggatccccctggccacgattccgactcagatagcgagctgtccctggatgagcagagcagctcttacgcctcctcacactcgtcagacagcgaggacgatggggtgggagctgaggaaaaatgggacccggccaggggcgccgtccacagcacccccaaaggggacgctgtggccaaccacgttccggccggctggcccgaccagagcctggctgagagtgacagtgaggaccccagcggcaagccccgcctgaaggtggagaccaaggtcagcgtggagctgcaccgcgaggagcagggcagtcaccgtggagagtaccccccggaccaggagagcgggggcgcagccaggcttgctagcagccagcccccagagcagaggaaaggcatcttgaaaaataaagtcacctacccgccgccgctgacgctgacggagcagacgctgaagggccggctccgggagaagctggccgactgtgagcagagccccacatcctcgcgcacgtcttccctgggctctggcggccccgactgcgccatcacagtcaagagccctgggagggagccggggcgtgaccacctcaacggggtggccatgaatgtgcgcactgggagcgcccaggccgatggctccgactctgagaaaccgtga

SEQ ID NO: 943 - DNA, 8772 bp, Homo sapiens
atgcggagcccggccaccggcgtccccctcccaacgccgccgccgccgctgctgctgctgttgctgctgctgctgccgccgccactattgggagaccaagtggggccctgtcgttccttggggtccaggggacgaggctcttcgggggcctgcgcccccatgggctggctctgtccatcctcagcgtcgaacctctggctctacaccagccgctgcagggatgcgggcactgagctgactggccacctggtaccccaccacgatggcctgagggtttggtgtccagaatccgaggcccatattcccctaccaccagctcctgaaggctgcccctggagctgtcgcctcctgggcattggaggccacctttccccacagggcaagctcacactgcccgaggagcacccgtgcttaaaggctccacggctcagatgccagtcctgcaagctggcacaggcccccgggctcagggcaggggaaaggtcaccagaagagtccctgggtgggcgtcggaaaaggaatgtaaatacagccccccagttccagccccccagctaccaggccacagtgccggagaaccagccagcaggcacccctgttgcatccctgagggccatcgacccggacgagggtgaggcaggtcgactggagtacaccatggatgccctctttgatagccgctccaaccagttcttctccctggacccagtcactggtgcagtaaccacagccgaggagctggatcgtgagaccaagagcacccacgtcttcagggtcacggcgcaggaccacggcatgccccgacgaagtgccctggctacactcaccatcttggttactgacaccaatgaccatgaccctgtgttcgagcagcaggagtacaaggagagcctcagggagaacctggaggttggctatgaggtgctcactgtcagggccacggatggtgatgcccctcccaatgccaatattctgtaccgcctgctggaggggtctgggggcagcccctctgaagtctttgagatcgaccctcgctctggggtgatccgaacccgtggccctgtggatcgggaagaggtggaatcctaccagctgacggtagaggcaagtgaccagggtcgggacccgggtcctcggagtaccacagccgctgttttcctttctgtggaggatgacaatgataatgccccccagtttagtgagaagcgctatgtggtccaggtgagggaggatgtgactccaggggccccagtactccgagtcacagcctcggatcgagacaaggggagcaatgccgtggtgcactatagcatcatgagtggcaatgctcggggacagttttatctggatgcccagactggagctctggatgtggtgagccctcttgactatgagacgaccaaggagtacaccctacgggtgcgagcacaggatggtggccgtcccccactctctaatgtctctggcttggtgacagtacaggtcctggatatcaacgacaatgcccccatcttcgtcagcacccctttccaggctactgtcctggagagcgtccccttaggctacctggttctccatgtccaggctatcgacgctgatgctggtgacaatgcccgcctggaataccgccttgctggggtgggacatgacttccccttcaccatcaacaatggcacaggctggatctctgtggctgctgaactggaccgggaggaagttgatttctacagctttggggtagaagctcgagaccatggcactccagcactcactgcctcggccagtgtcagcgtgactgtcctggatgtcaacgacaacaatccaacctttacccaaccagagtacacagtgcggctcaatgaggatgcagctgtgggcaccagcgtggtgacggtgtcagctgtggaccgtgatgctcatagtgtcatcacctaccagatcaccagtggcaatactcgaaaccgcttctccatcaccagccaaagtggtggtgggctggtatcccttgccctgccactggactacaaacttgagcggcagtatgtgttggctgttaccgcctccgatggcactcggcaggacacggcacagattgtggtgaatgtcaccgacgccaacacccatcgtcctgtctttcagagctcccactatacagtgaatgttaatgaggaccggccggcaggcaccacggtggtgctgatcagcgccacggatgaggacacaggtgagaatgcccgcatcacctacttcatggaggacagcatcccccagttccgcatcgatgcagacacgggggctgtcaccacccaggctgagctggactacgaagaccaagtgtcttacaccctggccattactgctcgggacaatggcattccccagaagtccgacaccacctacctggagatcctggtgaacgacgtgaatgacaatgcccctcagttcctgcgagactcctaccagggcagtgtctatgaggatgtgccacccttcactagcgtcctgcagatctcagccactgatcgtgattctggacttaatggcagggtcttctacaccttccaaggaggcgacgatggagacggtgactttattgttgagtccacgtcaggcatcgtgcgaacgctacggaggctggatcgagagaacgtggcccagtatgtcttgcgggcatatgcagtggacaaggggatgcccccagcccgcacacctatggaagtgacagtcactgtgttggatgtgaatgacaatccccctgtctttgagcaggatgagtttgatgtgtttgtggaagagaacagccccattgggctagccgtggcccgggtcacagccactgaccccgatgaaggcaccaatgcccagattatgtaccagattgtggagggcaacatccctgaggtcttccagctggacatcttctccggggagctgacagccctggtagacttagactacgaggaccggcctgagtacgtcctggtcatccaggccacgtcagctcctctggtgagccgggctacagtccacgtccgcctccttgaccgcaatgacaacccaccagtgctgggcaactttgagatccttttcaacaactatgtcaccaatcgctcaagcagcttccctgggggtgccattggccgagtacctgcccatgaccctgatatctcagatagtctgacttacagctttgagcggggaaatgaactcagcctggtcctgctcaatgcctccacgggtgagctgaagctaagccgcgcactggacaacaaccggcctctggaggccatcatgagcgtgctggtgtcagacggcgtacacagcgtgaccgcccagtgcgcgctgcgtgtgaccatcatcaccgatgagatgctcacccacagcatcacgctgcgcctggaggacatgtcacccgagcgcttcctgtcaccactgctaggcctcttcatccaggcggtggccgccacgctggccacgccaccggaccacgtggtggtcttcaacgtacagcgggacaccgacgcccccgggggccacatcctcaacgtgagcctgtcggtgggccagccgccagggcccgggggcgggccgcccttcctgccctctgaggacctgcaggagcgcctatacctcaaccgcagcctgctgacggccatctcggcacagcgcgtgctgcccttcgacgacaacatctgcctgcgggagccctgcgagaactacatgcgctgcgtgtcggtgctgcgcttcgactcctccgcgcccttcatcgcctcctcctccgtgctcttccggcccatccaccccgtcggagggctgcgctgccgctgcccgcccggcttcacgggtgactactgcgagaccgaggtggacctctgctactcgcggccctgtggcccccacgggcgctgccgcagccgcgagggcggctacacctgcctctgtcgtgatggctacacgggtgagcactgtgaggtgagtgctcgctcaggccgttgcaccccgggtgtctgcaagaatgggggcacctgtgtcaacctgctggtgggcggtttcaagtgcgattgcccatctggagacttcgagaagccctactgccaggtgaccacgcgcagcttccccgcccactccttcatcacctttcgcggcctgcgccagcgtttccacttcaccctggccctctcgtttgccacaaaggagcgcgacgggttgctgttgtacaatgggcgtttcaatgagaagcatgactttgtggccctcgaggtgatccaggagcaggtccagctcaccttctctgcaggggagtcaaccaccacggtgtccccattcgtgcccggaggagtcagtgatggccagtggcatacggtgcagctgaaatactacaataagccactgttgggtcagacagggctcccacagggcccatcagagcagaaggtggctgtggtgaccgtggatggctgtgacacaggagtggccttgcgcttcggatctgtcctgggcaactactcctgtgctgcccagggcacccagggtggcagcaagaagtctctggatctgacggggcccctgctactaggcggggtgcctgacctgcccgagagcttcccagtccgaatgcggcagttcgtgggctgcatgcggaacctgcaggtggacagccggcacatagacatggctgacttcattgccaacaatggcaccgtgcctggctgccctgccaagaagaacgtgtgtgacagcaacacttgccacaatgggggcacttgcgtgaaccagtgggacgcgttcagctgcgagtgccccctgggctttgggggcaagagctgcgcccaggaaatggccaatccacagcacttcctgggcagcagcctggtggcctggcatggcctctcgctgcccatctcccaaccctggtacctcagcctcatgttccgcacgcgccaggccgacggtgtcctgctgcaggccatcaccagggggcgcagcaccatcaccctacagctacgagagggccacgtgatgctgagcgtggagggcacagggcttcaggcctcctctctccgtctggagccaggccgggccaatgacggtgactggcaccatgcacagctggcactgggagccagcggggggcctggccatgccattctgtccttcgattatgggcagcagagagcagagggcaacctgggcccccggctgcatggtctgcacctgagcaacataacagtgggcggaatacctgggccagccggcggtgtggcccgtggctttcggggctgtttgcagggtgtgcgggtgagcgatacgccagagggggttaacagcctggatcccagccatggggagagcatcaacgtggagcaaggctgtagcctgcctgacccttgtgactcaaacccgtgtcctgctaacagctattgcagcaacgactgggacagctattcctgcagctgtgatccaggttactatggtgacaactgtactaatgtgtgtgacctgaacccgtgtgagcaccagtctgtgtgtacccgcaagcccagtgccccccatggctatacctgcgagtgtcccccaaattaccttgggccatactgtgagaccaggattgaccagccttgtccccgtggctggtggggacatcccacatgtggcccatgcaactgtgatgtcagcaaaggctttgacccagactgcaacaagacaagcggcgagtgccactgcaaggagaaccactaccggcccccaggcagccccacctgcctcttgtgtgactgctaccccacaggctccttgtccagagtctgtgaccctgaggatggccagtgtccatgcaagccaggtgtcatcgggcgtcagtgtgaccgctgtgacaacccttttgctgaggtcaccaccaatggctgtgaagtgaattatgacagctgcccacgagcgattgaggctgggatctggtggccccgtacccgcttcgggctgcctgctgctgctccctgtcccaaaggctcctttgggactgctgtgcgccactgtgatgagcacagggggtggctccccccaaacctcttcaactgcacgtccatcaccttctcagaactgaagggcttcgctgagcggctacagcggaatgagtcaggcctagactcagggcgctcccagcagctagccctgctcctgcgcaacgccacgcagcacacagctggctacttcggcagcgacgtcaaggtggcctaccagctggccacgcggctgctggcccacgagagcacccagcggggctttgggctgtctgccacacaggacgtgcacttcactgagaatctgctgcgggtgggcagcgccctcctggacacagccaacaagcggcactgggagctgatccagcagacagagggtggcaccgcctggctgctccagcactatgaggcctacgccagtgccctggcccagaacatgcggcacacctacctaagccccttcaccatcgtcacgcccaacattgtcatctccgtagtgcgcttggacaaagggaactttgctggggccaagctgccccgctacgaggccctgcgtggggagcagcccccggaccttgagacaacagtcattctgcctgagtctgtcttcagagagacgccccccgtggtcaggcccgcaggccccggagaggcccaggagccagaggagctggcacggcgacagcgacggcacccggagctgagccagggtgaggctgtggccagcgtcatcatctaccgcaccctggccgggctactgcctcataactatgaccctgacaagcgcagcttgagagtccccaaacgcccgatcatcaacacacccgtggtgagcatcagcgtccatgatgatgaggagcttctgccccgggccctggacaaacccgtcacggtgcagttccgcctgctggagacagaggagcggaccaagcccatctgtgtcttctggaaccattcaatcctggtcagtggcacaggtggctggtcggccagaggctgtgaagtcgtcttccgcaatgagagccacgtcagctgccagtgcaaccacatgacgagcttcgctgtgctcatggacgtttctcggcgggagaatggggagatcctgccactgaagacactgacatacgtggctctaggtgtcaccttggctgcccttctgctcaccttcttcttcctcactctcttgcgtatcctgcgctccaaccaacacggcatccgacgtaacctgacagctgccctgggcctggctcagctggtcttcctcctgggaatcaaccaggctgacctcccttttgcctgcacagtcattgccatcctgctgcacttcctgtacctctgcaccttttcctgggctctgctggaggccttgcacctgtaccgggcactcactgaggtgcgcgatgtcaacaccggccccatgcgcttctactacatgctgggctggggcgtgcctgccttcatcacagggctagccgtgggcctggaccccgagggctacgggaaccctgacttctgctggctctccatctatgacacgctcatctggagttttgctggcccggtggcctttgccgtctcgatgagtgtcttcctgtacatcctggcggcccgggcctcctgtgctgcccagcggcagggctttgagaagaaaggtcctgtctcgggcctgcagccctccttcgccgtcctcctgctgctgagcgccacgtggctgctggcactgctctctgtcaacagcgacaccctcctcttccactacctctttgctacctgcaattgcatccagggccccttcatcttcctctcctatgtggtgcttagcaaggaggtccggaaagcactcaagcttgcctgcagccgcaagcccagccctgaccctgctctgaccaccaagtccaccctgacctcgtcctacaactgccccagcccctacgcagatgggcggctgtaccagccctacggagactcggccggctctctgcacagcaccagtcgctcgggcaagagtcagcccagctacatccccttcttgctgagggaggagtccgcactgaaccctggccaagggccccctggcctgggggatccaggcagcctgttcctggaaggtcaagaccagcagcatgatcctgacacggactccgacagtgacctgtccttagaagacgaccagagtggctcctatgcctctacccactcatcagacagtgaggaggaagaagaggaggaggaagaggaggccgccttccctggagagcagggctgggatagcctgctggggcctggagcagagagactgcccctgcacagtactcccaaggatgggggcccagggcctggcaaggccccctggccaggagactttgggaccacagcaaaagagagtagtggcaacggggcccctgaggagcggctgcgggagaatggagatgccctgtctcgagaggggtccctaggcccccttccaggctcttctgcccagcctcacaaaggcatccttaagaagaagtgtctgcccaccatcagcgagaagagcagcctcctgcggctccccctggagcaatgcacagggtcttcccggggctcctccgctagtgagggcagccggggcggcccccctccccgcccaccgccccggcagagcctccaggagcagctgaacggggtcatgcccatcgccatgagcatcaaggcaggcacggtggatgaggactcgtcaggctccgaatttctcttctttaacttcctgcattaa

SEQ ID NO: 944 - DNA, 9939 bp, Homo sapiens
atgatggcgaggcggccgccgtggcggggcctcggggaacggtcgacccccatactcctgctccttctcctctctttgttccccctcagccaggaggagctggggggcggtgggcaccagggctgggacccaggcttagctgccactacggggccaagggcgcatatcggtggcggagccttagctctttgtccggagtcttccggggtccgggaggatggggggcctggcctgggggtcagggagcctatcttcgtggggctccgagggagaaggcaaagcgcccggaatagtcgagggccccctgagcagccgaatgaggagctggggattgaacacggcgtccagccattgggcagccgcgaacgagagacaggacagggaccagggtctgtgttatactggcgcccagaggtctcctcttgcgggcggacaggacctttgcaaagaggtagtctgtcaccaggggctctgtcctcaggggtcccgggctcggggaacagctcgcccctcccttcagactttttgattcggcaccacggtcccaagccggtgtcctcccagcggaacgctgggacaggctcccgcaaaagagtgggcaccgcgcgctgctgtggggaattatgggcaacagggagcaagggtcagggcgagagagccacgacatccggagcagaaaggacagccccccggcggaactgtcttccaggggcctcgggatctggccccgagctggattcagcaccacgcacggcgaggacagctcctgcatcaggttcagcaccccgcgagtctcggacagctcccgagccggcgcccaagcgcatgcgctcccggggtctcttccgctgccgcttcctcccgcagcgccccgggccgcgtcccccgggactcccggcccgtcctgaagccaggaaagtaacctcggcgaaccgggcacgctttcgtcgcgccgcaaaccgccacccgcagtttccgcagtacaactaccagacgctggtgccggagaatgaggcagcaggcaccgcggtgctacgcgtggttgctcaggacccggacgccggcgaggccgggcgcctagtctactcgctggcggcactcatgaacagccgctcgctggagctgttcagcatcgacccgcagagcggccttatccgtacggcggcagctctggaccgcgagagcatggagcgtcactacctgcgtgtgaccgcgcaggaccacgggtcgccgcgcctctcggccaccacgatggtggccgtgacagtagccgaccgcaacgaccactcgccggtttttgagcaagcgcagtaccgggagacccttcgcgagaatgtggaggagggctaccctatcctgcagctgcgtgccactgacggcgacgcgccccccaacgccaacctgcgctaccgcttcgtggggccgccagctgcgcgcgctgcagctgccgccgccttcgagattgatccacgctccggcctcatcagcaccagcggccgagtggaccgcgagcacatggaaagctatgagctggtggtggaagccagcgaccagggccaggaacccgggccgcgctcggccactgtgcgcgtacacataactgtgctagacgagaacgacaatgctcctcagttcagcgagaagcgctacgtggcgcaggtgcgcgaggatgtgcgcccccacacagtcgtgctgcgcgtcacggccactgaccgggacaaggacgccaacggattggtgcactacaacatcatcagtggcaatagccgtggacactttgccatcgacagcctcactggcgagatccaggtggtggcacctctggacttcgaggcagagagagagtatgccttgcgcatcagggcgcaggatgctggccggccaccgctgtccaacaacacgggcctggccagcatccaggtggtggacatcaatgaccacattcctatttttgtcagcacgcccttccaagtttctgtcttggaaaatgctcccttgggtcactcagtcatccacattcaggcagtcgatgcagaccatggggagaatgccagattggagtactccctaactggtgtggcacctgatactccttttgtgataaacagcgccactggctgggtctctgtgagtggtcccctggaccgtgagtctgtggagcattacttctttggtgtggaggctcgagaccatggctcacccccactctctgcctcagccagtgtcaccgtgactgtgctggacgttaatgacaatcggcctgagttcacaatgaaggagtaccacctacgactgaatgaggatgcagctgtgggcaccagtgtggtcagcgtgaccgcagtagaccgtgatgccaacagtgccatcagctaccagatcacaggcggcaacacccggaatcgctttgccatcagcacccaggggggtgtgggtctggtgactctggctctgccactggactacaagcaggaacgctacttcaagctggtactaactgcatctgaccgtgcccttcatgatcactgctatgtgcacatcaacatcacagatgccaacactcatcggccggtctttcaaagtgcccactactcagtgagtgtgaatgaagatcggccaatgggtagcaccatagtggtcatcagtgcctctgatgatgacgtgggtgagaatgctcgtatcacctatctcctggaggacaacctgccccagttccgcattgatgcagactcaggagccattacattacaggccccattagactatgaggaccaggtgacctacaccctggctatcacagctcgggacaatggcatcccacagaaggcagacactacttatgtggaggtgatggtcaatgacgtgaatgacaatgctccacaatttgtggcctcccactatacagggctggtctctgaggatgccccacctttcaccagtgtcctgcagatctcagccactgaccgggatgctcatgccaatggccgggtccagtacactttccagaatggtgaagatggggatggagattttaccattgagcccacctctggaattgtccgtacagtaaggcggctagaccgggaggcagtatcagtgtatgagttgactgcctacgcagtggacagaggtgtgcccccactccggactccagtcagtatccaggtgatggtgcaggatgtgaacgacaatgcacctgtcttcccagctgaggagtttgaggtgcgggtgaaagagaatagcattgtgggctcagtggtggcccagatcactgcagtggaccctgacgaaggccccaatgcccatataatgtaccagatcgtggaggggaacatccctgagctgttccaaatggacatcttctctggagaactgacggcactcattgacctagactatgaggctcgccaagaatatgtgattgtggtgcaggccacatctgctcctttggtcagccgggccactgtgcacgtccgcctggttgaccagaatgacaacagccctgtgctcaacaacttccagatcctcttcaacaactatgtatccaaccgttcagacaccttcccgtcgggcattattgggcgcatcccagcttatgaccccgatgtctccgaccacctcttctactcctttgagcgtggcaatgagctgcagctgctggtagtcaaccagaccagtggggagctgcgactcagccgaaagctagacaataaccgcccactggtggcctccatgttggtgactgtcacagatggcctgcacagcgtgacggcgcagtgtgtgctgcgcgtggtcatcatcacggaggagttgctggccaacagcctgaccgtgcgccttgagaacatgtggcaggagcgcttcctgtcaccgctgctgggccgcttcctcgagggcgtggctgcggtgctcgctacgcccgctgaggacgtcttcatcttcaacatccagaacgacacagacgtagggggcaccgtgctcaatgtgagtttctcggcgctagctccacgtggggccggggcgggcgctgcagggccctggttcagctccgaggagctgcaggagcagttgtacgtgcgccgggcggcgctggcggctcgctccctgctcgacgtactgcccttcgacgacaacgtgtgcctgcgagagccctgtgagaactacatgaaatgcgtgtccgtgctccgctttgactcgtccgcgcccttcctggcctcggcctccacgctgttccgacccatccagcccatcgctggcctgcgctgccgctgcccgcccggattcacgggagacttttgcgagaccgagctcgacctctgctactccaacccatgtcgcaacggcggagcctgcgcgcggcgcgagggaggctacacgtgcgtctgccgcccgcgcttcaccggagaggactgcgagctggacaccgaggccggccgctgcgtgccgggcgtctgccgcaacgggggcacctgcaccgacgcgcccaacggcggctttcgctgccagtgcccggcaggcggcgccttcgagggcccgcgctgcgaggtggctgcgcgctccttcccgcccagttcgttcgtcatgtttcgcggcctgcggcagcgattccaccttacgctgtccctctcgttcgcgacagtgcagcagagcgggctgctcttctacaacgggcgcctgaacgagaagcacgacttcctggccctggaactcgtggctggccaagtgcggctcacatattccacgggtgaatccaacaccgtggtcagccccacagttccagggggcttgagtgacgggcaatggcatacagtgcatctgagatactacaacaagccccggacagatgccctagggggtgcacagggcccctccaaggacaaggtggctgtgctaagcgtggatgattgtgatgtggccgtggctctgcagtttggtgctgagattggcaactactcatgcgcggctgctggtgtgcaaacaagctccaagaagtccctggacctgacgggccctcttcttctgggaggtgtccccaacctccccgagaacttccccgtatcccataaggacttcatcggctgtatgcgggacctgcacattgatggccgccgagtggacatggcggcttttgtcgcaaataatggcaccatggcaggctgccaagccaagctacacttttgtgactcaggcccctgcaagaacagtggcttctgctcggagcgctggggcagcttcagctgcgactgccctgtgggcttcggcggcaaagactgtcagcttactatggcccatccccaccatttccgtggcaacggcacactgagctggaactttggaagtgacatggctgtgtctgtgccatggtacctggggctggcatttcggacacgggcaacgcagggggtcctgatgcaagtgcaggctgggccacacagcacgctcctttgccagctagatcgggggttactgtctgtgacagtgaccaggggctcgggccgtgcttcccatctccttctggaccaggtgactgtcagtgatggccggtggcacgatctgcggctggagttgcaggaggaaccaggtggccggcggggccaccatgtccttatggtctcactggactttagcctcttccaggacaccatggcggtggggagtgagctgcagggcctgaaggtaaagcagctccacgtgggaggcctgccccccggcagtgcagaggaggctcctcagggtctggttggctgcatccagggggtgtggctcggctccacaccctctggctccccggccctgctaccccccagccaccgagtgaatgcggagcctggctgtgttgtgaccaacgcctgtgcctctgggccctgcccacctcacgcagactgccgggacctctggcagaccttttcttgcacctgccagccaggttactacggcccaggctgtgtggatgcctgcctcctgaacccctgtcagaaccagggatcatgccggcacctgccaggagccccccatggctatacctgtgactgtgtgggtggctatttcgggcaccactgtgagcacaggatggaccagcagtgcccacggggctggtgggggagcccaacctgtggcccctgcaactgtgatgttcacaaaggttttgatcccaactgcaacaagacaaatgggcagtgtcactgcaaggagttccactaccgaccgcggggcagtgactcttgcctcccatgtgactgctaccctgtgggctccacctcgcgctcatgtgcaccccacagcgggcagtgcccctgtcgcccaggagcccttggccgccagtgcaacagctgtgacagtcccttcgcagaggtgacagccagcggctgccgggtgctctatgatgcctgccctaagtccctgagatctggtgtgtggtggccccagacaaagtttggcgtcctggccacagtgccctgtccccggggggccctgggtgctgctgtgcggctgtgtgatgaggcccagggttggctggagcccgacctcttcaactgtacctcccctgcctttcgagagctcagtctgctgctggatggcctagagctgaacaagacggcactggataccatggaggccaagaagctggctcagcggctacgggaggtgactggccacactgaccactattttagccaagatgttcgagtcactgcccgcctgctggcccacctgctggccttcgagagccatcagcagggcttcgggctgacagccacacaggatgcccacttcaatgagaatctgctgtgggccggctctgcactgcttgccccagagacaggggacttgtgggcggcgctggggcagcgggcccctgggggctccccaggcagcgcgggactggtgaggcacctggaggagtatgcagccacactcgcaaggaatatggaactcacatacctgaatcccatggggctggtgacgcctaatatcatgctcagcattgaccgcatggagcaccccagttctccccggggggcccgtcgctaccctcgctaccatagcaacctctttcgaggccaggatgcctgggatcctcacacccatgtgctgctgccttcccagtccccacggccatccccatctgaagttctgcccacaagcagcagcatagaaaactccaccacctcaagtgtggtccccccaccagccccgccagagccagagcctgggatctccattatcattctcctcgtttaccgcaccttagggggactgctccctgcccagttccaggcagaacgccgaggtgccaggcttcctcagaaccccgtcatgaactccccggtggtcagcgtggctgtgttccacggacgcaacttcctaaggggaatcctggagtcccccatcagcctagagtttcgcctgctacagacagcgaatcggagcaaggcgatctgtgtgcagtgggacccacctggcctggcggagcagcatggtgtgtggacagcacgggactgcgagctggtgcacaggaatgggtcccacgcacggtgtcgctgcagccggacagggacctttggggtcctcatggatgcctctccccgtgagaggctggagggcgacctggagctgctggctgtgttcacccacgtggtcgtggctgtgtctgtggctgcgctggtgctgactgcagccatcctgctgagcctgcgcagcctcaagtccaatgtgcgtgggatccatgccaatgtggcagccgccctgggggtggcagagctcctcttcctgctggggattcacaggacccacaatcagctggtgtgcactgcagtcgccatcctcctgcactacttcttcctcagcaccttcgcgtggctcttcgtgcaggggctgcacctctaccgcatgcaggttgagccacgcaacgtggaccgcggcgccatgcgcttctaccatgccctgggctggggcgtccctgctgtgctgctgggccttgctgtgggcctggaccctgagggctatgggaaccctgacttctgctggatctcagtccacgagcccctcatctggagctttgctggccctgttgtcctggtcatagtgatgaacgggaccatgtttctcctcgctgcccgcacatcctgctccacagggcagagggaggccaagaagacctctgcactgacccttcgcagctccttcctgctgcttctgctggtcagtgcctcctggctctttgggctcctggcagtcaaccacagcatcctagccttccactacctccatgctggactctgcggcctccagggcctggcggtgctgctgctcttctgtgtcctaaatgcagatgctcgggctgcctggatgccagcctgtctgggcaggaaggcagcgcctgaggaggcaaggccagcacctgggctgggacctggggcctacaacaacacggctctctttgaggagagtggcctcatccgcatcactctgggcgcctccaccgtctcctctgtgagcagtgcccgctccggccggacccaggaccaggacagccagcggggccgcagctacctcagggacaatgtcctggttcgacatggctcagccgctgaccacactgaccacagcctccaggctcatgctggccccactgacctggacgtggccatgttccatcgagatgctggcgcagactccgactctgacagtgacctgtccttggaggaggagaggagtctctccattccatcttcagaaagcgaggacaatggccggacgcgggggcgcttccaacggccactctgccgagcagcccagagtgagaggctcctcacccaccccaaagatgtggatggcaatgacctcctgtcctactggccagccctgggggagtgcgaggcagccccctgtgctctgcagacttggggctctgaaaggcgcctggggctggacaccagcaaggatgcagctaacaacaaccagccagacccggccctgaccagtggggatgagacttctctgggccgggcccagcgccagaggaaaggcatcctgaagaaccggttgcaatacccactggtgccacagacccgaggtgcccctgagctgtcctggtgccgtgcagccaccttgggccaccgtgcagtgccagctgcctcttacggtcgcatctatgctggcgggggcacgggcagcctttcacagccagccagccgctactcttctagagaacagctggacctgctcctccggcggcaactgagccgtgagcgactagaggaagcccctgcccctgttctacgtcccctgagccggccagggtcccaggaatgcatggatgctgcaccaggccgactggagcccaaagatcggggcagcaccctgccacggaggcagccacctcgggactaccctggcgccatggctggccgcttcgggtcacgggatgcgctcgacttaggggcacctcgagagtggttgagcacgctgcctccgccccgccgcacccgggaccttgacccacagcccccacctctgcccctgtctccccagcggcaactctcaagggaccccctcttgccatcccggccgctggactctctgtctaggagctcgaactctcgggagcagctggaccaggtgcctagccggcacccctcacgagaagcccttgggccactcccgcagctgctcagagctagggaggactcggtcagtggccccagccatggcccctccacagaacagttggacattctttcctccatccttgcctctttcaactcctcggccctctcctctgtgcaatcttcaagcacacccttgggccctcacaccactgccacaccttctgccacagcctctgtgcttgggccctccacgccacgttctgccacgtctcacagcatctcggagctgtcgccagactcagaagttcccagaagtgagggtcactcctga

SEQ ID NO: 945 - DNA, 1383 bp, Homo sapiens
atgaacacttcagccccacctgctgtcagccccaacatcaccgtcctggcaccaggaaaggggccctggcaagtggccttcattgggatcaccacgggcctcctgtcgctagccacagtgacaggcaacctgctggtactcatctccttcaaggtcaacacggagctcaagacagtcaataactacttcctgctgagcctggcctgtgctgacctcatcatcggtaccttctccatgaacctctataccacgtacctgctcatgggccactgggctctgggcacgctggcttgtgacctctggctggccctggactatgtggccagcaatgcctccgtcatgaatctgctgctcatcagctttgaccgctacttctccgtgactcggcccctgagctaccgtgccaagcgcacaccccgccgggcagctctgatgatcggcctggcctggctggtttcctttgtgctctgggccccagccatcctcttctggcagtacctggtaggggagcggacagtgctagctgggcagtgctacatccagttcctctcccagcccatcatcacctttggcacagccatggctgccttctacctccctgtcacagtcatgtgcacgctctactggcgcatctaccgggagacagagaaccgagcacgggagctggcagcccttcagggctccgagacgccaggcaaagggggtggcagcagcagcagctcagagaggtctcagccaggggctgagggctcaccagagactcctccaggccgctgctgccgctgctgccgggcccccaggctgctgcaggcctacagctggaaggaagaagaggaagaggacgaaggctccatggagtccctcacatcctcagagggagaggagcctggctccgaagtggtgatcaagatgccaatggtggaccccgaggcacaggcccccaccaagcagcccccacggagctccccaaatacagtcaagaggccgactaagaaagggcgtgatcgagctggcaagggccagaagccccgtggaaaggagcagctggccaagcggaagaccttctcgctggtcaaggagaagaaggcggctcggaccctgagtgccatcctcctggccttcatcctcacctggacaccgtacaacatcatggtgctggtgtccacgttctgcaaggactgtgttcccgagaccctgtgggagctgggctactggctgtgctacgtcaacagcaccatcaaccccatgtgctacgcactctgcaacaaagccttccgggacacctttcgcctgctgctgctttgccgctgggacaagagacgctggcgcaagatccccaagcgccctggctccgtgcaccgcactccctcccgccaatgctga

SEQ ID NO: 946 - DNA, 1401 bp, Homo sapiens
atgaataactcaacaaactcctctaacaatagcctggctcttacaagtccttataagacatttgaagtggtgtttattgtcctggtggctggatccctcagtttggtgaccattatcgggaacatcctagtcatggtttccattaaagtcaaccgccacctccagaccgtcaacaattactttttattcagcttggcctgtgctgaccttatcataggtgttttctccatgaacttgtacaccctctacactgtgattggttactggcctttgggacctgtggtgtgtgacctttggctagccctggactatgtggtcagcaatgcctcagttatgaatctgctcatcatcagctttgacaggtacttctgtgtcacaaaacctctgacctacccagtcaagcggaccacaaaaatggcaggtatgatgattgcagctgcctgggtcctctctttcatcctctgggctccagccattctcttctggcagttcattgtaggggtgagaactgtggaggatggggagtgctacattcagtttttttccaatgctgctgtcacctttggtacggctattgcagccttctatttgccagtgatcatcatgactgtgctatattggcacatatcccgagccagcaagagcaggataaagaaggacaagaaggagcctgttgccaaccaagaccccgtttctccaagtctggtacaaggaaggatagtgaagccaaacaataacaacatgcccagcagtgacgatggcctggagcacaacaaaatccagaatggcaaagcccccagggatcctgtgactgaaaactgtgttcagggagaggagaaggagagctccaatgactccacctcagtcagtgctgttgcctctaatatgagagatgatgaaataacccaggatgaaaacacagtttccacttccctgggccattccaaagatgagaactctaagcaaacatgcatcagaattggcaccaagaccccaaaaagtgactcatgtaccccaactaataccaccgtggaggtagtggggtcttcaggtcagaatggagatgaaaagcagaatattgtagcccgcaagattgtgaagatgactaagcagcctgcaaaaaagaagcctcctccttcccgggaaaagaaagtcaccaggacaatcttggctattctgttggctttcatcatcacttgggccccatacaatgtcatggtgctcattaacaccttttgtgcaccttgcatccccaacactgtgtggacaattggttactggctttgttacatcaacagcactatcaaccctgcctgctatgcactttgcaatgccaccttcaagaagacctttaaacaccttctcatgtgtcattataagaacataggcgctacaaggtaa

SEQ ID NO: 947 - DNA, 1773 bp, Homo sapiens
atgaccttgcacaataacagtacaacctcgcctttgtttccaaacatcagctcctcctggatacacagcccctccgatgcagggctgcccccgggaaccgtcactcatttcggcagctacaatgtttctcgagcagctggcaatttctcctctccagacggtaccaccgatgaccctctgggaggtcataccgtctggcaagtggtcttcatcgctttcttaacgggcatcctggccttggtgaccatcatcggcaacatcctggtaattgtgtcatttaaggtcaacaagcagctgaagacggtcaacaactacttcctcttaagcctggcctgtgccgatctgattatcggggtcatttcaatgaatctgtttacgacctacatcatcatgaatcgatgggccttagggaacttggcctgtgacctctggcttgccattgactacgtagccagcaatgcctctgttatgaatcttctggtcatcagctttgacagatacttttccatcacgaggccgctcacgtaccgagccaaacgaacaacaaagagagccggtgtgatgatcggtctggcttgggtcatctcctttgtcctttgggctcctgccatcttgttctggcaatactttgttggaaagagaactgtgcctccgggagagtgcttcattcagttcctcagtgagcccaccattacttttggcacagccatcgctgctttttatatgcctgtcaccattatgactattttatactggaggatctataaggaaactgaaaagcgtaccaaagagcttgctggcctgcaagcctctgggacagaggcagagacagaaaactttgtccaccccacgggcagttctcgaagctgcagcagttacgaacttcaacagcaaagcatgaaacgctccaacaggaggaagtatggccgctgccacttctggttcacaaccaagagctggaaacccagctccgagcagatggaccaagaccacagcagcagtgacagttggaacaacaatgatgctgctgcctccctggagaactccgcctcctccgacgaggaggacattggctccgagacgagagccatctactccatcgtgctcaagcttccgggtcacagcaccatcctcaactccaccaagttaccctcatcggacaacctgcaggtgcctgaggaggagctggggatggtggacttggagaggaaagccgacaagctgcaggcccagaagagcgtggacgatggaggcagttttccaaaaagcttctccaagcttcccatccagctagagtcagccgtggacacagctaagacttctgacgtcaactcctcagtgggtaagagcacggccactctacctctgtccttcaaggaagccactctggccaagaggtttgctctgaagaccagaagtcagatcactaagcggaaaaggatgtccctggtcaaggagaagaaagcggcccagaccctcagtgcgatcttgcttgccttcatcatcacttggaccccatacaacatcatggttctggtgaacaccttttgtgacagctgcatacccaaaaccttttggaatctgggctactggctgtgctacatcaacagcaccgtgaaccccgtgtgctatgctctgtgcaacaaaacattcagaaccactttcaagatgctgctgctgtgccagtgtgacaaaaaaaagaggcgcaagcagcagtaccagcagagacagtcggtcatttttcacaagcgcgcacccgagcaggccttgtag

SEQ ID NO: 948 - DNA, 1437 bp, Homo sapiens
atggccaacttcacacctgtcaatggcagctcgggcaatcagtccgtgcgcctggtcacgtcatcatcccacaatcgctatgagacggtggaaatggtcttcattgccacagtgacaggctccctgagcctggtgactgtcgtgggcaacatcctggtgatgctgtccatcaaggtcaacaggcagctgcagacagtcaacaactacttcctcttcagcctggcgtgtgctgatctcatcataggcgccttctccatgaacctctacaccgtgtacatcatcaagggctactggcccctgggcgccgtggtctgcgacctgtggctggccctggactacgtggtgagcaacgcctccgtcatgaaccttctcatcatcagctttgaccgctacttctgcgtcaccaagcctctcacctaccctgcccggcgcaccaccaagatggcaggcctcatgattgctgctgcctgggtactgtccttcgtgctctgggcgcctgccatcttgttctggcagtttgtggtgggtaagcggacggtgcccgacaaccactgcttcatccagttcctgtccaacccagcagtgacctttggcacagccattgctgccttctacctgcctgtggtcatcatgacggtgctgtacatccacatctccctggccagtcgcagccgagtccacaagcaccggcccgagggcccgaaggagaagaaagccaagacgctggccttcctcaagagcccactaatgaagcagagcgtcaagaagccccgcccgggaggccgcccgggaggactgcgcaatggcaagctggaggaggcccccccgccagcgctgccaccgccaccgcgccccgtggctgataaggacacttccaatgagtccagctcaggcagtgccacccagaacaccaaggaacgcccagccacagagctgtccaccacagaggccaccactcccgccatgcccgcccctcccctgcagccgcgggccctcaacccagcctccagatggtccaagatccagattgtgacgaagcagacaggcaatgagtgtgtgacagccattgagattgtgcctgccacgccggctggcatgcgccctgcggccaacgtggcccgcaagttcgccagcatcgctcgcaaccaggtgcgcaagaagcggcagatggcggcccgggagcgcaaagtgacacgaacgatctttgccattctgctagccttcatcctcacctggacgccctacaacgtcatggtcctggtgaacaccttctgccagagctgcatccctgacacggtgtggtccattggctactggctctgctacgtcaacagcaccatcaaccctgcctgctatgctctgtgcaacgccacctttaaaaagaccttccggcacctgctgctgtgccagtatcggaacatcggcactgccaggtag

SEQ ID NO: 949 - DNA, 1599 bp, Homo sapiens
atggaaggggattcttaccacaatgcaaccaccgtcaatggcaccccagtaaatcaccagcctttggaacgccacaggttgtgggaagtcatcaccattgcagctgtgactgctgtggtaagcctgatcaccattgtgggcaatgtcttggtcatgatctccttcaaagtcaacagccagctcaagacagttaacaactattacctgctcagcttagcctgtgcagatctcatcattggaatcttctccatgaacctctacaccacctacatcctcatgggacgctgggctctcgggagtctggcttgtgacctttggcttgcactggactacgtggccagcaacgcttctgtcatgaaccttctggtgatcagttttgaccgttacttttccatcacaagacccttgacatatcgggccaagcgtactccgaaaagggctggcatcatgattggcttggcctggctgatctccttcatcctctgggccccagcaatcctctgctggcagtacttggttgggaagcggacagttccactggatgagtgccagatccagtttctctctgagcccaccatcacttttggcactgccattgctgccttctacatccctgtttctgtcatgaccatcctctactgtcgaatctaccgggaaacagagaagcgaaccaaggacctggctgacctccagggttctgactctgtgaccaaagctgagaagagaaagccagctcatagggctctgttcagatcctgcttgcgctgtcctcgacccaccctggcccagcgggaaaggaaccaggcctcctggtcatcctcccgcaggagcacctccaccactgggaagccatcccaagccactggcccaagcgccaattgggccaaagctgagcagctcaccacctgtagcagctacccttcctcagaggatgaggacaagcccgccactgaccctgtcctccaagtggtctacaagagtcagggtaaggaaagcccaggggaagaattcagtgctgaagagactgaggaaacttttgtgaaagctgaaactgaaaaaagtgactatgacaccccaaactaccttctgtctccagcagctgctcatagacccaagagtcagaaatgtgtggcctataagttccgattggtggtaaaagctgacgggaaccaggagaccaacaatggctgtcacaaggtgaaaatcatgccctgccccttcccagtggccaaggaaccttcaacgaaaggcctcaatcccaaccccagccatcaaatgaccaaacgaaagagagtggtcctagtcaaagagaggaaagcagcccagacactgagtgccattctcctggccttcatcatcacatggaccccgtataacatcatggtcctggtttctaccttctgtgacaagtgtgtcccagtcaccctgtggcacttgggctattggttgtgctatgtcaatagcactgtcaaccccatctgctatgccctctgcaacagaaccttcaggaagacctttaagatgctgcttctctgccgatggaaaaagaaaaaagtggaagagaagttgtactggcaggggaacagcaagctaccctga

SEQ ID NO: 950 - DNA, 1900 bp, Homo sapiens
gaattcggcacgagtcagggaagcagccccggcggccagcagggagctcaggacagagcaggctccctgggaagcctccgggtgataggggtgttccagctgcggcgctctgggggttcagagggggatcttgaatgaacaaatgaatgaactgctttctgggcaaacagccacagccagaggagcctgtgattggcagaaagaagccagggtgtgcaagtctccccaacagcctcgagtggcctgcagtcacagggaaccctcaggaagaccttccgggcagagaccagagggaagcccatctctccagcagaactgcttggatttttctaccaggaggctcagggctctgcaacaatgatagcagaagctgatggcatctagagatctaggctgggactagcacagcatcacttctaccactttctgttggtcacagcaactcaccatgccagtgcagattcaaggggaggagaaatagagtccacttcttgatgggaggcgtgacatagaatggaggatgaagattacaacacttccatcagttacggtgatgaataccctgattatttagactccattgtggttttggaggacttatcccccttggaagccagggtgaccaggatcttcctggtggtggtctacagcatcgtctgcttcctcgggattctgggcaatggtctggtgatcatcattgccaccttcaagatgaagaagacagtgaacatggtctggttcctcaacctggcagtggcagatttcctgttcaacgtcttcctcccaatccatatcacctatgccgccatggactaccactgggttttcgggacagccatgtgcaagatcagcaacttccttctcatccacaacatgttcaccagcgtcttcctgctgaccatcatcagctctgaccgctgcatctctgtgctcctccctgtctggtcccagaaccaccgcagcgttcgcctggcttacatggcctgcatggtcatctgggtcctggctttcttcttgagttccccatctctcgtcttccgggacacagccaacctgcatgggaaaatatcctgcttcaacaacttcagcctgtccacacctgggtcttcctcgtggcccactcactcccaaatggaccctgtggggtatagccggcacatggtggtgactgtcacccgcttcctctgtggcttcctggtcccagtcctcatcatcacagcttgctacctcaccatcgtgtgcaaactgcagcgcaaccgcctggccaagaccaagaagcccttcaagattattgtgaccatcatcattaccttcttcctctgctggtgcccctaccacacactcaacctcctagagctccaccacactgccatgcctggctctgtcttcagcctgggtttgcccctggccactgcccttgccattgccaacagctgcatgaaccccattctgtatgttttcatgggtcaggacttcaagaagttcaaggtggccctcttctctcgcctggtcaatgctctaagtgaagatacaggccactcttcctaccccagccatagaagctttaccaagatgtcatcaatgaatgagaggacttctatgaatgagagggagaccggcatgctttgatcctcactgtggaacccctcaatggactctctcaacccagggacacccaaggatatgtcttctgaagatcaaggcaagaacctctttagcatccaccaattttcactgcattttgcatgggatgaacagtgttttatgctgggaatctagggcctggaacccctttcttctagtggacagaacatgctgtgttccatacagccttggactagcaatttatgcttcttgggaggccagccttgactgactcaaagcaaaaaaggaagaattc

SEQ ID NO: 951 - DNA, 1419 bp, Homo sapiens
atgaagtcgatcctagatggccttgcagataccaccttccgcaccatcaccactgacctcctgtacgtgggctcaaatgacattcagtacgaagacatcaaaggtgacatggcatccaaattagggtacttcccacagaaattccctttaacttcctttaggggaagtcccttccaagagaagatgactgcgggagacaacccccagctagtcccagcagaccaggtgaacattacagaattttacaacaagtctctctcgtccttcaaggagaatgaggagaacatccagtgtggggagaacttcatggacatagagtgtttcatggtcctgaaccccagccagcagctggccattgcagtcctgtccctcacgctgggcaccttcacggtcctggagaacctcctggtgctgtgcgtcatcctccactcccgcagcctccgctgcaggccttcctaccacttcatcggcagcctggcggtggcagacctcctggggagtgtcatttttgtctacagcttcattgacttccacgtgttccaccgcaaagatagccgcaacgtgtttctgttcaaactgggtggggtcacggcctccttcactgcctccgtgggcagcctgttcctcacagccatcgacaggtacatatccattcacaggcccctggcctataagaggattgtcaccaggcccaaggccgtggtggcgttttgcctgatgtggaccatagccattgtgatcgccgtgctgcctctcctgggctggaactgcgagaaactgcaatctgtttgctcagacattttcccacacattgatgaaacctacctgatgttctggatcggggtcaccagcgtactgcttctgttcatcgtgtatgcgtacatgtatattctctggaaggctcacagccacgccgtccgcatgattcagcgtggcacccagaagagcatcatcatccacacgtctgaggatgggaaggtacaggtgacccggccagaccaagcccgcatggacattaggttagccaagaccctggtcctgatcctggtggtgttgatcatctgctggggccctctgcttgcaatcatggtgtatgatgtctttgggaagatgaacaagctcattaagacggtgtttgcattctgcagtatgctctgcctgctgaactccaccgtgaaccccatcatctatgctctgaggagtaaggacctgcgacacgctttccggagcatgtttccctcttgtgaaggcactgcgcagcctctggataacagcatgggggactcggactgcctgcacaaacacgcaaacaatgcagccagtgttcacagggccgcagaaagctgcatcaagagcacagtcaagattgccaaggtaaccatgtctgtgtccacagacacgtctgccgaggctctgtga

SEQ ID NO: 952 - DNA, 1083 bp, Homo sapiens
atggaggaatgctgggtgacagagatagccaatggctccaaggatggcttggattccaaccctatgaaggattacatgatcctgagtggtccccagaagacagctgttgctgtgttgtgcactcttctgggcctgctaagtgccctggagaacgtggctgtgctctatctgatcctgtcctcccaccaactccgccggaagccctcatacctgttcattggcagcttggctggggctgacttcctggccagtgtggtctttgcatgcagctttgtgaatttccatgttttccatggtgtggattccaaggctgtcttcctgctgaagattggcagcgtgactatgaccttcacagcctctgtgggtagcctcctgctgaccgccattgaccgatacctctgcctgcgctatccaccttcctacaaagctctgctcacccgtggaagggcactggtgaccctgggcatcatgtgggtcctctcagcactagtctcctacctgcccctcatgggatggacttgctgtcccaggccctgctctgagcttttcccactgatccccaatgactacctgctgagctggctcctgttcatcgccttcctcttttccggaatcatctacacctatgggcatgttctctggaaggcccatcagcatgtggccagcttgtctggccaccaggacaggcaggtgccaggaatggcccgaatgaggctggatgtgaggttggccaagaccctagggctagtgttggctgtgctcctcatctgttggttcccagtgctggccctcatggcccacagcctggccactacgctcagtgaccaggtcaagaaggcctttgctttctgctccatgctgtgcctcatcaactccatggtcaaccctgtcatctatgctctacggagtggagagatccgctcctctgcccatcactgcctggctcactggaagaagtgtgtgaggggccttgggtcagaggcaaaagaagaagccccgagatcctcagtcaccgagacagaggctgatgggaaaatcactccgtggccagattccagagatctagacctctctgattgctga

SEQ ID NO: 953 - DNA, 2536 bp, Homo sapiens
ggggaaacggcggccagacttccccgggaaggggcgagcgagagccgggccgggccgggccgggccgcggggccgggaagcgccgagccgggcatctcctcaccaggcagcgaccgaggagcccggccgcccaccccgtgccgcccgagcccgcagccgcccgccggtccctctgggatgtccgtaggacccgggcattcaggacggtagccgagcgagcccgaggatgggagggcacccgcagctccgtctcgtcaaggcccttctccttctggggctgaaccccgtctctgcctccctccaggaccagcactgcgagagcctgtccctggccagcaacatctcaggactgcagtgcaacgcatccgtggacctcattggcacctgctggccccgcagccctgcggggcagctagtggttcggccctgccctgcctttttctatggtgtccgctacaataccacaaacaatggctaccgggagtgcctggccaatggcagctgggccgcccgcgtgaattactccgagtgccaggagatcctcaatgaggagaaaaaaagcaaggtgcactaccatgtcgcagtcatcatcaactacctgggccactgtatctccctggtggccctcctggtggcctttgtcctctttctgcggctcaggagcatccggtgcctgcgaaacatcatccactggaacctcatctccgccttcatcctgcgcaacgccacctggttcgtggtccagctaaccatgagccccgaggtccaccagagcaacgtgggctggtgcaggttggtgacagccgcctacaactacttccatgtgaccaacttcttctggatgttcggcgagggctgctacctgcacacagccatcgtgctcacctactccactgaccggctgcgcaaatggatgttcatctgcattggctggggtgtgcccttccccatcattgtggcctgggccattgggaagctgtactacgacaatgagaagtgctggtttggcaaaaggcctggggtgtacaccgactacatctaccagggccccatgatcctggtcctgctgatcaatttcatcttccttttcaacatcgtccgcatcctcatgaccaagctccgggcatccaccacgtctgagaccattcagtacaggaaggctgtgaaagccactctggtgctgctgcccctcctgggcatcacctacatgctgttcttcgtcaatcccggggaggatgaggtctcccgggtcgtcttcatctacttcaactccttcctggaatccttccagggcttctttgtgtctgtgttctactgtttcctcaatagtgaggtccgttctgccatccggaagaggtggcaccggtggcaggacaagcactcgatccgtgcccgagtggcccgtgccatgtccatccccacctccccaacccgtgtcagctttcacagcatcaagcagtccacagcagtctgagctggcaggtcatggagcagcccccaaagagctgtggctggggggatgacggccaggctccctgaccaccctgcctgtggaggtgacctgttaggtctcatgcccactcccccaggagcagctggcactgacagcctgggggggccgctctccccctgcagccgtgcaggactctagctcatgagtggaaagtcacctacaggactgggccgggcccagggcctctggcttccctgcccaatcctccctggagaagggacatgggaatgaattgaaatggggcgctggacacctacagcagcacgcatgtccctccaaggctgtcttctcccagagcacaagaaggccagcccactgggccctggggctgccctcggcaaccgtggggaggccatttgctgccctggggcatcatgggcaactcgtgacagcctctgactcaccacgatgacgcctctggacctcggtgatgccttccgacaccactgggaaccaagggccctcactcaggaaccctggagacagaagtcaggtgtcatcatcagacttgcggccacagcactagagtcacccccccaggcctccagaaccttactggcactgtggcactgccaccagcaatgccctgccttgctgccttcaccctgaacatttagtaccctgcaggccaggccagcttcccctcacttaaccaccccataccagtcacctcctgctccttttcctcttttgtgagaagatgggggctggagggggcagagtggcctgtgagcaagagccaggggtgtcccagtcccagcctctggggcagagcttgtagccctggatggcctctggggcaggaccactagctaagcaagccaggagaagacccctgcccaagtggctcttgggacaacgtgctgcttacactccaggtgtggaccggccgcagcccccactgacctgcccatgtccagagggactggacagccagggcagggctttggggggcactagaagatgagggtgtcggctgtgaggcgggtggctggtataaataatatttatcttttcaaccag

SEQ ID NO: 954 - DNA, 1236 bp, Homo sapiens
atggacgcggcactgctccacagcctgctggaggccaactgcagcctggcgctggctgaagagctgctcttggacggctgggggccacccctggaccccgagggtccctactcctactgcaacacgaccttggaccagatcggaacgtgctggccccgcagcgctgccggagccctcgtggagaggccgtgccccgagtacttcaacggcgtcaagtacaacacgacccggaatgcctatcgagaatgcttggagaatgggacgtgggcctcaaagatcaactactcacagtgtgagcccattttggatgacaagcagaggaagtatgacctgcactaccgcatcgcccttgtcgtcaactacctgggccactgcgtatctgtggcagccctggtggccgccttcctgcttttcctggccctgcggagcattcgctgtctgcggaatgtgattcactggaacctcatcaccacctttatcctgcgaaatgtcatgtggttcctgctgcagctcgttgaccatgaagtgcacgagagcaatgaggtctggtgccactgcatcaccaccatcttcaactacttcgtggtgaccaacttcttctggatgtttgtggaaggctgctacctgcacacggccattgtcatgacctactccactgagcgcctgcgcaagtgcctcttcctcttcatcggatggtgcatccccttccccatcatcgtcgcctgggccatcggcaagctctactatgagaatgaacagtgctggtttggcaaggagcctggcgacctggtggactacatctaccaaggccccatcattctcgtgctcctgatcaatttcgtatttctgttcaacatcgtcaggatcctaatgacaaagttacgcgcgtccaccacatccgagacaatccagtacaggaaggcagtgaaggccaccctggtgctcctgcccctcctgggcatcacctacatgctcttcttcgtcaatcccggggaggacgacctgtcacagatcatgttcatctatttcaactccttcctgcagtcgttccagggtttcttcgtgtctgtcttctactgcttcttcaatggagaggtgcgctcagccgtgaggaagaggtggcaccgctggcaggaccatcactcccttcgagtccccatggcccgggccatgtccatccctacatcacccacacggatcagcttccacagcatcaagcagacggccgctgtgtga

SEQ ID NO: 955 - DNA, 1068 bp, Homo sapiens
atggatcagttccctgaatcagtgacagaaaactttgagtacgatgatttggctgaggcctgttatattggggacatcgtggtctttgggactgtgttcctgtccatattctactccgtcatctttgccattggcctggtgggaaatttgttggtagtgtttgccctcaccaacagcaagaagcccaagagtgtcaccgacatttacctcctgaacctggccttgtctgatctgctgtttgtagccactttgcccttctggactcactatttgataaatgaaaagggcctccacaatgccatgtgcaaattcactaccgccttcttcttcatcggcttttttggaagcatattcttcatcaccgtcatcagcattgataggtacctggccatcgtcctggccgccaactccatgaacaaccggaccgtgcagcatggcgtcaccatcagcctaggcgtctgggcagcagccattttggtggcagcaccccagttcatgttcacaaagcagaaagaaaatgaatgccttggtgactaccccgaggtcctccaggaaatctggcccgtgctccgcaatgtggaaacaaattttcttggcttcctactccccctgctcattatgagttattgctacttcagaatcatccagacgctgttttcctgcaagaaccacaagaaagccaaagccattaaactgatccttctggtggtcatcgtgtttttcctcttctggacaccctacaacgttatgattttcctggagacgcttaagctctatgacttctttcccagttgtgacatgaggaaggatctgaggctggccctcagtgtgactgagacggttgcatttagccattgttgcctgaatcctctcatctatgcatttgctggggagaagttcagaagatacctttaccacctgtatgggaaatgcctggctgtcctgtgtgggcgctcagtccacgttgatttctcctcatctgaatcacaaaggagcaggcatggaagtgttctgagcagcaattttacttaccacacgagtgatggagatgcattgctccttctctga

SEQ ID NO: 956 - DNA, 1059 bp, Homo sapiens
atggaggggatcagtatatacacttcagataactacaccgaggaaatgggctcaggggactatgactccatgaaggaaccctgtttccgtgaagaaaatgctaatttcaataaaatcttcctgcccaccatctactccatcatcttcttaactggcattgtgggcaatggattggtcatcctggtcatgggttaccagaagaaactgagaagcatgacggacaagtacaggctgcacctgtcagtggccgacctcctctttgtcatcacgcttcccttctgggcagttgatgccgtggcaaactggtactttgggaacttcctatgcaaggcagtccatgtcatctacacagtcaacctctacagcagtgtcctcatcctggccttcatcagtctggaccgctacctggccatcgtccacgccaccaacagtcagaggccaaggaagctgttggctgaaaaggtggtctatgttggcgtctggatccctgccctcctgctgactattcccgacttcatctttgccaacgtcagtgaggcagatgacagatatatctgtgaccgcttctaccccaatgacttgtgggtggttgtgttccagtttcagcacatcatggttggccttatcctgcctggtattgtcatcctgtcctgctattgcattatcatctccaagctgtcacactccaagggccaccagaagcgcaaggccctcaagaccacagtcatcctcatcctggctttcttcgcctgttggctgccttactacattgggatcagcatcgactccttcatcctcctggaaatcatcaagcaagggtgtgagtttgagaacactgtgcacaagtggatttccatcaccgaggccctagctttcttccactgttgtctgaaccccatcctctatgctttccttggagccaaatttaaaacctctgcccagcacgcactcacctctgtgagcagagggtccagcctcaagatcctctccaaaggaaagcgaggtggacattcatctgtttccactgagtctgagtcttcaagttttcactccagctaa

SEQ ID NO: 957 - DNA, 1029 bp, Homo sapiens
atggcagagcatgattaccatgaagactatgggttcagcagtttcaatgacagcagccaggaggagcatcaagacttcctgcagttcagcaaggtctttctgccctgcatgtacctggtggtgtttgtctgtggtctggtggggaactctctggtgctggtcatatccatcttctaccataagttgcagagcctgacggatgtgttcctggtgaacctacccctggctgacctggtgtttgtctgcactctgcccttctgggcctatgcaggcatccatgaatgggtgtttggccaggtcatgtgcaagagcctactgggcatctacactattaacttctacacgtccatgctcatcctcacctgcatcactgtggatcgtttcattgtagtggttaaggccaccaaggcctacaaccagcaagccaagaggatgacctggggcaaggtcaccagcttgctcatctgggtgatatccctgctggtttccttgccccaaattatctatggcaatgtctttaatctcgacaagctcatatgtggttaccatgacgaggcaatttccactgtggttcttgccacccagatgacactggggttcttcttgccactgctcaccatgattgtctgctattcagtcataatcaaaacactgcttcatgctggaggcttccagaagcacagatctctaaagatcatcttcctggtgatggctgtgttcctgctgacccagatgcccttcaacctcatgaagttcatccgcagcacacactgggaatactatgccatgaccagctttcactacaccatcatggtgacagaggccatcgcatacctgagggcctgccttaaccctgtgctctatgcctttgtcagcctgaagtttcgaaagaacttctggaaacttgtgaaggacattggttgcctcccttaccttggggtctcacatcaatggaaatcttctgaggacaattccaagactttttctgcctcccacaatgtggaggccaccagcatgttccagttatag

SEQ ID NO: 958 - DNA, 1014 bp, Homo sapiens
atggatgaaacaggaaatctgacagtatcttctgccacatgccatgacactattgatgacttccgcaatcaagtgtattccaccttgtactctatgatctctgttgtaggcttctttggcaatggctttgtgctctatgtcctcataaaaacctatcacaagaagtcagccttccaagtatacatgattaatttagcagtagcagatctactttgtgtgtgcacactgcctctccgtgtggtctattatgttcacaaaggcatttggctctttggtgacttcttgtgccgcctcagcacctatgctttgtatgtcaacctctattgtagcatcttctttatgacagccatgagctttttccggtgcattgcaattgtttttccagtccagaacattaatttggttacacagaaaaaagccaggtttgtgtgtgtaggtatttggatttttgtgattttgaccagttctccatttctaatggccaaaccacaaaaagatgagaaaaataataccaagtgctttgagcccccacaagacaatcaaactaaaaatcatgttttggtcttgcattatgtgtcattgtttgttggctttatcatcccttttgttattataattgtctgttacacaatgatcattttgaccttactaaaaaaatcaatgaaaaaaaatctgtcaagtcataaaaaggctataggaatgatcatggtcgtgaccgctgcctttttagtcagtttcatgccatatcatattcaacgtaccattcaccttcattttttacacaatgaaactaaaccctgtgattctgtccttagaatgcagaagtccgtggtcataaccttgtctctggctgcatccaattgttgctttgaccctctcctatatttcttttctgggggtaactttaggaaaaggctgtctacatttagaaagcattctttgtccagcgtgacttatgtacccagaaagaaggcctctttgccagaaaaaggagaagaaatatgtaaagtatag

SEQ ID NO: 959 - DNA, 1041 bp, Homo sapiens
atggagagaaaatttatgtccttgcaaccatccatctccgtatcagaaatggaaccaaatggcaccttcagcaataacaacagcaggaactgcacaattgaaaacttcaagagagaatttttcccaattgtatatctgataatatttttctggggagtcttgggaaatgggttgtccatatatgttttcctgcagccttataagaagtccacatctgtgaacgttttcatgctaaatctggccatttcagatctcctgttcataagcacgcttcccttcagggctgactattatcttagaggctccaattggatatttggagacctggcctgcaggattatgtcttattccttgtatgtcaacatgtacagcagtatttatttcctgaccgtgctgagtgttgtgcgtttcctggcaatggttcacccctttcggcttctgcatgtcaccagcatcaggagtgcctggatcctctgtgggatcatatggatccttatcatggcttcctcaataatgctcctggacagtggctctgagcagaacggcagtgtcacatcatgcttagagctgaatctctataaaattgctaagctgcagaccatgaactatattgccttggtggtgggctgcctgctgccatttttcacactcagcatctgttatctgctgatcattcgggttctgttaaaagtggaggtcccagaatcggggctgcgggtttctcacaggaaggcactgaccaccatcatcatcaccttgatcatcttcttcttgtgtttcctgccctatcacacactgaggaccgtccacttgacgacatggaaagtgggtttatgcaaagacagactgcataaagctttggttatcacactggccttggcagcagccaatgcctgcttcaatcctctgctctattactttgctggggagaattttaaggacagactaaagtctgcactcagaaaaggccatccacagaaggcaaagacaaagtgtgttttccctgttagtgtgtggttgagaaaggaaacaagagtataa

SEQ ID NO: 960 - DNA, 1332 bp, Homo sapiens
atggatccactgaatctgtcctggtatgatgatgatctggagaggcagaactggagccggcccttcaacgggtcagacgggaaggcggacagaccccactacaactactatgccacactgctcaccctgctcatcgctgtcatcgtcttcggcaacgtgctggtgtgcatggctgtgtcccgcgagaaggcgctgcagaccaccaccaactacctgatcgtcagcctcgcagtggccgacctcctcgtcgccacactggtcatgccatgggttgtctacctggaggtggtaggtgagtggaaattcagcaggattcactgtgacatcttcgtcactctggacgtcatgatgtgcacggcgagcatcctgaacttgtgtgccatcagcatcgacaggtacacagctgtggccatgcccatgctgtacaatacgcgctacagctccaagcgccgggtcaccgtcatgatctccatcgtctgggtcctgtccttcaccatctcctgcccactcctcttcggactcaataacgcagaccagaacgagtgcatcattgccaacccggccttcgtggtctactcctccatcgtctccttctacgtgcccttcattgtcaccctgctggtctacatcaagatctacattgtcctccgcagacgccgcaagcgagtcaacaccaaacgcagcagccgagctttcagggcccacctgagggctccactaaagggcaactgtactcaccccgaggacatgaaactctgcaccgttatcatgaagtctaatgggagtttcccagtgaacaggcggagagtggaggctgcccggcgagcccaggagctggagatggagatgctctccagcaccagcccacccgagaggacccggtacagccccatcccacccagccaccaccagctgactctccccgacccgtcccaccacggtctccacagcactcctgacagccccgccaaaccagagaagaatgggcatgccaaagaccaccccaagattgccaagatctttgagatccagaccatgcccaatggcaaaacccggacctccctcaagaccatgagccgtagaaagctctcccagcagaaggagaagaaagccactcagatgctcgccattgttctcggcgtgttcatcatctgctggctgcccttcttcatcacacacatcctgaacatacactgtgactgcaacatcccgcctgtcctgtacagcgccttcacgtggctgggctatgtcaacagcgccgtgaaccccatcatctacaccaccttcaacattgagttccgcaaggccttcctgaagatccttcactgctga

SEQ ID NO: 961 - DNA, 1203 bp, Homo sapiens
atggcatctctgagtcagctgagtagccacctgaactacacctgtggggcagagaactccacaggtgccagccaggcccgcccacatgcctactatgccctctcctactgcgcgctcatcctggccatcgtcttcggcaatggcctggtgtgcatggctgtgctgaaggagcgggccctgcagactaccaccaactacttagtagtgagcctggctgtggcagacttgctggtggccaccttggtgatgccctgggtggtatacctggaggtgacaggtggagtctggaatttcagccgcatttgctgtgatgtttttgtcaccctggatgtcatgatgtgtacagccagcatccttaatctctgtgccatcagcatagacaggtacactgcagtggtcatgcccgttcactaccagcatggcacgggacagagctcctgtcggcgcgtggccctcatgatcacggccgtctgggtactggcctttgctgtgtcctgccctcttctgtttggctttaataccacaggggaccccactgtctgctccatctccaaccctgattttgtcatctactcttcagtggtgtccttctacctgccctttggagtgactgtccttgtctatgccagaatctatgtggtgctgaaacaaaggagacggaaaaggatcctcactcgacagaacagtcagtgcaacagtgtcaggcctggcttcccccaacaaaccctctctcctgacccggcacatctggagctgaagcgttactacagcatctgccaggacactgccttgggtggaccaggcttccaagaaagaggaggagagttgaaaagagaggagaagactcggaattccctgagtcccaccatagcgcccaagctcagcttagaagttcgaaaactcagcaatggcagattatcgacatctttgaagctggggcccctgcaacctcggggagtgccacttcgggagaagaaggcaacccaaatggtggccattgtgcttggggccttcattgtctgctggctgcccttcttcttgacccatgttctcaatacccactgccagacatgccacgtgtccccagagctttacagtgccacgacatggctgggctacgtgaatagcgccctcaaccctgtgatctataccaccttcaatatcgagttccggaaagccttcctcaagatcctgtcttgctga

SEQ ID NO: 962 - DNA, 1404 bp, Homo sapiens
atggggaaccgcagcaccgcggacgcggacgggctgctggctgggcgcgggccggccgcgggggcatctgcgggggcatctgcggggctggctgggcagggcgcggcggcgctggtggggggcgtgctgctcatcggcgcggtgctcgcggggaactcgctcgtgtgcgtgagcgtggccaccgagcgcgccctgcagacgcccaccaactccttcatcgtgagcctggcggccgccgacctcctcctcgctctcctggtgctgccgctcttcgtctactccgaggtccagggtggcgcgtggctgctgagcccccgcctgtgcgacgccctcatggccatggacgtcatgctgtgcaccgcctccatcttcaacctgtgcgccatcagcgtggacaggttcgtggccgtggccgtgccgctgcgctacaaccggcagggtgggagccgccggcagctgctgctcatcggcgccacgtggctgctgtccgcggcggtggcggcgcccgtactgtgcggcctcaacgacgtgcgcggccgcgaccccgccgtgtgccgcctggaggaccgcgactacgtggtctactcgtccgtgtgctccttcttcctaccctgcccgctcatgctgctgctctactgggccacgttccgcggcctgcagcgctgggaggtggcacgtcgcgccaagctgcacggccgcgcgccccgccgacccagcggccctggcccgccttcccccacgccacccgcgccccgcctcccccaggacccctgcggccccgactgtgcgccccccgcgcccggccttccccggggtccctgcggccccgactgtgcgcccgccgcgcccggcctccccccggacccctgcggccccgactgtgcgccccccgcgcccggcctcccccaggacccctgcggccccgactgtgcgccccccgcgcccggccttccccggggtccctgcggccccgactgtgcgccccccgcgcccggcctcccccaggacccctgcggccccgactgtgcgccccccgcgcccggcctccccccggacccctgcggctccaactgtgctccccccgacgccgtcagagccgccgcgctcccaccccagactccaccgcagacccgcaggaggcggcgtgccaagatcaccggccgggagcgcaaggccatgagggtcctgccggtggtggtcggggccttcctgctgtgctggacgcccttcttcgtggtgcacatcacgcaggcgctgtgtcctgcctgctccgtgcccccgcggctggtcagcgccgtcacctggctgggctacgtcaacagcgccctcaaccccgtcatctacactgtcttcaacgccgagttccgcaacgtcttccgcaaggccctgcgtgcctgctgctga

SEQ ID NO: 963 - DNA, 1143 bp, Homo sapiens
atggggcccaccagcgtcccgctggtcaaggcccaccgcagctcggtctctgactacgtcaactatgatatcatcgtccggcattacaactacacgggaaagctgaatatcagcgcggacaaggagaacagcattaaactgacctcggtggtgttcattctcatctgctgctttatcatcctggagaacatctttgtcttgctgaccatttggaaaaccaagaaattccaccgacccatgtactattttattggcaatctggccctctcagacctgttggcaggagtagcctacacagctaacctgctcttgtctggggccaccacctacaagctcactcccgcccagtggtttctgcgggaagggagtatgtttgtggccctgtcagcctccgtgttcagtctcctcgccatcgccattgagcgctatatcacaatgctgaaaatgaaactccacaacgggagcaataacttccgcctcttcctgctaatcagcgcctgctgggtcatctccctcatcctgggtggcctgcctatcatgggctggaactgcatcagtgcgctgtccagctgctccaccgtgctgccgctctaccacaagcactatatcctcttctgcaccacggtcttcactctgcttctgctctccatcgtcattctgtactgcagaatctactccttggtcaggactcggagccgccgcctgacgttccgcaagaacatttccaaggccagccgcagctctgagaatgtggcgctgctcaagaccgtaattatcgtcctgagcgtcttcatcgcctgctgggcaccgctcttcatcctgctcctgctggatgtgggctgcaaggtgaagacctgtgacatcctcttcagagcggagtacttcctggtgttagctgtgctcaactccggcaccaaccccatcatttacactctgaccaacaaggagatgcgtcgggccttcatccggatcatgtcctgctgcaagtgcccgagcggagactctgctggcaaattcaagcgacccatcatcgccggcatggaattcagccgcagcaaatcggacaattcctcccacccccagaaagacgaaggggacaacccagagaccattatgtcttctggaaacgtcaactcttcttcc

SEQ ID NO: 964 - DNA, 1095 bp, Homo sapiens
atggctgccatctctacttccatccctgtaatttcacagccccagttcacagccatgaatgaaccacagtgcttctacaacgagtccattgccttcttttataaccgaagtggaaagcatcttgccacagaatggaacacagtcagcaagctggtgatgggacttggaatcactgtttgtatcttcatcatgttggccaacctattggtcatggtggcaatctatgtcaaccgccgcttccattttcctatttattacctaatggctaatctggctgctgcagacttctttgctgggttggcctacttctatctcatgttcaacacaggacccaatactcggagactgactgtcagcacatggctccttcgtcagggcctcattgacaccagcctgacggcatctgtggccaacttactggctattgcaatcgagaggcacattacggttttccgcatgcagctccacacacggatgagcaaccggcgggtagtggtggtcattgtggtcatctggactatggccatcgttatgggtgctatacccagtgtgggctggaactgtatctgtgatattgaaaattgttccaacatggcacccctctacagtgactcttacttagtcttctgggccattttcaacttggtgacctttgtggtaatggtggttctctatgctcacatctttggctatgttcgccagaggactatgagaatgtctcggcatagttctggaccccggcggaatcgggataccatgatgagtcttctgaagactgtggtcattgtgcttggggcctttatcatctgctggactcctggattggttttgttacttctagacgtgtgctgtccacagtgcgacgtgctggcctatgagaaattcttccttctccttgctgaattcaactctgccatgaaccccatcatttactcctaccgcgacaaagaaatgagcgccacctttaggcagatcctctgctgccagcgcagtgagaaccccaccggccccacagaaggctcagaccgctcggcttcctccctcaaccacaccatcttggctggagttcacagcaatgatcactctgtggtttag

SEQ ID NO: 965 - DNA, 1134 bp, Homo sapiens
atggcaactgccctcccgccgcgtctccagccggtgcgggggaacgagaccctgcgggagcattaccagtacgtggggaagttggcgggcaggctgaaggaggcctccgagggcagcacgctcaccaccgtgctcttcttggtcatctgcagcttcatcgtcttggagaacctgatggttttgattgccatctggaaaaacaataaatttcacaaccgcatgtactttttcattggcaacctggctctctgcgacctgctggccggcatcgcttacaaggtcaacattctgatgtctggcaagaagacgttcagcctgtctcccacggtctggttcctcagggagggcagtatgttcgtggcccttggggcgtccacctgcagcttactggccatcgccatcgagcggcacttgacaatgatcaaaatgaggccttacgacgccaacaagaggcaccgcgtcttcctcctgatcgggatgtgctggctcattgccttcacgctgggcgccctgcccattctgggctggaactgcctgcacaatctccctgactgctctaccatcctgcccctctactccaagaagtacattgccttctgcatcagcatcttcacggccatcctggtgaccatcgtgatcctctacgcacgcatctacttcctggtgaagtccagcagccgtaaggtggccaaccacaacaactcggagcggtccatggcactgctgcggaccgtggtgattgtggtgagcgtgttcatcgcctgctggtccccactcttcatcctcttcctcattgatgtggcctgcagggtgcaggcgtgccccatcctcttcaaggctcagtggttcatcgtgttggctgtgctcaactccgccatgaacccggtcatctacacgctggccagcaaggagatgcggcgggccttcttccgtctggtctgcaactgcctggtcaggggacggggggcccgcgcctcacccatccagcctgcgctcgacccaagcagaagtaaatcaagcagcagcaacaatagcagccactctccgaaggtcaaggaagacctgccccacacagacccctcatcctgcatcatggacaagaacgcagcacttcagaatgggatcttctgcaac

SEQ ID NO: 966 - DNA, 1149 bp, Homo sapiens
atggtcatcatgggccagtgctactacaacgagaccatcggcttcttctataacaacagtggcaaagagctcagctcccactggcggcccaaggatgtggtcgtggtggcactggggctgaccgtcagcgtgctggtgctgctgaccaatctgctggtcatagcagccatcgcctccaaccgccgcttccaccagcccatctactacctgctcggcaatctggccgcggctgacctcttcgcgggcgtggcctacctcttcctcatgttccacactggtccccgcacagcccgactttcacttgagggctggttcctgcggcagggcttgctggacacaagcctcactgcgtcggtggccacactgctggccatcgccgtggagcggcaccgcagtgtgatggccgtgcagctgcacagccgcctgccccgtggccgcgtggtcatgctcattgtgggcgtgtgggtggctgccctgggcctggggctgctgcctgcccactcctggcactgcctctgtgccctggaccgctgctcacgcatggcacccctgctcagccgctcctatttggccgtctgggctctgtcgagcctgcttgtcttcctgctcatggtggctgtgtacacccgcattttcttctacgtgcggcggcgagtgcagcgcatggcagagcatgtcagctgccacccccgctaccgagagaccacgctcagcctggtcaagactgttgtcatcatcctgggggcgttcgtggtctgctggacaccaggccaggtggtactgctcctggatggtttaggctgtgagtcctgcaatgtcctggctgtagaaaagtacttcctactgttggccgaggccaactcactggtcaatgctgctgtgtactcttgccgagatgctgagatgcgccgcaccttccgccgccttctctgctgcgcgtgcctccgccagtccacccgcgagtctgtccactatacatcctctgcccagggaggtgccagcactcgcatcatgcttcccgagaacggccacccactgatgactccaccctttagctaccttgaacttcagcggtacgcggcaagcaacaaatccacagcccctgatgacttgtgggtgctcctggctcaacccaaccaacaggactga

SEQ ID NO: 967 - DNA, 1062 bp, Homo sapiens
atgggcagcttgtactcggagtacctgaaccccaacaaggtccaggaacactataattataccaaggagacgctggaaacgcaggagacgacctcccgccaggtggcctcggccttcatcgtcatcctctgttgcgccattgtggtggaaaaccttctggtgctcattgcggtggcccgaaacagcaagttccactcggcaatgtacctgtttctgggcaacctggccgcctccgatctactggcaggcgtggccttcgtagccaataccttgctctctggctctgtcacgctgaggctgacgcctgtgcagtggtttgcccgggagggctctgcctccatcacgctctcggcctctgtcttcagcctcctggccatcgccattgagcgccacgtggccattgccaaggtcaagctgtatggcagcgacaagagctgccgcatgcttctgctcatcggggcctcgtggctcatctcgctggtcctcggtggcctgcccatccttggctggaactgcctgggccacctcgaggcctgctccactgtcctgcctctctacgccaagcattatgtgctgtgcgtggtgaccatcttctccatcatcctgttggccatcgtggccctgtacgtgcgcatctactgcgtggtccgctcaagccacgctgacatggccgccccgcagacgctagccctgctcaagacggtcaccatcgtgctaggcgtctttatcgtctgctggctgcccgccttcagcatcctccttctggactatgcctgtcccgtccactcctgcccgatcctctacaaagcccactactttttcgccgtctccaccctgaattccctgctcaaccccgtcatctacacgtggcgcagccgggacctgcggcgggaggtgcttcggccgctgcagtgctggcggccgggggtgggggtgcaaggacggaggcgggtcgggaccccgggccaccacctcctgccactccgcagctccagctccctggagaggggcatgcacatgcccacgtcacccacgtttctggagggcaacacggtggtctga

SEQ ID NO: 968 - DNA, 1155 bp, Homo sapiens
atgaacgccacggggaccccggtggcccccgagtcctgccaacagctggcggccggcgggcacagccggctcattgttctgcactacaaccactcgggccggctggccgggcgcggggggccggaggatggcggcctgggggccctgcgggggctgtcggtggccgccagctgcctggtggtgctggagaacttgctggtgctggcggccatcaccagccacatgcggtcgcgacgctgggtctactattgcctggtgaacatcacgctgagtgacctgctcacgggcgcggcctacctggccaacgtgctgctgtcgggggcccgcaccttccgtctggcgcccgcccagtggttcctacgggagggcctgctcttcaccgccctggccgcctccaccttcagcctgctcttcactgcaggggagcgctttgccaccatggtgcggccggtggccgagagcggggccaccaagaccagccgcgtctacggcttcatcggcctctgctggctgctggccgcgctgctggggatgctgcctttgctgggctggaactgcctgtgcgcctttgaccgctgctccagccttctgcccctctactccaagcgctacatcctcttctgcctggtgatcttcgccggcgtcctggccaccatcatgggcctctatggggccatcttccgcctggtgcaggccagcgggcagaaggccccacgcccagcggcccgccgcaaggcccgccgcctgctgaagacggtgctgatgatcctgctggccttcctggtgtgctggggcccactcttcgggctgctgctggccgacgtctttggctccaacctctgggcccaggagtacctgcggggcatggactggatcctggccctggccgtcctcaactcggcggtcaaccccatcatctactccttccgcagcagggaggtgtgcagagccgtgctcagcttcctctgctgcgggtgtctccggctgggcatgcgagggcccggggactgcctggcccgggccgtcgaggctcactccggagcttccaccaccgacagctctctgaggccaagggacagctttcgcggctcccgctcgctcagctttcggatgcgggagcccctgtccagcatctccagcgtgcggagcatctga

SEQ ID NO: 969 - DNA, 1062 bp, Homo sapiens
atgaatgagtgtcactatgacaagcacatggactttttttataataggagcaacactgatactgtcgatgactggacaggaacaaagcttgtgattgttttgtgtgttgggacgtttttctgcctgtttatttttttttctaattctctggtcatcgcggcagtgatcaaaaacagaaaatttcatttccccttctactacctgttggctaatttagctgctgccgatttcttcgctggaattgcctatgtattcctgatgtttaacacaggcccagtttcaaaaactttgactgtcaaccgctggtttctccgtcaggggcttctggacagtagcttgactgcttccctcaccaacttgctggttatcgccgtggagaggcacatgtcaatcatgaggatgcgggtccatagcaacctgaccaaaaagagggtgacactgctcattttgcttgtctgggccatcgccatttttatgggggcggtccccacactgggctggaattgcctctgcaacatctctgcctgctcttccctggcccccatttacagcaggagttaccttgttttctggacagtgtccaacctcatggccttcctcatcatggttgtggtgtacctgcggatctacgtgtacgtcaagaggaaaaccaacgtcttgtctccgcatacaagtgggtccatcagccgccggaggacacccatgaagctaatgaagacggtgatgactgtcttaggggcgtttgtggtatgctggaccccgggcctggtggttctgctcctcgacggcctgaactgcaggcagtgtggcgtgcagcatgtgaaaaggtggttcctgctgctggcgctgctcaactccgtcgtgaaccccatcatctactcctacaaggacgaggacatgtatggcaccatgaagaagatgatctgctgcttctctcaggagaacccagagaggcgtccctctcgcatcccctccacagtcctcagcaggagtgacacaggcagccagtacatagaggatagtattagccaaggtgcagtctgcaataaaagcacttcctaa

SEQ ID NO: 970 - DNA, 1197 bp, Homo sapiens
atggagtcggggctgctgcggccggcgccggtgagcgaggtcatcgtcctgcattacaactacaccggcaagctccgcggtgcgcgctaccagccgggtgccggcctgcgcgccgacgccgtggtgtgcctggcggtgtgcgccttcatcgtgctagagaatctagccgtgttgttggtgctcggacgccacccgcgcttccacgctcccatgttcctgctcctgggcagcctcacgttgtcggatctgctggcaggcgccgcctacgccgccaacatcctactgtcggggccgctcacgctgaaactgtcccccgcgctctggttcgcacgggagggaggcgtcttcgtggcactcactgcgtccgtgctgagcctcctggccatcgcgctggagcgcagcctcaccatggcgcgcagggggcccgcgcccgtctccagtcgggggcgcacgctggcgatggcagccgcggcctggggcgtgtcgctgctcctcgggctcctgccagcgctgggctggaattgcctgggtcgcctggacgcttgctccactgtcttgccgctctacgccaaggcctacgtgctcttctgcgtgctcgccttcgtgggcatcctggccgcgatctgtgcactctacgcgcgcatctactgccaggtacgcgccaacgcgcggcgcctgccggcacggcccgggactgcggggaccacctcgacccgggcgcgtcgcaagccgcgctcgctggccttgctgcgcacgctcagcgtggtgctcctggcctttgtggcatgttggggccccctcttcctgctgctgttgctcgacgtggcgtgcccggcgcgcacctgtcctgtactcctgcaggccgatcccttcctgggactggccatggccaactcacttctgaaccccatcatctacacgctcaccaaccgcgacctgcgccacgcgctcctgcgcctggtctgctgcggacgccactcctgcggcagagacccgagtggctcccagcagtcggcgagcgcggctgaggcttccgggggcctgcgccgctgcctgcccccgggccttgatgggagcttcagcggctcggagcgctcatcgccccagcgcgacgggctggacaccagcggctccacaggcagccccggtgcacccacagccgcccggactctggtatcagaaccggctgcagactga

SEQ ID NO: 971 - DNA, 1284 bp, Homo sapiens
atggaaaccctttgcctcagggcatccttttggctggcactggttggatgtgtaatcagtgataatcctgagagatacagcacaaatctaagcaatcatgtggatgatttcaccacttttcgtggcacagagctcagcttcctggttaccactcatcaacccactaatttggtcctacccagcaatggctcaatgcacaactattgcccacagcagactaaaattacttcagctttcaaatacattaacactgtgatatcttgtactattttcatcgtgggaatggtggggaatgcaactctgctcaggatcatttaccagaacaaatgtatgaggaatggccccaacgcgctgatagccagtcttgcccttggagaccttatctatgtggtcattgatctccctatcaatgtatttaagctgctggctgggcgctggccttttgatcacaatgactttggcgtatttctttgcaagctgttcccctttttgcagaagtcctcggtggggatcaccgtcctcaacctctgcgctcttagtgttgacaggtacagagcagttgcctcctggagtcgtgttcagggaattgggattcctttggtaactgccattgaaattgcctccatctggatcctgtcctttatcctggccattcctgaagcgattggcttcgtcatggtaccctttgaatataggggtggacagcataaaacctgtatgctcaatgccacatcaaaattcatggagttctaccaagatgtaaaggactggtggctcttcgggttctatttctgtatgcccttggtgtgcactgcgatcttctacaccctcatgactggtgagatgttgaacagaaggaatggcagcttgagaattgccctcagtgaacatcttaagcagcgtcgagaagtggcaaaaacagttttctgcttggttgtaatttttgctctttgctggttccctcttcatttaagccgtatattgaagaaaactgtgtataacgagatggacaagaaccgatgtgaattacttagtttcttactgctcatggattacatcggtattaacttggcaaccatgaattcatgtataaaccccatagctctgtattttgtgagcaagaaatttaaaaattgtttccagtcatgcctctgctgctgctgttaccagtccaaaagtctgatgacctcggtccccatgaacggaacaagcatccagtggaagaaccacgatcaaaacaaccacaacacagaccggagcagccataaggacagcatgaactga

SEQ ID NO: 972 - DNA, 1329 bp, Homo sapiens
atgcagccgcctccaagtctgtgcggacgcgccctggttgcgctggttcttgcctgcggcctgtcgcggatctggggagaggagagaggcttcccgcccgacagggccactccgcttttgcaaaccgcagagataatgacgccacccactaagaccttatggcccaagggttccaacgccagtctggcgcggtcgttggcacctgcggaggtgcctaaaggagacaggacggcaggatctccgccacgcaccatctcccctcccccgtgccaaggacccatcgagatcaaggagactttcaaatacatcaacacggttgtgtcctgccttgtgttcgtgctggggatcatcgggaactccacacttctgagaattatctacaagaacaagtgcatgcgaaacggtcccaatatcttgatcgccagcttggctctgggagacctgctgcacatcgtcattgacatccctatcaatgtctacaagctgctggcagaggactggccatttggagctgagatgtgtaagctggtgcctttcatacagaaagcctccgtgggaatcactgtgctgagtctatgtgctctgagtattgacagatatcgagctgttgcttcttggagtagaattaaaggaattggggttccaaaatggacagcagtagaaattgttttgatttgggtggtctctgtggttctggctgtccctgaagccataggttttgatataattacgatggactacaaaggaagttatctgcgaatctgcttgcttcatcccgttcagaagacagctttcatgcagttttacaagacagcaaaagattggtggctgttcagtttctatttctgcttgccattggccatcactgcatttttttatacactaatgacctgtgaaatgttgagaaagaaaagtggcatgcagattgctttaaatgatcacctaaagcagagacgggaagtggccaaaaccgtcttttgcctggtccttgtctttgccctctgctggcttccccttcacctcagcaggattctgaagctcactctttataatcagaatgatcccaatagatgtgaacttttgagctttctgttggtattggactatattggtatcaacatggcttcactgaattcctgcattaacccaattgctctgtatttggtgagcaaaagattcaaaaactgctttaagtcatgcttatgctgctggtgccagtcatttgaagaaaaacagtccttggaggaaaagcagtcgtgcttaaagttcaaagctaatgatcacggatatgacaacttccgttccagtaataaatacagctcatcttga

SEQ ID NO: 973 - DNA, 2661 bp, Homo sapiens
atgcgtggcttcaacctgctcctcttctggggatgttgtgttatgcacagctgggaagggcacataagacccacacggaaaccaaacacaaagggtaataactgtagagacagtaccttgtgcccagcttatgccacctgcaccaatacggtggacagttactattgcacttgcaaacaaggcttcctgtccagcaatgggcaaaatcacttcaaggatccaggagtgcgatgcaaagatattgatgaatgttctcaaagcccccagccctgtggtcctaactcatcctgcaaaaacctgtcagggaggtacaagtgcagctgtttagatggtttctcttctcccactggaaatgactgggtcccaggaaagccgggcaatttctcctgtactgatatcaatgagtgcctcaccagcagggtctgccctgagcattctgactgtgtcaactccatgggaagctacagttgcagctgtcaagttggattcatctctagaaactccacctgtgaagacgtgaatgaatgtgcagatccaagagcttgcccagagcatgcaacttgtaataacactgttggaaactactcttgtttctgcaacccaggatttgaatccagcagtggccacttgagttgccagggtctcaaagcatcgtgtgaagatattgatgaatgcactgaaatgtgccccatcaattcaacatgcaccaacactcctgggagctacttttgcacctgccaccctggctttgcaccaagcagtggacagttgaatttcacagaccaaggagtggaatgtagagatattgatgagtgccgccaagatccatcaacctgtggtcctaattctatctgcaccaatgccctgggctcctacagctgtggctgcattgtaggctttcatcccaatccagaaggctcccagaaagatggcaacttcagctgccaaagggttctcttcaaatgtaaggaagatgtgatacccgataataagcagatccagcaatgccaagagggaaccgcagtgaaacctgcatatgtctccttttgtgcacaaataaataacatcttcagcgttctggacaaagtgtgtgaaaataaaacgaccgtagtttctctgaagaatacaactgagagctttgtccctgtgcttaaacaaatatccatgtggactaaattcaccaaggaagagacgtcctccctggccacagtcttcctggagagtgtggaaagcatgacactggcatctttttggaaaccctcagcaaatgtcactccggctgttcgggcggaatacttagacattgagagcaaagttatcaacaaagaatgcagtgaagagaatgtgacgttggacttggtagccaagggggataagatgaagatcgggtgttccacaattgaggaatctgaatccacagagaccactggtgtggcttttgtctcctttgtgggcatggaatcggttttaaatgagcgcttcttccaagaccaccaggctcccttgaccacctctgagatcaagctgaagatgaattctcgagtcgttgggggcataatgactggagagaagaaagacggcttctcagatccaatcatctacactctggagaacgttcagccaaagcagaagtttgagaggcccatctgtgtttcctggagcactgatgtgaagggtggaagatggacatcctttggctgtgtgatcctggaagcttctgagacatataccatctgcagctgtaatcagatggcaaatcttgccgttatcatggcgtctggggagctcacgatggacttttccttgtacatcattagccatgtaggcattatcatctccttggtgtgcctcgtcttggccatcgccacctttctgctgtgtcgctccatccgaaatcacaacacctacctccacctgcacctctgcgtgtgtctcctcttggcgaagactctcttcctcgccggtatacacaagactgacaacaagacgggctgcgccatcatcgcgggcttcctgcactaccttttccttgcctgcttcttctggatgctggtggaggctgtgatactgttcttgatggtcagaaacctgaaggtggtgaattacttcagctctcgcaacatcaagatgctgcacatctgtgcctttggttatgggctgccgatgctggtggtggtgatctctgccagtgtgcagccacagggctatggaatgcataatcgctgctggctgaatacagagacagggttcatctggagtttcttggggccagtttgcacagttatagtgatcaactcccttctcctgacctggaccttgtggatcctgaggcagaggctttccagtgttaatgccgaagtctcaacgctaaaagacaccaggttactgaccttcaaggcctttgcccagctcttcatcctgggctgctcctgggtgctgggcatttttcagattggacctgtggcaggtgtcatggcttacctgttcaccatcatcaacagcctgcagggggccttcatcttcctcatccactgtctgctcaacggccaggtacgagaagaatacaagaggtggatcactgggaagacgaagcccagctcccagtcccagacctcaaggatcttgctgtcctccatgccatccgcttccaagacgggttaa

SEQ ID NO: 974 - DNA, 1821 bp, Homo sapiens
atgtgtgtacctggcttcagatccagcagtaaccaagacaggtttatcactaatgatggaaccgtctgtatagaaaatgtgaatgcaaactgccatttagataatgtctgtatagctgcaaatattaataaaactttaacaaaaatcagatccataaaagaacctgtggctttgctacaagaagtctatagaaattctgtgacagatctttcaccaacagatataattacatatatagaaatattagctgaatcatcttcattactaggttacaagaacaacactatctcagccaaggacaccctttctaactcaactcttactgaatttgtaaaaaccgtgaataattttgttcaaagggatacatttgtagtttgggacaagttatctgtgaatcataggagaacacatcttacaaaactcatgcacactgttgaacaagctactttaaggatatcccagagcttccaaaagaccacagagtttgatacaaattcaacggatatagctctcaaagttttcttttttgattcatataacatgaaacatattcatcctcatatgaatatggatggagactacataaatatatttccaaagagaaaagctgcatatgattcaaatggcaatgttgcagttgcatttttatattataagagtattggtcctttgctttcatcatctgacaacttcttattgaaacctcaaaattatgataattctgaagaggaggaaagagtcatatcttcagtaatttcagtctcaatgagctcaaacccacccacattatatgaacttgaaaaaataacatttacattaagtcatcgaaaggtcacagataggtataggagtctatgtgcattttggaattactcacctgataccatgaatggcagctggtcttcagagggctgtgagctgacatactcaaatgagacccacacctcatgccgctgtaatcacctgacacattttgcaattttgatgtcctctggtccttccattggtattaaagattataatattcttacaaggatcactcaactaggaataattatttcactgatttgtcttgccatatgcatttttaccttctggttcttcagtgaaattcaaagcaccaggacaacaattcacaaaaatctttgctgtagcctatttcttgctgaacttgtttttcttgttgggatcaatacaaatactaataagctcttctgttcaatcattgccggactgctacactacttctttttagctgcttttgcatggatgtgcattgaaggcatacatctctatctcattgttgtgggtgtcatctacaacaagggatttttgcacaagaatttttatatctttggctatctaagcccagccgtggtagttggattttcggcagcactaggatacagatattatggcacaaccaaagtatgttggcttagcaccgaaaacaactttatttggagttttataggaccagcatgcctaatcattcttgttaatctcttggcttttggagtcatcatatacaaagtttttcgtcacactgcagggttgaaaccagaagttagttgctttgagaacataaggtcttgtgcaagaggagccctcgctcttctgttccttctcggcaccacctggatctttggggttctccatgttgtgcacgcatcagtggttacagcttacctcttcacagtcagcaatgctttccaggggatgttcatttttttattcctgtgtgttttatctagaaagattcaagaagaatattacagattgttcaaaaatgtcccctgttgttttggatgtttaaggtaa

SEQ ID NO: 975 - DNA, 1278 bp, Homo sapiens
atggggccgcggcggctgctgctggtggccgcctgcttcagtctgtgcggcccgctgttgtctgcccgcacccgggcccgcaggccagaatcaaaagcaacaaatgccaccttagatccccggtcatttcttctcaggaaccccaatgataaatatgaaccattttgggaggatgaggagaaaaatgaaagtgggttaactgaatacagattagtctccatcaataaaagcagtcctcttcaaaaacaacttcctgcattcatctcagaagatgcctccggatatttgaccagctcctggctgacactctttgtcccatctgtgtacaccggagtgtttgtagtcagcctcccactaaacatcatggccatcgttgtgttcatcctgaaaatgaaggtcaagaagccggcggtggtgtacatgctgcacctggccacggcagatgtgctgtttgtgtctgtgctcccctttaagatcagctattacttttccggcagtgattggcagtttgggtctgaattgtgtcgcttcgtcactgcagcattttactgtaacatgtacgcctctatcttgctcatgacagtcataagcattgaccggtttctggctgtggtgtatcccatgcagtccctctcctggcgtactctgggaagggcttccttcacttgtctggccatctgggctttggccatcgcaggggtagtgcctctcgtcctcaaggagcaaaccatccaggtgcccgggctcaacatcactacctgtcatgatgtgctcaatgaaaccctgctcgaaggctactatgcctactacttctcagccttctctgctgtcttcttttttgtgccgctgatcatttccacggtctgttatgtgtctatcattcgatgtcttagctcttccgcagttgccaaccgcagcaagaagtcccgggctttgttcctgtcagctgctgttttctgcatcttcatcatttgcttcggacccacaaacgtcctcctgattgcgcattactcattcctttctcacacttccaccacagaggctgcctactttgcctacctcctctgtgtctgtgtcagcagcataagctcgtgcatcgaccccctaatttactattacgcttcctctgagtgccagaggtacgtctacagtatcttatgctgcaaagaaagttccgatcccagcagttataacagcagtgggcagttgatggcaagtaaaatggatacctgctctagtaacctgaataacagcatatacaaaaagctgttaacttag

SEQ ID NO: 976 - DNA, 1194 bp, Homo sapiens
atgcggagccccagcgcggcgtggctgctgggggccgccatcctgctagcagcctctctctcctgcagtggcaccatccaaggaaccaatagatcctctaaaggaagaagccttattggtaaggttgatggcacatcccacgtcactggaaaaggagttacagttgaaacagtcttttctgtggatgagttttctgcatctgtcctcactggaaaactgaccacggtcttccttccaattgtctacacaattgtgtttgtggtgggtttgccaagtaacggcatggccctgtgggtctttcttttccgaactaagaagaagcaccctgctgtgatttacatggccaatctggccttggctgacctcctctctgtcatctggttccccttgaagattgcctatcacatacatgccaacaactggatttatggggaagctctttgtaatgtgcttattggctttttctatggcaacatgtactgttccattctcttcatgacctgcctcagtgtgcagaggtattgggtcatcgtgaaccccatggggcactccaggaagaaggcaaacattgccattggcatctccctggcaatatggctgctgattctgctggtcaccatccctttgtatgtcgtgaagcagaccatcttcattcctgccctgaacatcacgacctgtcatgatgttttgcctgagcagctcttggtgggagacatgttcaattacttcctctctctggccattggggtctttctgttcccagccttcctcacagcctctgcctatgtgctgatgatcagaatgctgcgatcttctgccatggatgaaaactcagagaagaaaaggaagagggccatcaaactcattgtcactgtcctggccatgtacctgatctgcttcactcctagtaaccttctgcttgtggtgcattattttctgattaagagccagggccagagccatgtctatgccctgtacattgtagccctctgcctctctacccttaacagctgcatcgacccctttgtctattactttgtttcacatgatttcagggatcatgcaaagaacgctctcctttgccgaagtgtccgcactgtaaagcagatgcaagtatccctcacctcaaagaaacactccaggaaatccagctcttactcttcaagttcaaccactgttaagacctcctattga

SEQ ID NO: 977 - DNA, 1125 bp, Homo sapiens
atgaaagccctcatctttgcagctgctggcctcctgcttctgttgcccactttttgtcagagtggcatggaaaatgatacaaacaacttggcaaagccaaccttacccattaagacctttcgtggagctcccccaaattcttttgaagagttccccttttctgccttggaaggctggacaggagccacgattactgtaaaaattaagtgccctgaagaaagtgcttcacatctccatgtgaaaaatgctaccatggggtacctgaccagctccttaagtactaaactgatacctgccatctacctcctggtgtttgtagttggtgtcccggccaatgctgtgaccctgtggatgcttttcttcaggaccagatccatctgtaccactgtattctacaccaacctggccattgcagattttcttttttgtgttacattgccctttaagatagcttatcatctcaatgggaacaactgggtatttggagaggtcctgtgccgggccaccacagtcatcttctatggcaacatgtactgctccattctgctccttgcctgcatcagcatcaaccgctacctggccatcgtccatcctttcacctaccggggcctgcccaagcacacctatgccttggtaacatgtggactggtgtgggcaacagttttcttatatatgctgccatttttcatactgaagcaggaatattatcttgttcagccagacatcaccacctgccatgatgttcacaacacttgcgagtcctcatctcccttccaactctattacttcatctccttggcattctttggattcttaattccatttgtgcttatcatctactgctatgcagccatcatccggacacttaatgcatacgatcatagatggttgtggtatgttaaggcgagtctcctcatccttgtgatttttaccatttgctttgctccaagcaatattattcttattattcaccatgctaactactactacaacaacactgatggcttatattttatatatctcatagctttgtgcctgggtagtcttaatagttgcttagatccattcctttattttctcatgtcaaaaaccagaaatcactccactgcttaccttacaaaatag

SEQ ID NO: 978 - DNA, 1158 bp, Homo sapiens
atgtgggggcgactgctcctgtggcccctggtgctggggttcagcctgtctggcggcacccagacccccagcgtctacgacgagagcgggagcaccggaggtggtgatgacagcacgccctcaatcctgcctgccccccgcggctacccaggccaagtctgtgccaatgacagtgacaccctggagctcccggacagctcacgggcactgcttctgggctgggtgcccaccaggctggtgcccgccctctatgggctggtcctggtggtggggctgccggccaatgggctggcgctgtgggtgctggccacgcaggcacctcggctgccctccaccatgctgctgatgaacctcgcgactgctgacctcctgctggccctggcgctgcccccgcggatcgcctaccacctgcgtggccagcgctggcccttcggggaggccgcctgccgcctggccacggccgcactctatggtcacatgtatggctcagtgctgctgctggccgccgtcagcctggatcgctacctggccctggtgcacccgctgcgggcccgcgccctgcgtggccggcgcctggcccttggactctgcatggctgcttggctcatggcggccgccctggcactgcccctgacactgcagcggcagaccttccggctggcgcgctccgatcgcgtgctctgccatgacgcgctgcccctggacgcacaggcctcccactggcaaccggccttcacctgcctggcgctgttgggctgtttcctgcccctgctggccatgctgctgtgctacggggccaccctgcacacgctggcggccagcggccggcgctacggccacgcgctgaggctgaccgcagtggtgctggcctccgccgtggccttcttcgtgcccagcaacctgctgctgctgctgcattactcggacccgagccccagcgcctggggcaacctctatggtgcctacgtgcccagcctggcgctgagcaccctcaacagctgcgtggatcccttcatctactactacgtgtcggccgagttcagggacaaggtgcgggcagggctcttccaacggtcgccgggggacaccgtggcctccaaggcctctgcggaagggggcagccggggcatgggcacccactcctctttgctccagtga

SEQ ID NO: 979 - DNA, 1002 bp, Homo sapiens
atgcctgctaattacacgtgtaccaggccagatggagacaatacagattttcgatactttatttatgcagtgacatacactgtcattcttgtgccaggtctcatagggaatatattagccctgtgggtattctatggttatatgaaagaaacaaaacgagctgtgatatttatgataaacttagccattgctgacttactacaagttctttccttgccactgaggatcttctactacttgaatcatgactggccatttgggcctggtctctgcatgttctgtttctacctgaagtatgtcaacatgtatgcaagcatctacttcttggtctgcatcagtgtgcgacgattttggtttctcatgtacccctttcgcttccatgactgcaaacagaaatatgacctgtacatcagcattgctggctggctgatcatctgccttgcctgtgtactctttccactcctcagaaccagtgatgatacctctggcaataggaccaaatgctttgtggatcttcctaccaggaatgtcaacctggcccagtccgttgttatgatgaccattggcgagttgattgggtttgtaactccgcttctgattgtcctatattgtacctggaagacggttttatcactgcaagataaatatcccatggcccaagatcttggagagaaacagaaagccttgaagatgattctaacctgtgcaggggtattcctaatttgctttgcaccttatcatttcagttttcctttagatttcctggtgaagtccaatgaaattaaaagctgcctagccagaagggtgattctaatatttcattctgtggcattgtgtcttgctagtctgaattcatgtcttgacccagtcatatactacttttccactaatgagttccgaagacggctttcaagacaagatttgcatgacagcatccaactccatgcaaaatcctttgtgagtaaccatacagcttccaccatgacacctgaattatgctaa

SEQ ID NO: 980 - DNA, 1053 bp, Homo sapiens
atggagacaaattcctctctccccacgaacatctctggagggacacctgctgtatctgctggctatctcttcctggatatcatcacttatctggtatttgcagtcacctttgtcctcggggtcctgggcaacgggcttgtgatctgggtggctggattccggatgacacacacagtcaccaccatcagttacctgaacctggccgtggctgacttctgtttcacctccactttgccattcttcatggtcaggaaggccatgggaggacattggcctttcggctggttcctgtgcaaattcctctttaccatagtggacatcaacttgttcggaagtgtcttcctgatcgccctcattgctctggaccgctgtgtttgcgtcctgcatccagtctggacccagaaccaccgcaccgtgagcctggccaagaaggtgatcattgggccctgggtgatggctctgctcctcacattgccagttatcattcgtgtgactacagtacctggtaaaacggggacagtagcctgcacttttaacttttcgccctggaccaacgaccctaaagagaggataaatgtggccgttgccatgttgacggtgagaggcatcatccggttcatcattggcttcagcgcacccatgtccatcgttgctgtcagttatgggcttattgccaccaagatccacaagcaaggcttgattaagtccagtcgtcccttacgggtcctctcctttgtcgcagcagccttttttctctgctggtccccatatcaggtggtggcccttatagccacagtcagaatccgtgagttattgcaaggcatgtacaaagaaattggtattgcagtggatgtgacaagtgccctggccttcttcaacagctgcctcaaccccatgctctatgtcttcatgggccaggacttccgggagaggctgatccacgcccttcccgccagtctggagagggccctgaccgaggactcaacccaaaccagtgacacagctaccaattctactttaccttctgcagaggtggcgttacaggcaaagtga

SEQ ID NO: 981 - DNA, 2393 bp, Homo sapiens
cgctgagatctgtggaggtttttctctgcaaatgcagaaagaaatcaggtggatggatgcataattatggccctgctcctggtctctttgctggcattcctgagcttgggctcaggatgtcatcatcggatctgtcactgctctaacagggtttttctctgccaagagagcaaggtgacagagattccttctgacctcccgaggaatgccattgaactgaggtttgtcctcaccaagcttcgagtcatccaaaaaggtgcattttcaggatttggggacctggagaaaatagagatctctcagaatgatgtcttggaggtgatagaggcagatgtgttctccaaccttcccaaattacatgaaattagaattgaaaaggccaacaacctgctctacatcacccctgaggccttccagaaccttcccaaccttcaatatctgttaatatccaacacaggtattaagcaccttccagatgttcacaagattcattctctccaaaaggttttacttgacattcaagataacataaacatccacacaattgaaagaaattctttcgtggggctgagctttgaaagtgtgattctatggctgaataagaatgggattcaagaaatacacaactgtgcattcaatggaacccaactagatgcagtgaatctaagcgataataataatttagaagaattgcctaatgatgttttccacggagcctctggaccagtcattctagatatttcaagaacaaggatccattccctgcctagctatggcttagaaaatcttaagaagctgagggccaggtcgacttacaacttaaaaaagctgcctactctggaaaagcttgtcgccctcatggaagccagcctcacctatcccagccattgctgtgcctttgcaaactggagacggcaaatctctgagcttcatccaatttgcaacaaatctattttaaggcaagaagttgattatatgactcaggctaggggtcagagatcctctctggcagaagacaatgagtccagctacagcagaggatttgacatgacgtacactgagtttgactatgacttatgcaatgaagtggttgacgtgacctgctcccctaagccagatgcattcaacccatgtgaagatatcatggggtacaacatcctcagagtcctgatatggtttatcagcatcctggccatcactgggaacatcatagtgctagtgatcctaactaccagccaatataaactcacagtccccaggttccttatgtgcaacctggcctttgctgatctctgcattggaatctacctgctgctcattgcatcagttgatatccataccaagagccaatatcacaactatgccattgactggcaaactggggcaggctgtgatgctgctggctttttcactgtctttgccagtgagctgtcagtctacactctgacagctatcaccttggaaagatggcataccatcacgcatgccatgcagctggactgcaaggtgcagctccgccatgctgccagtgtcatggtgatgggctggatttttgcttttgcagctgccctctttcccatctttggcatcagcagctacatgaaggtgagcatctgcctgcccatggatattgacagccctttgtcacagctgtatgtcatgtccctccttgtgctcaatgtcctggcctttgtggtcatctgtggctgctatatccacatctacctcacagtgcggaaccccaacatcgtgtcctcctctagtgacaccaggatcgccaagcgcatggccatgctcatcttcactgacttcctctgcatggcacccatttctttctttgccatttctgcctccctcaaggtgcccctcatcactgtgtccaaagcaaagattctgctggttctgtttcaccccatcaactcctgtgccaaccccttcctctatgccatctttaccaaaaactttcgcagagatttcttcattctgctgagcaagtgtggctgctatgaaatgcaagcccaaatttataggacagaaacttcatccactgtccacaacacccatccaaggaatggccactgctcttcagctcccagagtcaccagtggttccacttacatacttgtccctctaagtcatttagcccaaaactaaaacacaatgtgaaaatgtatctgagtattgaatgataattcagtccttgcctttgaagggtatgtcacaaggagctgacagtgcttctacacatttcatctaatttaatattcctggcatacctttaaggtaaattggtcaggaactattaattccatgtgatacattaggaagctgaattattagtaacaacaataataattaaagaatgcaatactgtaaaaaagcggccgcgaatt

SEQ ID NO: 982 - DNA, 1017 bp, Homo sapiens
atggcctcctctgggtatgtcctccaggcggagctctccccctcaactgagaactcaagtcagctggacttcgaagatgtatggaattcttcctatggtgtgaatgattccttcccagatggagactatgatgccaacctggaagcagctgccccctgccactcctgtaacctgctggatgactctgcactgcccttcttcatcctcaccagtgtcctgggtatcctagctagcagcactgtcctcttcatgcttttcagacctctcttccgctggcagctctgccctggctggcctgtcctggcacagctggctgtgggcagtgccctcttcagcattgtggtgcccgtcttggccccagggctaggtagcactcgcagctctgccctgtgtagcctgggctactgtgtctggtatggctcagcctttgcccaggctttgctgctagggtgccatgcctccctgggccacagactgggtgcaggccaggtcccaggcctcaccctggggctcactgtgggaatttggggagtggctgccctactgacactgcctgtcaccctggccagtggtgcttctggtggactctgcaccctgatatacagcacggagctgaaggctttgcaggccacacacactgtagcctgtcttgccatctttgtcttgttgccattgggtttgtttggagccaaggggctgaagaaggcattgggtatggggccaggcccctggatgaatatcctgtgggcctggtttattttctggtggcctcatggggtggttctaggactggatttcctggtgaggtccaagctgttgctgttgtcaacatgtctggcccagcaggctctggacctgctgctgaacctggcagaagccctggcaattttgcactgtgtggctacgcccctgctcctcgccctattctgccaccaggccacccgcaccctcttgccctctctgcccctccctgaaggatggtcttctcatctggacacccttggaagcaaatcctag

SEQ ID NO: 983 - DNA, 1746 bp, Homo sapiens
atgcagcgcccgggcccccgcctgtggctggtcctgcaggtgatgggctcgtgcgccgccatcagctccatggacatggagcgcccgggcgacggcaaatgccagcccatcgagatcccgatgtgcaaggacatcggctacaacatgactcgtatgcccaacctgatgggccacgagaaccagcgcgaggcagccatccagttgcacgagttcgcgccgctggtggagtacggctgccacggccacctccgcttcttcctgtgctcgctgtacgcgccgatgtgcaccgagcaggtctctacccccatccccgcctgccgggtcatgtgcgagcaggcccggctcaagtgctccccgattatggagcagttcaacttcaagtggcccgactccctggactgccggaaactccccaacaagaacgaccccaactacctgtgcatggaggcgcccaacaacggctcggacgagcccacccggggctcgggcctgttcccgccgctgttccggccgcagcggccccacagcgcgcaggagcacccgctgaaggacgggggccccgggcgcggcggctgcgacaacccgggcaagttccaccacgtggagaagagcgcgtcgtgcgcgccgctctgcacgcccggcgtggacgtgtactggagccgcgaggacaagcgcttcgcagtggtctggctggccatctgggcggtgctgtgcttcttctccagcgccttcaccgtgctcaccttcctcatcgacccggcccgcttccgctaccccgagcgccccatcatcttcctctccatgtgctactgcgtctactccgtgggctacctcatccgcctcttcgccggcgccgagagcatcgcctgcgaccgggacagcggccagctctatgtcatccaggagggactggagagcaccggctgcacgctggtcttcctggtcctctactacttcggcatggccagctcgctgtggtgggtggtcctcacgctcacctggttcctggccgccggcaagaagtggggccacgaggccatcgaagccaacagcagctacttccacctggcagcctgggccatcccggcggtgaagaccatcctgatcctggtcatgcgcagggtggcgggggacgagctcaccggggtctgctacgtgggcagcatggacgtcaacgcgctcaccggcttcgtgctcattcccctggcctgctacctggtcatcggcacgtccttcatcctctcgggcttcgtggccctgttccacatccggagggtgatgaagacgggcggcgagaacacggacaagctggagaagctcatggtgcgtatcgggctcttctctgtgctgtacaccgtgccggccacctgtgtgatcgcctgctacttttacgaacgcctcaacatggattactggaagatcctggcggcgcagcacaagtgcaaaatgaacaaccagactaaaacgctggactgcctgatggccgcctccatccccgccgtggagatcttcatggtgaagatctttatgctgctggtggtggggatcaccagcgggatgtggatttggacctccaagactctgcagtcctggcagcaggtgtgcagccgtaggttaaagaagaagagccggagaaaaccggccagcgtgatcaccagcggtgggatttacaaaaaagcccagcatccccagaaaactcaccacgggaaatatgagatccctgcccagtcgcccacctgcgtgtga

SEQ ID NO: 984 - DNA, 1983 bp, Homo sapiens
cgagtaaagtttgcaaagaggcgcgggaggcggcagccgcagcgaggaggcggcggggaagaagcgcagtctccgggttgggggcgggggcggggggggcgccaaggagccgggtggggggcggcggccagcatgcggccccgcagcgccctgccccgcctgctgctgccgctgctgctgctgcccgccgccgggccggcccagttccacggggagaagggcatctccatcccggaccacggcttctgccagcccatctccatcccgctgtgcacggacatcgcctacaaccagaccatcatgcccaaccttctgggccacacgaaccaggaggacgcaggcctagaggtgcaccagttctatccgctggtgaaggtgcagtgctcgcccgaactgcgcttcttcctgtgctccatgtacgcacccgtgtgcaccgtgctggaacaggccatcccgccgtgccgctctatctgtgagcgcgcgcgccagggctgcgaagccctcatgaacaagttcggttttcagtggcccgagcgcctgcgctgcgagcacttcccgcgccacggcgccgagcagatctgcgtcggccagaaccactccgaggacggagctcccgcgctactcaccaccgcgccgccgccgggactgcagccgggtgccgggggcaccccgggtggcccgggcggcggcggcgctcccccgcgctacgccacgctggagcaccccttccactgcccgcgcgtcctcaaggtgccatcctatctcagctacaagtttctgggcgagcgtgattgtgctgcgccctgcgaacctgcgcggcccgatggttccatgttcttctcacaggaggagacgcgtttcgcgcgcctctggatcctcacctggtcggtgctgtgctgcgcttccaccttcttcactgtcaccacgtacttggtagacatgcagcgcttccgctacccagagcggcctatcatttttctgtcgggctgctacaccatggtgtcggtggcctacatcgcgggcttcgtgctccaggagcgcgtggtgtgcaacgagcgcttctccgaggacggttaccgcacggtggtgcagggcaccaagaaggagggctgcaccatcctcttcatgatgctctacttcttcagcatggccagctccatctggtgggtcatcctgtcgctcacctggttcctggcagccggcatgaagtggggccacgaggccatcgaggccaactctcagtacttccacctggccgcctgggccgtgccggccgtcaagaccatcaccatcctggccatgggccagatcgacggcgacctgctgagcggcgtgtgcttcgtaggcctcaacagcctggacccgctgcggggcttcgtgctagcgccgctcttcgtgtacctgttcatcggcacgtccttcctcctggccggcttcgtgtcgctcttccgcatccgcaccatcatgaagcacgacggcaccaagaccgaaaagctggagcggctcatggtgcgcatcggcgtcttctccgtgctctacacagtgcccgccaccatcgtcatcgcttgctacttctacgagcaggccttccgcgagcactgggagcgctcgtgggtgagccagcactgcaagagcctggccatcccgtgcccggcgcactacacgccgcgcatgtcgcccgacttcacggtctacatgatcaaatacctcatgacgctcatcgtgggcatcacgtcgggcttctggatctggtcgggcaagacgctgcactcgtggaggaagttctacactcgcctcaccaacagccgacacggtgagaccaccgtgtgagggacgcccccaggccggaaccgcgcggcgctttcctccgcccggggtggggcccctacagactccgtattttatttttttaaataaaaaacgatcgaaaccatttcacttttaggttgctttttaaaagagaactctctgcccaacaccccc

SEQ ID NO: 985 - DNA, 2001 bp, Homo sapiens
atggctatgacttggattgtcttctctctttggcccttgactgtgttcatggggcatataggtgggcacagtttgttttcttgtgaacctattaccttgaggatgtgccaagatttgccttataatactaccttcatgcctaatcttctgaatcattatgaccaacagacagcagctttggcaatggagccattccaccctatggtgaatctggattgttctcgggatttccggccttttctttgtgcactctacgctcctatttgtatggaatatggacgtgtcacacttccctgtcgtaggctgtgtcagcgggcttacagtgagtgttcgaagctcatggagatgtttggtgttccttggcctgaagatatggaatgcagtaggttcccagattgtgatgagccatatcctcgacttgtggatctgaatttagctggagaaccaactgaaggagccccagtggcagtgcagagagactatggtttttggtgtccccgagagttaaaaattgatcctgatctgggttattcttttctgcatgtgcgtgattgttcacctccttgtccaaatatgtacttcagaagagaagaactgtcatttgctcgctatttcataggattgatttcaatcatttgcctctcggccacattgtttacttttttaacttttttgattgatgtcacaagattccgttatcctgaaaggcctattatattttatgcagtctgctacatgatggtatccttaattttcttcattggatttttgcttgaagatcgagtagcctgcaatgcatccatccctgcacaatataaggcttccacagtgacacaaggatctcataataaagcctgtaccatgctttttatgatactctatttttttactatggctggcagtgtatggtgggtaattcttaccatcacatggtttttagcagctgtgccaaagtggggtagtgaagctattgagaagaaagcattgctgtttcacgccagtgcatggggcatccccggaactctaaccatcatccttttagcgatgaataaaattgaaggtgacaatattagtggcgtgtgttttgttggcctctacgatgttgatgcattgagatattttgttcttgctcccctctgcctgtatgtggtagttggggtttctctcctcttagctggcattatatccctaaacagagttcgaattgagattccattagaaaaggagaaccaagataaattagtgaagtttatgatccggatcggtgttttcagcattctttatctcgtaccactcttggttgtaattggatgctacttttatgagcaagcttaccggggcatctgggaaacaacgtggatacaagaacgctgcagagaatatcacattccatgtccatatcaggttactcaaatgagtcgtccagacttgattctctttctgatgaaatacctgatggctctcatagttggcattccctctgtattttgggttggaagcaaaaagacatgctttgaatgggccagtttttttcatggtcgtaggaaaaaagagatagtgaatgagagccgacaggtactccaggaacctgattttgctcagtctctcctgagggatccaaatactcctatcataagaaagtcaaggggaacttccactcaaggaacatccacccatgcttcttcaactcagctggctatggtggatgatcaaagaagcaaagcaggaagcatccacagcaaagtgagcagctaccacggcagcctccacagatcacgtgatggcaggtacacgccctgcagttacagaggaatggaggagagactacctcatggcagcatgtcacgactaacagatcactccaggcatagtagttctcatcggctcaatgaacagtcacgacatagcagcatcagagatctcagtaataatcccatgactcatatcacacatggcaccagcatgaatcgggttattgaagaagatggaaccagtgcttaa

SEQ ID NO: 986 - DNA, 1614 bp, Homo sapiens
atggcctggcggggcgcagggccgagcgtcccgggggcgcccgggggcgtcggtctcagtctggggttgctcctgcagttgctgctgctcctggggccggcgcggggcttcggggacgaggaagagcggcgctgcgaccccatccgcatctccatgtgccagaacctcggctacaacgtgaccaagatgcccaacctggttgggcacgagctgcagacggacgccgagctgcagctgacaactttcacaccgctcatccagtacggctgctccagccagctgcagttcttcctttgttctgtttatgtgccaatgtgcacagagaagatcaacatccccattggcccatgcggcggcatgtgtctttcagtcaagagacgctgtgaacccgtcctgaaggaatttggatttgcctggccagagagtctgaactgcagcaaattcccaccacagaacgaccacaaccacatgtgcatggaagggccaggtgatgaagaggtgcccttacctcacaaaacccccatccagcctggggaagagtgtcactctgtgggaaccaattctgatcagtacatctgggtgaaaaggagcctgaactgtgtgctcaagtgtggctatgatgctggcttatacagccgctcagccaaggagttcactgatatctggatggctgtgtgggccagcctgtgtttcatctccactgccttcacagtactgaccttcctgatcgattcttctaggttttcctaccctgagcgccccatcatatttctcagtatgtgctataatatttatagcattgcttatattgtcaggctgactgtaggccgggaaaggatatcctgtgattttgaagaggcagcagaacctgttctcatccaagaaggacttaagaacacaggatgtgcaataattttcttgctgatgtacttttttggaatggccagctccatttggtgggttattctgacactcacttggtttttggcagcaggactcaaatggggtcatgaagccattgaaatgcacagctcttatttccacattgcagcctgggccatccccgcagtgaaaaccattgtcatcttgattatgagactggtggatgcagatgaactgactggcttgtgctatgttggaaaccaaaatctcgatgccctcaccgggttcgtggtggctcccctctttacttatttggtcattggaactttgttcattgctgcaggtttggtggccttgttcaaaattcggtcaaatcttcaaaaggatgggacaaagacagacaagttagaaagactgatggtcaagattggggtgttctcagtactgtacacagttcctgcaacgtgtgtgattgcctgttatttttatgaaatctccaactgggcactttttcggtattctgcagatgattccaacatggctgttgaaatgttgaaaacttttatgtctttgttggtgggcatcacttcaggcatgtggatttggtctgccaaaagtcttcacacgtggcagaagtgttccaacagattggtgaattctggaaaggtaaagagagagaagagaggaaatggttgggtgaagcctggaaaaggcagtgagactgtggtataa

SEQ ID NO: 987 - DNA, 1758 bp, Homo sapiens
atggctcggcctgacccatccgcgccgccctcgctgttgctgctgctcctggcgcagctggtgggccgggcggccgccgcgtccaaggccccggtgtgccaggaaatcacggtgcccatgtgccgcggcatcggctacaacctgacgcacatgcccaaccagttcaaccacgacacgcaggacgaggcgggcctggaggtgcaccagttctggccgctggtggagatccaatgctcgccggacctgcgcttcttcctatgcactatgtacacgcccatctgtctgcccgactaccacaagccgctgccgccctgccgctcggtgtgcgagcgcgccaaggccggctgctcgccgctgatgcgccagtacggcttcgcctggcccgagcgcatgagctgcgaccgcctcccggtgctgggccgcgacgccgaggtcctctgcatggattacaaccgcagcgaggccaccacggcgccccccaggcctttcccagccaagcccacccttccaggcccgccaggggcgccggcctcggggggcgaatgccccgctgggggcccgttcgtgtgcaagtgtcgcgagcccttcgtgcccattctgaaggagtcacacccgctctacaacaaggtgcggacgggccaggtgcccaactgcgcggtaccctgctaccagccgtccttcagtgccgacgagcgcacgttcgccaccttctggataggcctgtggtcggtgctgtgcttcatctccacgtccaccacagtggccaccttcctcatcgacatggacacgttccgctatcctgagcgccccatcatcttcctgtcagcctgctacctgtgcgtgtcgctgggcttcctggtgcgtctggtcgtgggccatgccagcgtggcctgcagccgcgagcacaaccacatccactacgagaccacgggccctgcactgtgcaccatcgtcttcctcctggtctacttcttcggcatggccagctccatctggtgggtcatcctgtcgctcacctggttcctggccgccgcgatgaagtggggcaacgaggccatcgcgggctacggccagtacttccacctggctgcgtggctcatccccagcgtcaagtccatcacggcactggcgctgagctccgtggacggggacccagtggccggcatctgctacgtgggcaaccagaacctgaactcgctgcggcgcttcgtgctgggcccgctggtgctctacctgctggtgggcacgctcttcctgctggcgggcttcgtgtcgctcttccgcatccgcagcgtcatcaagcagggcggcaccaagacggacaagctggagaagctcatgatccgcatcggcatcttcacgctgctctacacggtccccgccagcattgtggtggcctgctacctgtacgagcagcactaccgcgagagctgggaggcggcgctcacctgcgcctgcccgggccacgacaccggccagccgcgcgccaagcccgagtactgggtgctcatgctcaagtacttcatgtgcctggtggtgggcatcacgtcgggcgtctggatctggtcgggcaagacggtggagtcgtggcggcgtttcaccagccgctgctgctgccgcccgcggcgcggccacaagagcgggggcgccatggccgcaggggactaccccgaggcgagcgccgcgctcacaggcaggaccgggccgccgggccccgccgccacctaccacaagcaggtgtccctgtcgcacgtgtag

SEQ ID NO: 988 - DNA, 2121 bp, Homo sapiens
atggagatgtttacatttttgttgacgtgtatttttctacccctcctaagagggcacagtctcttcacctgtgaaccaattactgttcccagatgtatgaaaatggcctacaacatgacgtttttccctaatctgatgggtcattatgaccagagtattgccgcggtggaaatggagcattttcttcctctcgcaaatctggaatgttcaccaaacattgaaactttcctctgcaaagcatttgtaccaacctgcatagaacaaattcatgtggttccaccttgtcgtaaactttgtgagaaagtatattctgattgcaaaaaattaattgacacttttgggatccgatggcctgaggagcttgaatgtgacagattacaatactgtgatgagactgttcctgtaacttttgatccacacacagaatttcttggtcctcagaagaaaacagaacaagtccaaagagacattggattttggtgtccaaggcatcttaagacttctgggggacaaggatataagtttctgggaattgaccagtgtgcgcctccatgccccaacatgtattttaaaagtgatgagctagagtttgcaaaaagttttattggaacagtttcaatattttgtctttgtgcaactctgttcacattccttacttttttaattgatgttagaagattcagatacccagagagaccaattatatattactctgtctgttacagcattgtatctcttatgtacttcattggatttttgctgggcgatagcacagcctgcaataaggcagatgagaagctagaacttggtgacactgttgtcctaggctctcaaaataaggcttgcaccgttttgttcatgcttttgtattttttcacaatggctggcactgtgtggtgggtgattcttaccattacttggttcttagctgcaggaagaaaatggagttgtgaagccatcgagcaaaaagcagtgtggtttcatgctgttgcatggggaacaccaggtttcctgactgttatgcttcttgctctgaacaaagttgaaggagacaacattagtggagtttgctttgttggcctttatgacctggatgcttctcgctactttgtactcttgccactgtgcctttgtgtgtttgttgggctctctcttcttttagctggcattatttccttaaatcatgttcgacaagtcatacaacatgatggccggaaccaagaaaaactaaagaaatttatgattcgaattggagtcttcagcggcttgtatcttgtgccattagtgacacttctcggatgttacgtctatgagcaagtgaacaggattacctgggagataacttgggtctctgatcattgtcgtcagtaccatatcccatgtccttatcaggcaaaagcaaaagctcgaccagaattggctttatttatgataaaatacctgatgacattgattgttggcatctctgctgtcttctgggttggaagcaaaaagacatgcacagaatgggctgggttttttaaacgaaatcgcaagagagatccaatcagtgaaagtcgaagagtactacaggaatcatgtgagtttttcttaaagcacaattctaaagttaaacacaaaaagaagcactataaaccaagttcacacaagctgaaggtcatttccaaatccatgggaaccagcacaggagctacagcaaatcatggcacttctgcagtagcaattactagccatgattacctaggacaagaaactttgacagaaatccaaacctcaccagaaacatcaatgagagaggtgaaagcggacggagctagcacccccaggttaagagaacaggactgtggtgaacctgcctcgccagcagcatccatctccagactctctggggaacaggtcgacgggaagggccaggcaggcagtgtatctgaaagtgcgcggagtgaaggaaggattagtccaaagagtgatattactgacactggcctggcacagagcaacaatttgcaggtccccagttcttcagaaccaagcagcctcaaaggttccacatctctgcttgttcacccagtttcaggagtgagaaaagagcagggaggtggttgtcattcagatacttga

SEQ ID NO: 989 - DNA, 1725 bp, Homo sapiens
atgcgggaccccggcgcggccgctccgctttcgtccctgggcctctgtgccctggtgctggcgctgctgggcgcactgtccgcgggcgccggggcgcagccgtaccacggagagaagggcatctccgtgccggaccacggcttctgccagcccatctccatcccgctgtgcacggacatcgcctacaaccagaccatcctgcccaacctgctgggccacacgaaccaagaggacgcgggcctcgaggtgcaccagttctacccgctggtgaaggtgcagtgttctcccgaactccgctttttcttatgctccatgtatgcgcccgtgtgcaccgtgctcgatcaggccatcccgccgtgtcgttctctgtgcgagcgcgcccgccagggctgcgaggcgctcatgaacaagttcggcttccagtggcccgagcggctgcgctgcgagaacttcccggtgcacggtgcgggcgagatctgcgtgggccagaacacgtcggacggctccgggggcccaggcggcggccccactgcctaccctaccgcgccctacctgccggacctgcccttcaccgcgctgcccccgggggcctcagatggcagggggcgtcccgccttccccttctcatgcccccgtcagctcaaggtgcccccgtacctgggctaccgcttcctgggtgagcgcgattgtggcgccccgtgcgaaccgggccgtgccaacggcctgatgtactttaaggaggaggagaggcgcttcgcccgcctctgggtgggcgtgtggtccgtgctgtgctgcgcctcgacgctctttaccgttctcacctacctggtggacatgcggcgcttcagctacccagagcggcccatcatcttcctgtcgggctgctacttcatggtggccgtggcgcacgtggccggcttccttctagaggaccgcgccgtgtgcgtggagcgcttctcggacgatggctaccgcacggtggcgcagggcaccaagaaggagggctgcaccatcctcttcatggtgctctacttcttcggcatggccagctccatctggtgggtcattctgtctctcacttggttcctggcggccggcatgaagtggggccacgaggccatcgaggccaactcgcagtacttccacctggccgcgtgggccgtgcccgccgtcaagaccatcactatcctggccatgggccaggtagacggggacctgctgagcggggtgtgctacgttggcctctccagtgtggacgcgctgcggggcttcgtgctggcgcctctgttcgtctacctcttcataggcacgtccttcttgctggccggcttcgtgtccctcttccgtatccgcaccatcatgaaacacgacggcaccaagaccgagaagctggagaagctcatggtgcgcatcggcgtcttcagcgtgctctacacagtgcccgccaccatcgtcctggcctgctacttctacgagcaggccttccgcgagcactgggagcgcacctggctcctgcagacgtgcaagagctatgccgtgccctgcccgcccggccacttcccgcccatgagccccgacttcaccgtcttcatgatcaagtacctgatgaccatgatcgtcggcatcaccactggcttctggatctggtcgggcaagaccctgcagtcgtggcgccgcttctaccacagacttagccacagcagcaagggggagactgcggtatga

SEQ ID NO: 990 - DNA, 2085 bp, Homo sapiens
atggagtggggttacctgttggaagtgacctcgctgctggccgccttggcgctgctgcagcgctctagcggcgctgcggccgcctcggccaaggagctggcatgccaagagatcaccgtgccgctgtgtaagggcatcggctacaactacacctacatgcccaatcagttcaaccacgacacgcaagacgaggcgggcctggaggtgcaccagttctggccgctggtggagatccagtgctcgcccgatctcaagttcttcctgtgcagcatgtacacgcccatctgcctagaggactacaagaagccgctgccgccctgccgctcggtgtgcgagcgcgccaaggccggctgcgcgccgctcatgcgccagtacggcttcgcctggcccgaccgcatgcgctgcgaccggctgcccgagcaaggcaaccctgacacgctgtgcatggactacaaccgcaccgacctaaccaccgccgcgcccagcccgccgcgccgcctgccgccgccgccgcccggcgagcagccgccttcgggcagcggccacggccgcccgccgggggccaggcccccgcaccgcggaggcggcaggggcggtggcggcggggacgcggcggcgcccccagctcgcggcggcggcggtggcgggaaggcgcggccccctggcggcggcgcggctccctgcgagcccgggtgccagtgccgcgcgcctatggtgagcgtgtccagcgagcgccacccgctctacaaccgcgtcaagacaggccagatcgctaactgcgcgctgccctgccacaacccctttttcagccaggacgagcgcgccttcaccgtcttctggatcggcctgtggtcggtgctctgcttcgtgtccaccttcgccaccgtctccaccttccttatcgacatggagcgcttcaagtacccggagcggcccattatcttcctctcggcctgctacctcttcgtgtcggtgggctacctagtgcgcctggtggcgggccacgagaaggtggcgtgcagcggtggcgcgccgggcgcggggggcgctgggggcgcgggcggcgcggcggcgggcgcgggcgcggcgggcgcgggcgcgggcggcccgggcgggcgcggcgagtacgaggagctgggcgcggtggagcagcacgtgcgctacgagaccaccggccccgcgctgtgcaccgtggtcttcttgctggtctacttcttcggcatggccagctccatctggtgggtgatcttgtcgctcacatggttcctggcggccggtatgaagtggggcaacgaagccatcgccggctactcgcagtacttccacctggccgcgtggcttgtgcccagcgtcaagtccatcgcggtgctggcgctcagctcggtggacggcgacccggtggcgggcatctgctacgtgggcaaccagagcctggacaacctgcgcggcttcgtgctggcgccgctggtcatctacctcttcatcggcaccatgttcctgctggccggcttcgtgtccctgttccgcatccgctcggtcatcaagcaacaggacggccccaccaagacgcacaagctggagaagctgatgatccgcctgggcctgttcaccgtgctctacaccgtgcccgccgcggtggtggtcgcctgcctcttctacgagcagcacaaccgcccgcgctgggaggccacgcacaactgcccgtgcctgcgggacctgcagcccgaccaggcacgcaggcccgactacgccgtcttcatgctcaagtacttcatgtgcctagtggtgggcatcacctcgggcgtgtgggtctggtccggcaagacgctggagtcctggcgctccctgtgcacccgctgctgctgggccagcaagggcgccgcggtgggcgggggcgcgggcgccacggccgcggggggtggcggcgggccggggggcggcggcggcgggggacccggcggcggcggggggccgggcggcggcgggggctccctctacagcgacgtcagcactggcctgacgtggcggtcgggcacggcgagctccgtgtcttatccaaagcagatgccattgtcccaggtctga

SEQ ID NO: 991 - DNA, 1776 bp, Homo sapiens
atggccgtggcgcctctgcggggggcgctgctgctgtggcagctgctggcggcgggcggcgcggcactggagatcggccgcttcgacccggagcgcgggcgcggggctgcgccgtgccaggcggtggagatccccatgtgccgcggcatcggctacaacctgacccgcatgcccaacctgctgggccacacgtcgcagggcgaggcggctgccgagctagcggagttcgcgccgctggtgcagtacggctgccacagccacctgcgcttcttcctgtgctcgctctacgcgcccatgtgcaccgaccaggtctcgacgcccattcccgcctgccggcccatgtgcgagcaggcgcgcctgcgctgcgcgcccatcatggagcagttcaacttcggctggccggactcgctcgactgcgcccggctgcccacgcgcaacgacccgcacgcgctgtgcatggaggcgcccgagaacgccacggccggccccgcggagccccacaagggcctgggcatgctgcccgtggcgccgcggcccgcgcgccctcccggagacctgggcccgggcgcgggcggcagtggcacctgcgagaaccccgagaagttccagtacgtggagaagagccgctcgtgcgcaccgcgctgcgggcccggcgtcgaggtgttctggtcccggcgcgacaaggacttcgcgctggtctggatggccgtgtggtcggcgctgtgcttcttctccaccgccttcactgtgctcaccttcttgctggagccccaccgcttccagtaccccgagcgccccatcatcttcctctccatgtgctacaacgtctactcgctggccttcctgatccgtgcggtggccggagcgcagagcgtggcctgtgaccaggaggcgggcgcgctctacgtgatccaggagggcctggagaacacgggctgcacgctggtcttcctactgctctactacttcggcatggccagctcgctctggtgggtggtcctgacgctcacctggttcctggctgccgggaagaaatggggccacgaggccatcgaggcccacggcagctatttccacatggctgcctggggcctgcccgcgctcaagaccatcgtcatcctgaccctgcgcaaggtggcgggtgatgagctgactgggctttgctacgtggccagcacggatgcagcagcgctcacgggcttcgtgctggtgcccctctctggctacctggtgctgggcagtagtttcctcctgaccggcttcgtggccctcttccacatccgcaagatcatgaagacgggcggcaccaacacagagaagctggagaagctcatggtcaagatcggggtcttctccatcctctacacggtgcccgccacctgcgtcatcgtttgctatgtctacgaacgcctcaacatggacttctggcgccttcgggccacagagcagccatgcgcagcggccgcggggcccggaggccggagggactgctcgctgccagggggctcggtgcccaccgtggcggtcttcatgctcaaaattttcatgtcactggtggtggggatcaccagcggcgtctgggtgtggagctccaagactttccagacctggcagagcctgtgctaccgcaagatagcagctggccgggcccgggccaaggcctgccgcgcccccgggagctacggacgtggcacgcactgccactataaggctcccaccgtggtcttgcacatgactaagacggacccctctttggagaaccccacacacctctag

SEQ ID NO: 992 - DNA, 1143 bp, Homo sapiens
atgtgcccaatgctactgaaaaacggttacaatggaaacgccaccccagtgaccaccactgccccgtgggcctccctgggcctctccgccaagacctgcaacaacgtgtccttcgaagagagcaggatagtcctggtcgtggtgtacagcgcggtgtgcacgctgggggtgccggccaactgcctgactgcgtggctggcgctgctgcaggtactgcagggcaacgtgctggccgtctacctgctctgcctggcactctgcgagctgctgtacacaggcacgctgccactctgggtcatctatatccgcaaccagcaccgctggaccctaggcctgctggcctgcaaggtgaccgcctacatcttcttctgcaacatctacgtcagcatcctcttcctgtgctgcatctcctgcgaccgcttcgtggccgtggtgtacgcgctggagagtcggggccgccgccgccggaggaccgccatcctcatctccgcctgcatcttcatcctcgtcgggatcgttcactacccggtgttccagacggaagacaaggagacctgctttgacatgctgcagatggacagcaggattgccgggtactactacgccaggttcaccgttggctttgccatccctctctccatcatcgccttcaccaaccaccggattttcaggagcatcaagcagagcatgggcttaagcgctgcccagaaggccaaggtgaagcactcggccatcgcggtggttgtcatcttcctagtctgcttcgccccgtaccacctggttctcctcgtcaaagccgctgccttttcctactacagaggagacaggaacgccatgtgcggcttggaggaaaggctgtacacagcctctgtggtgtttctgtgcctgtccacggtgaacggcgtggctgaccccattatctacgtgctggccacggaccattcccgccaagaagtgtccagaatccataaggggtggaaagagtggtccatgaagacagacgtcaccaggctcacccacagcagggacaccgaggagctgcagtcgcccgtggcccttgcagaccactacaccttctccaggcccgtgcacccaccagggtcaccatgccctgcaaagaggctgattgaggagtcctgctga

SEQ ID NO: 993 - DNA, 2886 bp, Homo sapiens
atgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacactcagccgctgtgtccgaatctgctccaagtcttatttgaccctggaaaatgggaaggttttcctgacgggtggggacctcccagctctggacggagcccgggtggatttccggtgtgaccccgacttccatctggtgggcagctcccggagcatctgtagtcagggccagtggagcacccccaagccccactgccaggtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggaggggcacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtga

SEQ ID NO: 994 - DNA, 1050 bp, Homo sapiens
atggagctggcggtcgggaacctcagcgagggcaacgcgagctggccggagccccccgccccggagcccgggccgctgttcggcatcggcgtggagaacttcgtcacgctggtggtgttcggcctgatcttcgcgctgggtgtgctgggcaacagcctagtgatcaccgtgctggcgcgcagcaagccgggcaagccgcggagcaccaccaacctgttcatcctcaacctgagcatcgccgacctggcctacctgctcttctgcatccccttccaggccaccgtgtacgcgctgcccacctgggtgctgggcgccttcatctgcaagttcatccactacttcttcaccgtgtccatgctggtgagcatcttcaccctggccgcgatgtccgtggaccgctacgtggccatcgtgcactcgcggcgctcctcctccctcagggtgtcccgcaacgcgctgctgggcgtgggctgcatctgggcgctgtccattgccatggcctcgcccgtggcctaccaccagggcctcttccacccgcgcgccagcaaccagaccttctgctgggagcagtggcccgaccctcgccacaagaaggcctacgtggtgtgcaccttcgtcttcggctacctgctgccgctcctgctcatctgcttctgctatgccaaggtccttaatcacttgcataaaaagttgaagaacatgtcaaagaagtctgaagcatccaagaaaaagactgcacagacagttctggtggtggttgtggtgtttggaatctcctggctgccgcaccacatcatccatctctgggctgagtttggagttttcccgctgacgccggcttccttcctcttcagaatcaccgcccactgcctggcgtacagcaattcctccgtgaatcctatcatttatgcatttctctctgaaaatttcaggaaggcctataaacaagtgttcaagtgtcacattcgcaaagattcacacctgagtgatactaaagaaaataaaagtcgaatagacaccccaccatcaaccaattgtactcatgtgtga

SEQ ID NO: 995 - DNA, 1164 bp, Homo sapiens
atgaacgtctcgggctgcccaggggccgggaacgcgagccaggcgggcggcgggggaggctggcaccccgaggcggtcatcgtgcccctgctcttcgcgctcatcttcctcgtgggcaccgtgggcaacacgctggtgctggcggtgctgctgcgcggcggccaggcggtcagcactaccaacctgttcatccttaacctgggcgtggccgacctgtgtttcatcctgtgctgcgtgcccttccaggccaccatctacaccctggacggctgggtgttcggctcgctgctgtgcaaggcggtgcacttcctcatcttcctcaccatgcacgccagcagcttcacgctggccgccgtctccctggacaggtatctggccatccgctacccgctgcactcccgcgagctgcgcacgcctcgaaacgcgctggcagccatcgggctcatctgggggctgtcgctgctcttctccgggccctacctgagctactaccgccagtcgcagctggccaacctgaccgtgtgccatcccgcgtggagcgcccctcgccgccgcgccatggacatctgcaccttcgtcttcagctacctgcttcctgtgctggttctcggcctgacctacgcgcgcaccttgcgctacctctggcgcgccgtcgacccggtggccgcgggctcgggtgcccggcgcgccaagcgcaaggtgacacgcatgatcctcatcgtggccgcgctcttctgcctctgctggatgccccaccacgcgctcatcctctgcgtgtggttcggccagttcccgctcacgcgcgccacttatgcgcttcgcatcctctcgcacctggtctcctacgccaactcctgcgtcaaccccatcgtttacgcgctggtctccaagcacttccgcaaaggcttccgcacgatctgcgcgggcctgctgggccgtgccccaggccgagcctcgggccgtgtgtgcgctgccgcgcggggcacccacagtggcagcgtgttggagcgcgagtccagcgacctgttgcacatgagcgaggcggcgggggcccttcgtccctgccccggcgcttcccagccatgcatcctcgagccctgtcctggcccgtcctggcagggcccaaaggcaggcgacagcatcctgacggttgatgtggcctga

SEQ ID NO: 996 - DNA, 1107 bp, Homo sapiens
atggctgatgcccagaacatttcactggacagcccagggagtgtgggggccgtggcagtgcctgtggtctttgccctaatcttcctgctgggcacagtgggcaatgggctggtgctggcagtgctcctgcagcctggcccgagtgcctggcaggagcctggcagcaccacggacctgttcatcctcaacctggcggtggctgacctctgcttcatcctgtgctgcgtgcccttccaggccaccatctacacgctggatgcctggctctttggggccctcgtctgcaaggccgtgcacctgctcatctacctcaccatgtacgccagcagctttacgctggctgctgtctccgtggacaggtacctggccgtgcggcacccgctgcgctcgcgcgccctgcgcacgccgcgtaacgcccgcgccgcagtggggctggtgtggctgctggcggcgctcttctcggcgccctacctcagctactacggcaccgtgcgctacggcgcgctggagctctgcgtgcccgcctgggaggacgcgcgccgccgcgccctggacgtggccaccttcgctgccggctacctgctgcccgtggctgtggtgagcctggcctacgggcgcacgctgcgcttcctgtgggccgccgtgggtcccgcgggcgcggcggcggccgaggcgcggcggagggcgacgggccgcgcggggcgcgccatgctggcggtggccgcgctctacgcgctctgctggggtccgcaccacgcgctcatcctgtgcttctggtacggccgcttcgccttcagcccggccacctacgcctgccgcctggcctcacactgcctggcctacgccaactcctgcctcaacccgctcgtctacgcgctcgcctcgcgccacttccgcgcgcgcttccgccgcctgtggccgtgcggccgccgacgccgccaccgtgcccgccgcgccttgcgtcgcgtccgccccgcgtcctcgggcccacccggctgccccggagacgcccggcctagcgggaggctgctggctggtggcggccagggcccggagcccagggagggacccgtccacggcggagaggctgcccgaggaccggaataa

SEQ ID NO: 997 - DNA, 1434 bp, Homo sapiens
atgcccccctgccagccacagcgacccctgctgctgttgctgctgctgctggcctgccagccacaggtcccctccgctcaggtgatggacttcctgtttgagaagtggaagctctacggtgaccagtgtcaccacaacctgagcctgctgccccctcccacggagctggtgtgcaacagaaccttcgacaagtattcctgctggccggacacccccgccaataccacggccaacatctcctgcccctggtacctgccttggcaccacaaagtgcaacaccgcttcgtgttcaagagatgcgggcccgacggtcagtgggtgcgtggaccccgggggcagccttggcgtgatgcctcccagtgccagatggatggcgaggagattgaggtccagaaggaggtggccaagatgtacagcagcttccaggtgatgtacacagtgggctacagcctgtccctgggggcgctgctcctcgccttggccatcctggggggcctcagcaagctgcactgcacccgcaatgccatccacgcgaatctgtttgcgtccttcgtgctgaaagccagctccgtgctggtcattgatgggctgctcaggacccgctacagccagaaaattggcgacgacctcagtgtcagcacctggctcagtgatggagcggtggctggctgccgtgtggccgcggtgttcatgcaatatggcatcgtggccaactactgctggctgctggtggagggcctgtacctgcacaacctgctgggcctggccaccctccccgagaggagcttcttcagcctctacctgggcatcggctggggtgcccccatgctgttcgtcgtcccctgggcagtggtcaagtgtctgttcgagaacgtccagtgctggaccagcaatgacaacatgggcttctggtggatcctgcggttccccgtcttcctggccatcctgatcaacttcttcatcttcgtccgcatcgttcagctgctcgtggccaagctgcgggcacggcagatgcaccacacagactacaagttccggctggccaagtccacgctgaccctcatccctctgctgggcgtccacgaagtggtcttcgccttcgtgacggacgagcacgcccagggcaccctgcgctccgccaagctcttcttcgacctcttcctcagctccttccagggcctgctggtggctgtcctctactgcttcctcaacaaggaggtgcagtcggagctgcggcggcgttggcaccgctggcgcctgggcaaagtgctatgggaggagcggaacaccagcaaccacagggcctcatcttcgcccggccacggccctcccagcaaggagctgcagtttgggaggggtggtggcagccaggattcatctgcggagacccccttggctggtggcctccctagattggctgagagccccttctga

SEQ ID NO: 998 - DNA, 1272 bp, Homo sapiens
atggaccgccggatgtggggggcccacgtcttctgcgtgttgagcccgttaccgaccgtattgggccacatgcacccagaatgtgacttcatcacccagctgagagaggatgagagtgcctgtctacaagcagcagaggagatgcccaacaccaccctgggctgccctgcgacctgggatgggctgctgtgctggccaacggcaggctctggcgagtgggtcaccctcccctgcccggatttcttctctcacttcagctcagagtcaggggctgtgaaacgggattgtactatcactggctggtctgagccctttccaccttaccctgtggcctgccctgtgcctctggagctgctggctgaggaggaatcttacttctccacagtgaagattatctacaccgtgggccatagcatctctattgtagccctcttcgtggccatcaccatcctggttgctctcaggaggctccactgcccccggaactacgtccacacccagctgttcaccacttttatcctcaaggcgggacgtgtgttcctgaaggatgctgcccttttccacagcgacgacactgaccactgcagcttctccactgttctatgcaaggtctctgtggccgcctcccatttcgccaccatgaccaacttcagctggctgttggcagaagccgtctacctgaactgcctcctggcctccacctcccccagctcaaggagagccttctggtggctggttctcgctggctgggggctgcccgtgctcttcactggcacgtgggtgagctgcaaactggccttcgaggacatcgcgtgctgggacctggacgacacctccccctactggtggatcatcaaagggcccattgtcctctcggtcggggtgaactttgggctttttctcaatattatccgcatcctggtgaggaaactggagccagctcagggcagcctccatacccagtctcagtattggcgtctctccaagtcgacacttttcctgatcccactctttggaattcactacatcatcttcaacttcctgccagacaatgctggcctgggcatccgcctccccctggagctgggactgggttccttccagggcttcattgttgccatcctctactgcttcctcaaccaagaggtgaggactgagatctcacggaagtggcatggccatgaccctgagcttctgccagcctggaggacccgtgctaagtggaccacgccttcccgctcggcggcaaaggtgctgacatctatgtgctag

SEQ ID NO: 999 - DNA, 1392 bp, Homo sapiens
atggccggcgcccccggcccgctgcgccttgcgctgctgctgctcgggatggtgggcagggccggcccccgcccccagggtgccactgtgtccctctgggagacggtgcagaaatggcgagaataccgacgccagtgccagcgctccctgactgaggatccacctcctgccacagacttgttctgcaaccggaccttcgatgaatacgcctgctggccagatggggagccaggctcgttcgtgaatgtcagctgcccctggtacctgccctgggccagcagtgtgccgcagggccacgtgtaccggttctgcacagctgaaggcctctggctgcagaaggacaactccagcctgccctggagggacttgtcggagtgcgaggagtccaagcgaggggagagaagctccccggaggagcagctcctgttcctctacatcatctacacggtgggctacgcactctccttctctgctctggttatcgcctctgcgatcctcctcggcttcagacacctgcactgcaccaggaactacatccacctgaacctgtttgcatccttcatcctgcgagcattgtccgtcttcatcaaggacgcagccctgaagtggatgtatagcacagccgcccagcagcaccagtgggatgggctcctctcctacctggactctctgagctgccgcctggtgtttctgctcatgcagtactgtgtggcggccaattactactggctcttggtggagggcgtgtacctgtacacactgctggccttctcggtcttatctgagcaatggatcttcaggctctacgtgagcataggctggggtgttcccctgctgtttgttgtcccctggggcattgtcaagtacctctatgaggacgagggctgctggaccaggaactccaacatgaactactggctcattatccggctgcccattctctttgccattggggtgaacttcctcatctttgttcgggtcatctgcatcgtggtatccaaactgaaggccaatctcatgtgcaagacagacatcaaatgcagacttgccaagtccacgctgacactcatccccctgctggggactcatgaggtcatctttgcctttgtgatggacgagcacgcccgggggaccctgcgcttcatcaagctgtttacagagctctccttcacctccttccaggggctgatggtggccatattatactgctttgtcaacaatgaggtccagctggaatttcggaagagctgggagcgctggcggcttgagcacttgcacatccagagggacagcagcatgaagcccctcaagtgtcccaccagcagcctgagcagtggagccacggcgggcagcagcatgtacacagccacttgccaggcctcctgcagctga

SEQ ID NO: 1000 - DNA, 987 bp, Homo sapiens
atggcaaacagtgcctctcctgaacagaatcaaaatcactgttcagccatcaacaacagcatcccactgatgcagggcaacctccccactctgaccttgtctggaaagatccgagtgacggttactttcttcctttttctgctctctgcgacctttaatgcttctttcttgttgaaacttcagaagtggacacagaagaaagagaaagggaaaaagctctcaagaatgaagctgctcttaaaacatctgaccttagccaacctgttggagactctgattgtcatgccactggatgggatgtggaacattacagtccaatggtatgctggagagttactctgcaaagttctcagttatctaaagcttttctccatgtatgccccagccttcatgatggtggtgatcagcctggaccgctccctggctatcacgaggcccctagctttgaaaagcaacagcaaagtcggacagtccatggttggcctggcctggatcctcagtagtgtctttgcaggaccacagttatacatcttcaggatgattcatctagcagacagctctggacagacaaaagttttctctcaatgtgtaacacactgcagtttttcacaatggtggcatcaagcattttataactttttcaccttcagctgcctcttcatcatccctcttttcatcatgctgatctgcaatgcaaaaatcatcttcaccctgacacgggtccttcatcaggacccccacgaactacaactgaatcagtccaagaacaatataccaagagcacggctgaagactctaaaaatgacggttgcatttgccacttcatttactgtctgctggactccctactatgtcctaggaatttggtattggtttgatcctgaaatgttaaacaggttgtcagacccagtaaatcacttcttctttctctttgcctttttaaacccatgctttgatccacttatctatggatatttttctctgtga

SEQ ID NO: 1001 - DNA, 1749 bp, Homo sapiens
gtggcctcgaggtggtggcagggccgccccctgcagtccggagacgaacgcacggaccgggcctccggaggcaggttcggctggaaggaaccgctctcgcttcgtcctacacttgcgcaaatgtctccgagcttactcacatagcatattggtatatcaaaatgaaatgcaaggaaccaaaaataacataattgaaggcagtaaaagtgaaattaaataggaagatcatcagtcaaggaagacccactggagaggacagaaaatgaagcagtgttttatcatgtgtatttcagcaggtcttcttgaaatttaactaaaaatatgactgctctctcttcagagaactgctcttttcagtaccagttacgtcaaacaaaccagcccctagacgttaactatctgctattcttgatcatacttgggaaaatattattaaatatccttacactaggaatgagaagaaaaaacacctgtcaaaattttatggaatatttttgcatttcactagcattcgttgatcttttacttttggtaaacatttccattatattgtatttcagggattttgtacttttaagcattaggttcactaaataccacatctgcctatttactcaaattatttcctttacttatggctttttgcattatccagttttcctgacagcttgtatagattattgcctgaatttctctaaaacaaccaagctttcatttaagtgtcaaaaattattttatttctttacagtaattttaatttggatttcagtccttgcttatgttttgggagacccagccatctaccaaagcctgaaggcacagaatgcttattctcgtcactgtcctttctatgtcagcattcagagttactggctgtcatttttcatggtgatgattttatttgtagctttcataacctgttgggaagaagttactactttggtacaggctatcaggataacttcctatatgaatgaaactatcttatattttcctttttcatcccactccagttatactgtgagatctaaaaaaatattcttatccaagctcattgtctgttttctcagtacctggttaccatttgtactacttcaggtaatcattgttttacttaaagttcagattccagcatatattgagatgaatattccctggttatactttgtcaatagttttctcattgctacagtgtattggtttaattgtcacaagcttaatttaaaagacattggattacctttggatccatttgtcaactggaagtgctgcttcattccacttacaattcctaatcttgagcaaattgaaaagcctatatcaataatgatttgttaatattattaattaaaagttacagctgtcataagatcataattttatgaacagaaagaactcaggacatattaaaaaataaactgaactaaaacaacttttgccccctgactgatagcatttcagaatgtgtcttttgaagggctataccagttattaaatagtgttttattttaaaaacaaaataattccaagaagtttttatagttattcagggacactatattacaaatattactttgttattaacacaaaaagtgataagagttaacatttggctatactgatgtttgtgttactcaaaaaaactactggatgcaaactgttatgtaaatctgagatttcactgacaactttaagatatcaacctaaacatttttattaaatgttcaaatgtaagcaagaaaaaaaaaa

SEQ ID NO: 1002 - DNA, 1068 bp, Homo sapiens
atggaagatttggaggaaacattatttgaagaatttgaaaactattcctatgacctagactattactctctggagtctgatttggaggagaaagtccagctgggagttgttcactgggtctccctggtgttatattgtttggcttttgttctgggaattccaggaaatgccatcgtcatttggttcacggggctcaagtggaagaagacagtcaccactctgtggttcctcaatctagccattgcggatttcatttttcttctctttctgcccctgtacatctcctatgtggccatgaatttccactggccctttggcatctggctgtgcaaagccaattccttcactgcccagttgaacatgtttgccagtgtttttttcctgacagtgatcagcctggaccactatatccacttgatccatcctgtcttatctcatcggcatcgaaccctcaagaactctctgattgtcattatattcatctggcttttggcttctctaattggcggtcctgccctgtacttccgggacactgtggagttcaataatcatactctttgctataacaattttcagaagcatgatcctgacctcactttgatcaggcaccatgttctgacttgggtgaaatttatcattggctatctcttccctttgctaacaatgagtatttgctacttgtgtctcatcttcaaggtgaagaagcgaacagtcctgatctccagtaggcatttctggacaattctggttgtggttgtggcctttgtggtttgctggactccttatcacctgtttagcatttgggagctcaccattcaccacaatagctattcccaccatgtgatgcaggctggaatccccctctccactggtttggcattcctcaatagttgcttgaaccccatcctttatgtcctaattagtaagaagttccaagctcgcttccggtcctcagttgctgagatactcaagtacacactgtgggaagtcagctgttctggcacagtgagtgaacagctcaggaactcagaaaccaagaatctgtgtctcctggaaacagctcaataa

SEQ ID NO: 1003 - DNA, 1113 bp, Homo sapiens
atggcctcatcgaccactcggggccccagggtttctgacttattttctgggctgccgccggcggtcacaactcccgccaaccagagcgcagaggcctcggcgggcaacgggtcggtggctggcgcggacgctccagccgtcacgcccttccagagcctgcagctggtgcatcagctgaaggggctgatcgtgctgctctacagcgtcgtggtggtcgtggggctggtgggcaactgcctgctggtgctggtgatcgcgcgggtgcgccggctgcacaacgtgacgaacttcctcatcggcaacctggccttgtccgacgtgctcatgtgcaccgcctgcgtgccgctcacgctggcctatgccttcgagccacgcggctgggtgttcggcggcggcctgtgccacctggtcttcttcctgcagccggtcaccgtctatgtgtcggtgttcacgctcaccaccatcgcagtggaccgctacgtcgtgctggtgcacccgctgaggcggcgcatctcgctgcgcctcagcgcctacgctgtgctggccatctgggcgctgtccgcggtgctggcgctgcccgccgccgtgcacacctatcacgtggagctcaagccgcacgacgtgcgcctctgcgaggagttctggggctcccaggagcgccagcgccagctctacgcctgggggctgctgctggtcacctacctgctccctctgctggtcatcctcctgtcttacgtccgggtgtcagtgaagctccgcaaccgcgtggtgccgggctgcgtgacccagagccaggccgactgggaccgcgctcggcgccggcgcaccttctgcttgctggtggtggtcgtggtggtgttcgccgtctgctggctgccgctgcacgtcttcaacctgctgcgggacctcgacccccacgccatcgacccttacgcctttgggctggtgcagctgctctgccactggctcgccatgagttcggcctgctacaaccccttcatctacgcctggctgcacgacagcttccgcgaggagctgcgcaaactgttggtcgcttggccccgcaagatagccccccatggccagaatatgaccgtcagcgtggtcatctga

SEQ ID NO: 1004 - DNA, 1029 bp, Homo sapiens
atgaccagcaatttttcccaacctgttgtgcagctttgctatgaggatgtgaatggatcttgtattgaaactccctattctcctgggtcccgggtaattctgtacacggcgtttagctttgggtctttgctggctgtatttggaaatctcttagtaatgacttctgttcttcattttaagcagctgcactctccaaccaattttctcattgcctctctggcctgtgctgacttcttggtaggtgtgactgtgatgcttttcagcatggtcaggacggtggagagctgctggtattttggagccaaattttgtactcttcacagttgctgtgatgtggcattttgttactcttctgtcctccacttgtgcttcatctgcatcgacaggtacattgtggttactgatcccctggtctatgctaccaagttcaccgtgtctgtgtcgggaatttgcatcagcgtgtcctggattctgcctctcacgtacagcggtgctgtgttctacacaggtgtcaatgatgatgggctggaggaattagtaagtgctctcaactgcgtaggtggctgtcaaattattgtaagtcaaggctgggtgttgatagattttctgttattcttcatacctacccttgttatgataattctttacagtaagatttttcttatagctaaacaacaagctataaaaattgaaactactagtagcaaagtagaatcatcctcagagagttataaaatcagagtggccaagagagagaggaaagcagctaaaaccctgggggtcacggtactagcatttgttatttcatggttaccgtatacagttgatatattaattgatgcctttatgggcttcctgacccctgcctatatctatgaaatttgctgttggagtgcttattataactcagccatgaatcctttgatttatgctctattttatccttggtttaggaaagccataaaacttattttaagtggagatgttttaaaggctagttcatcaaccattagtttatttttagaataa

SEQ ID NO: 1005 - DNA, 1017 bp, Homo sapiens
atgatcaattcaacctccacacagcctccagatgaatcctgctctcagaacctcctgatcactcagcagatcattcctgtgctgtactgtatggtcttcattgcgggaatcctactcaatggagtgtcaggatggatattcttttacgtgcccagctctaagagtttcatcatctatctcaagaacattgttattgctgactttgtgatgagcctgacttttcctttcaagatccttggtgactcaggccttggtccctggcagctgaacgtgtttgtgtgcagggtctctgccgtgctcttctacgtcaacatgtacgtcagcattgtgttctttgggctcatcagctttgacaggtattataaaattgtaaagcctctttggacttctttcatccagtcagtgagttacagcaaacttctgtcagtgatagtatggatgctcatgctcctccttgctgttccaaatattattctcaccaaccagagtgttagggaggttacacaaataaaatgtatagaactgaaaagtgaactgggacggaagtggcacaaagcatcaaactacatcttcgtggccatcttctggattgtgtttcttttgttaatcgttttctatactgctatcacaaagaaaatctttaagtcccaccttaagtcaagtcggaattccacttcggtcaaaaagaaatctagccgcaacatattcagcatcgtgtttgtgttttttgtctgttttgtaccttaccatattgccagaatcccctacacaaagagtcagaccgaagctcattacagctgccagtcaaaagaaatcttgcggtatatgaaagaattcactctgctactatctgctgcaaatgtatgcttggaccctattatttatttctttctatgccagccgtttagggaaatcttatgtaagaaattgcacattccattaaaagctcagaatgacctagacatttccagaatcaaaagaggaaatacaacacttgaaagcacagatactttgtga

SEQ ID NO: 1006 - DNA, 1005 bp, Homo sapiens
atgaatgaagacctgaaggtcaatttaagcgggctgcctcgggattatttagatgccgctgctgcggagaacatctcggctgctgtctcctcccgggttcctgccgtagagccagagcctgagctcgtagtcaacccctgggacattgtcttgtgtacctcgggaaccctcatctcctgtgaaaatgccattgtggtccttatcatcttccacaaccccagcctgcgagcacccatgttcctgctaataggcagcctggctcttgcagacctgctggccggcattggactcatcaccaattttgtttttgcctacctgcttcagtcagaagccaccaagctggtcacgatcggcctcattgtcgcctctttctctgcctctgtctgcagcttgctggctatcactgttgaccgctacctctcactgtactacgctctgacgtaccattcggagaggacggtcacgtttacctatgtcatgctcgtcatgctctgggggacctccatctgcctggggctgctgcccgtcatgggctggaactgcctccgagacgagtccacctgcagcgtggtcagaccgctcaccaagaacaacgcggccatcctctcggtgtccttcctcttcatgtttgcgctcatgcttcagctctacatccagatctgtaagattgtgatgaggcacgcccatcagatagccctgcagcaccacttcctggccacgtcgcactatgtgaccacccggaaaggggtctccaccctggctatcatcctggggacgtttgctgcttgctggatgcctttcaccctctattccttgatagcggattacacctacccctccatctatacctacgccaccctcctgcccgccacctacaattccatcatcaaccctgtcatatatgctttcagaaaccaagagatccagaaagcgctctgtctcatttgctgcggctgcatcccgtccagtctcgcccagagagcgcgctcgcccagtgatgtgtag

SEQ ID NO: 1007 - DNA, 1170 bp, Homo sapiens
atggcgctgacccccgagtccccgagcagcttccctgggctggccgccaccggcagctctgtgccggagccgcctggcggccccaacgcaaccctcaacagctcctgggccagcccgaccgagcccagctccctggaggacctggtggccacgggcaccattgggactctgctgtcggccatgggcgtggtgggcgtggtgggcaacgcctacacgctggtggtcacctgccgctccctgcgtgcggtggcctccatgtacgtctacgtggtcaacctggcgctggccgacctgctgtacctgctcagcatccccttcatcgtggccacctacgtcaccaaggagtggcacttcggggacgtgggctgccgcgtgctcttcggcctggacttcctgaccatgcacgccagcatcttcacgctgaccgtcatgagcagcgagcgctacgctgcggtgctgcggccgctggacaccgtgcagcgccccaagggctaccgcaagctgctggcgctgggcacctggctgctggcgctgctgctgacgctgcccgtgatgctggccatgcggctggtgcgccggggtcccaagagcctgtgcctgcccgcctggggcccgcgcgcccaccgcgcctacctgacgctgctcttcgccaccagcatcgcggggcccgggctgctcatcgggctgctctacgcgcgcctggcccgcgcctaccgccgctcgcagcgcgcctccttcaagcgggcccggcggccgggggcgcgcgcgctgcgcctggtgctgggcatcgtgctgctcttctgggcctgcttcctgcccttctggctgtggcagctgctcgcccagtaccaccaggccccgctggcgccgcggacggcgcgcatcgtcaactacctgaccacctgcctcacctacggcaacagctgcgccaaccccttcctctacacgctgctcaccaggaactaccgcgaccacctgcgcggccgcgtgcggggcccgggcagcgggggaggccgggggcccgttccctccctgcagccccgcgcccgcttccagcgctgttcgggccgctccctgtcttcctgcagcccacagcccactgacagcctcgtgctggccccagcggccccggcccgacctgcgcccgagggtcccagggccccggcgtga

SEQ ID NO: 1008 - DNA, 1083 bp, Homo sapiens
atggacccagaagaaacttcagtttatttggattattactatgctacgagcccaaactctgacatcagggagacccactcccatgttccttacacctctgtcttccttccagtcttttacacagctgtgttcctgactggagtgctggggaaccttgttctcatgggagcgttgcatttcaaacccggcagccgaagactgatcgacatctttatcatcaatctggctgcctctgacttcatttttcttgtcacattgcctctctgggtggataaagaagcatctctaggactgtggaggacgggctccttcctgtgcaaagggagctcctacatgatctccgtcaatatgcactgcagtgtcctcctgctcacttgcatgagtgttgaccgctacctggccattgtgtggccagtcgtatccaggaaattcagaaggacagactgtgcatatgtagtctgtgccagcatctggtttatctcctgcctgctggggttgcctactcttctgtccagggagctcacgctgattgatgataagccatactgtgcagagaaaaaggcaactccaattaaactcatatggtccctggtggccttaattttcaccttttttgtccctttgttgagcattgtgacctgctactgttgcattgcaaggaagctgtgtgcccattaccagcaatcaggaaagcacaacaaaaagctgaagaaatctataaagatcatctttattgtcgtggcagcctttcttgtctcctggctgcccttcaatactttcaagttcctggccattgtctctgggttgcggcaagaacactatttaccctcagctattcttcagcttggtatggaggtgagtggacccttggcatttgccaacagctgtgtcaaccctttcatttactatatcttcgacagctacatccgccgggccattgtccactgcttgtgcccttgcctgaaaaactatgactttgggagtagcactgagacatcagatagtcacctcactaaggctctctccaccttcattcatgcagaagattttgccaggaggaggaagaggtctgtgtcactctaa

SEQ ID NO: 1009 - DNA, 1409 bp, Homo sapiens
gaaagagacaaagcagcaattaaagtcagcccagcaccaactccgacgccaagcgttacactggaaactactttttaaagcaacaaaagagtctaaaacaaaatacaacatttcttaaatacactgtttccagaaagagctattttaacagaagcaactcaaagatatcccttcgacagaagtggaagtgctgaaaaatgctcatctctcacacagacttttgatggacaggagtttctaagtatcatgcctaccaacaagctgtaaaatgatcaccctgaacaatcaagatcaacctgtcccttttaacagctcacatccagatgaatacaaaattgcagcccttgtcttctatagctgtatcttcataattggattatttgttaacatcactgcattatgggttttcagttgtaccaccaagaagagaaccacggtaaccatctatatgatgaatgtggcattagtggacttgatatttataatgactttaccctttcgaatgttttattatgcaaaagatgaatggccatttggagagtacttctgccagattcttggagctctcacagtgttttacccaagcattgctttatggcttcttgcctttattagtgctgacagatacatggccattgtacagccgaagtacgccaaagaacttaaaaacacgtgcaaagccgtgctggcgtgtgtgggagtctggataatgaccctgaccacgaccacccctctgctactgctctataaagacccagataaagactccactcccgccacctgcctcaagatttctgacatcatctatctaaaagctgtgaacgtgctgaacctcactcgactgacattttttttcttgattcctttgttcatcatgattgggtgctacttggtcattattcataatctccttcacggcaggacgtctaagctgaaacccaaagtcaaggagaagtccataaggatcatcatcacgctgctggtgcaggtgctcgtctgctttatgcccttccacatctgtttcgctttcctgatgctgggaacgggggagaacagttacaatccctggggagcctttaccaccttcctcatgaacctcagcacgtgtctggatgtgattctctactacatcgtttcaaaacaatttcaggctcgagtcattagtgtcatgctataccgtaattaccttcgaagcatgcgcagaaaaagtttccgatctggtagtctacggtcactaagcaatataaacagtgaaatgttatgaataataaggttctttcatttcaatcccatcaaaattcacttcactaactactctggcgtcaatggatattctgtataatactatcaagtcccttttctcttgaaaaaataaattcattatcttcattttaaaaaaaaaaaaaaaa

SEQ ID NO: 1010 - DNA, 1248 bp, Homo sapiens
atggtttttgctcacagaatggataacagcaagccacatttgattattcctacacttctggtgcccctccaaaaccgcagctgcactgaaacagccacacctctgccaagccaatacctgatggaattaagtgaggagcacagttggatgagcaaccaaacagaccttcactatgtgctgaaacccggggaagtggccacagccagcatcttctttgggattctgtggttgttttctatcttcggcaattccctggtttgtttggtcatccataggagtaggaggactcagtctaccaccaactactttgtggtctccatggcatgtgctgaccttctcatcagcgttgccagcacgcctttcgtcctgctccagttcaccactggaaggtggacgctgggtagtgcaacgtgcaaggttgtgcgatattttcaatatctcactccaggtgtccagatctacgttctcctctccatctgcatagaccggttctacaccatcgtctatcctctgagcttcaaggtgtccagagaaaaagccaagaaaatgattgcggcatcgtggatctttgatgcaggctttgtgacccctgtgctctttttctatggctccaactgggacagtcattgtaactatttcctcccctcctcttgggaaggcactgcctacactgtcatccacttcttggtgggctttgtgattccatctgtcctcataattttattttaccaaaaggtcataaaatatatttggagaataggcacagatggccgaacggtgaggaggacaatgaacattgtccctcggacaaaagtgaaaactatcaagatgttcctcattttaaatctgttgtttttgctctcctggctgccttttcatgtagctcagctatggcacccccatgaacaagactataagaaaagttcccttgttttcacagctatcacatggatatcctttagttcttcagcctctaaacctactctgtattcaatttataatgccaattttcggagagggatgaaagagactttttgcatgtcctctatgaaatgttaccgaagcaatgcctatactatcacaacaagttcaaggatggccaaaaaaaactacgttggcatttcagaaatcccttccatggccaaaactattaccaaagactcgatctatgactcatttgacagagaagccaaggaaaaaaagcttgcttggcccattaactcaaatccaccaaatacttttgtctaa

SEQ ID NO: 1011 - DNA, 1089 bp, Homo sapiens
atggggacggaggccacagagcaggtttcctggggccattactctggggatgaagaggacgcatactcggctgagccactgccggagctttgctacaaggccgatgtccaggccttcagccgggccttccaacccagtgtctccctgaccgtggctgcgctgggtctggccggcaatggcctggtcctggccacccacctggcagcccgacgcgcagcgcgctcgcccacctctgcccacctgctccagctggccctggccgacctcttgctggccctgactctgcccttcgcggcagcaggggctcttcagggctggagtctgggaagtgccacctgccgcaccatctctggcctctactcggcctccttccacgccggcttcctcttcctggcctgtatcagcgccgaccgctacgtggccatcgcgcgagcgctcccagccgggccgcggccctccactcccggccgcgcacacttggtctccgtcatcgtgtggctgctgtcactgctcctggcgctgcctgcgctgctcttcagccaggatgggcagcgggaaggccaacgacgctgtcgcctcatcttccccgagggcctcacgcagacggtgaagggggcgagcgccgtggcgcaggtggccctgggcttcgcgctgccgctgggcgtcatggtagcctgctacgcgcttctgggccgcacgctgctggccgccagggggcccgagcgccggcgtgcgctgcgcgtcgtggtggctctggtggcggccttcgtggtgctgcagctgccctacagcctcgccctgctgctggatactgccgatctactggctgcgcgcgagcggagctgccctgccagcaaacgcaaggatgtcgcactgctggtgaccagcggcttggccctcgcccgctgtggcctcaatcccgttctctacgccttcctgggcctgcgcttccgccaggacctgcggaggctgctacggggtgggagctcgccctcagggcctcaaccccgccgcggctgcccccgccggccccgcctttcttcctgctcagctcccacggagacccacagtctctcctgggacaactag

SEQ ID NO: 1012 - DNA, 1302 bp, Homo sapiens
atgtgtttttctcccattctggaaatcaacatgcagtctgaatctaacattacagtgcgagatgacattgatgacatcaacaccaatatgtaccaaccactatcatatccgttaagctttcaagtgtctctcaccggatttcttatgttagaaattgtgttgggacttggcagcaacctcactgtattggtactttactgcatgaaatccaacttaatcaactctgtcagtaacattattacaatgaatcttcatgtacttgatgtaataatttgtgtgggatgtattcctctaactatagttatccttctgctttcactggagagtaacactgctctcatttgctgtttccatgaggcttgtgtatcttttgcaagtgtctcaacagcaatcaacgtttttgctatcactttggacagatatgacatctctgtaaaacctgcaaaccgaattctgacaatgggcagagctgtaatgttaatgatatccatttggattttttcttttttctctttcctgattccttttattgaggtaaattttttcagtcttcaaagtggaaatacctgggaaaacaagacacttttatgtgtcagtacaaatgaatactacactgaactgggaatgtattatcacctgttagtacagatcccaatattctttttcactgttgtagtaatgttaatcacatacaccaaaatacttcaggctcttaatattcgaataggcacaagattttcaacagggcagaagaagaaagcaagaaagaaaaagacaatttctctaaccacacaacatgaggctacagacatgtcacaaagcagtggtgggagaaatgtagtctttggtgtaagaacttcagtttctgtaataattgccctccggcgagctgtgaaacgacaccgtgaacgacgagaaagacaaaagagagtcttcaggatgtctttattgattatttctacatttcttctctgctggacaccaatttctgttttaaataccaccattttatgtttaggcccaagtgaccttttagtaaaattaagattgtgttttttagtcatggcttatggaacaactatatttcaccctctattatatgcattcactagacaaaaatttcaaaaggtcttgaaaagtaaaatgaaaaagcgagttgtttctatagtagaagctgatcccctgcctaataatgctgtaatacacaactcttggatagatcccaaaagaaacaaaaaaattacctttgaagatagtgaaataagagaaaaacgtttagtgcctcaggttgtcacagactag

SEQ ID NO: 1013 - DNA, 1209 bp, Homo sapiens
atgttgtgtccttccaagacagatggctcagggcactctggtaggattcaccaggaaactcatggagaagggaaaagggacaagattagcaacagtgaagggagggagaatggtgggagaggattccagatgaacggtgggtcgctggaggctgagcatgccagcaggatgtcagttctcagagcaaagcccatgtcaaacagccaacgcttgctccttctgtccccaggatcacctcctcgcacggggagcatctcctacatcaacatcatcatgccttcggtgttcggcaccatctgcctcctgggcatcatcgggaactccacggtcatcttcgcggtcgtgaagaagtccaagctgcactggtgcaacaacgtccccgacatcttcatcatcaacctctcggtagtagatctcctctttctcctgggcatgcccttcatgatccaccagctcatgggcaatggggtgtggcactttggggagaccatgtgcaccctcatcacggccatggatgccaatagtcagttcaccagcacctacatcctgaccgccatggccattgaccgctacctggccactgtccaccccatctcttccacgaagttccggaagccctctgtggccaccctggtgatctgcctcctgtgggccctctccttcatcagcatcacccctgtgtggctgtatgccagactcatccccttcccaggaggtgcagtgggctgcggcatacgcctgcccaacccagacactgacctctactggttcaccctgtaccagtttttcctggcctttgccctgccttttgtggtcatcacagccgcatacgtgaggatcctgcagcgcatgacgtcctcagtggcccccgcctcccagcgcagcatccggctgcggacaaagagggtgacccgcacagccatcgccatctgtctggtcttctttgtgtgctgggcaccctactatgtgctacagctgacccagttgtccatcagccgcccgaccctcacctttgtctacttatacaatgcggccatcagcttgggctatgccaacagctgcctcaacccctttgtgtacatcgtgctctgtgagacgttccgcaaacgcttggtcctgtcggtgaagcctgcagcccaggggcagcttcgcgctgtcagcaacgctcagacggctgacgaggagaggacagaaagcaaaggcacctga

SEQ ID NO: 1014 - DNA, 1128 bp, Homo sapiens
atggcgaacgcgagcgagccgggtggcagcggcggcggcgaggcggccgccctgggcctcaagctggccacgctcagcctgctgctgtgcgtgagcctagcgggcaacgtgctgttcgcgctgctgatcgtgcgggagcgcagcctgcaccgcgccccgtactacctgctgctcgacctgtgcctggccgacgggctgcgcgcgctcgcctgcctcccggccgtcatgctggcggcgcggcgtgcggcggccgcggcgggggcgccgccgggcgcgctgggctgcaagctgctcgccttcctggccgcgctcttctgcttccacgccgccttcctgctgctgggcgtgggcgtcacccgctacctggccatcgcgcaccaccgcttctatgcagagcgcctggccggctggccgtgcgccgccatgctggtgtgcgccgcctgggcgctggcgctggccgcggccttcccgccagtgctggacggcggtggcgacgacgaggacgcgccgtgcgccctggagcagcggcccgacggcgcccccggcgcgctgggcttcctgctgctgctggccgtggtggtgggcgccacgcacctcgtctacctccgcctgctcttcttcatccacgaccgccgcaagatgcggcccgcgcgcctggtgcccgccgtcagccacgactggaccttccacggcccgggcgccaccggccaggcggccgccaactggacggcgggcttcggccgcgggcccacgccgcccgcgcttgtgggcatccggcccgcagggccgggccgcggcgcgcgccgcctcctcgtgctggaagaattcaagacggagaagaggctgtgcaagatgttctacgccgtcacgctgctcttcctgctcctctgggggccctacgtcgtggccagctacctgcgggtcctggtgcggcccggcgccgtcccccaggcctacctgacggcctccgtgtggctgaccttcgcgcaggccggcatcaaccccgtcgtgtgcttcctcttcaacagggagctgagggactgcttcagggcccagttcccctgctgccagagcccccggaccacccaggcgacccatccctgcgacctgaaaggcattggtttatga

SEQ ID NO: 1015 - DNA, 993 bp, Homo sapiens
atgatgtggggtgcaggcagccctctggcctggctctcagctggctcaggcaacgtgaatgtaagcagcgtgggcccagcagaggggcccacaggtccagccgcaccactgccctcgcctaaggcctgggatgtggtgctctgcatctcaggcaccctggtgtcctgcgagaatgcgctagtggtggccatcatcgtgggcactcctgccttccgtgcccccatgttcctgctggtgggcagcctggccgtggcagacctgctggcaggcctgggcctggtcctgcactttgctgctgtcttctgcatcggctcagcggagatgagcctggtgctggttggcgtgctggcaatggcctttaccgccagcatcggcagtctactggccatcactgtcgaccgctacctttctctgtacaatgccctcacctactattcagagacaacagtgacacggacctatgtgatgctggccttagtgtggggaggtgccctgggcctggggctgctgcctgtgctggcctggaactgcctggatggcctgaccacatgtggcgtggtttatccactctccaagaaccatctggtagttctggccattgccttcttcatggtgtttggcatcatgctgcagctctacgcccaaatctgccgcatcgtctgccgccatgcccagcagattgcccttcagcggcacctgctgcctgcctcccactatgtggccacccgcaagggcattgccacactggccgtggtgcttggagcctttgccgcctgctggttgcccttcactgtctactgcctgctgggtgatgcccactctccacctctctacacctatcttaccttgctccctgccacctacaactccatgatcaaccctatcatctacgccttccgcaaccaggatgtgcagaaagtgctgtgggctgtctgctgctgctgttcctcttccaagatccccttccgatcccgctcccccagtgatgtctag

SEQ ID NO: 1016 - DNA, 1128 bp, Homo sapiens
atggatgtgacttcccaagcccggggcgtgggcctggagatgtacccaggcaccgcgcagcctgcggcccccaacaccacctcccccgagctcaacctgtcccacccgctcctgggcaccgccctggccaatgggacaggtgagctctcggagcaccagcagtacgtgatcggcctgttcctctcgtgcctctacaccatcttcctcttccccatcggctttgtgggcaacatcctgatcctggtggtgaacatcagcttccgcgagaagatgaccatccccgacctgtacttcatcaacctggcggtggcggacctcatcctggtggccgactccctcattgaggtgttcaacctgcacgagcggtactacgacatcgccgtcctgtgcaccttcatgtcgctcttcctgcaggtcaacatgtacagcagcgtcttcttcctcacctggatgagcttcgaccgctacatcgccctggccagggccatgcgctgcagcctgttccgcaccaagcaccacgcccggctgagctgtggcctcatctggatggcatccgtgtcagccacgctggtgcccttcaccgccgtgcacctgcagcacaccgacgaggcctgcttctgtttcgcggatgtccgggaggtgcagtggctcgaggtcacgctgggcttcatcgtgcccttcgccatcatcggcctgtgctactccctcattgtccgggtgctggtcagggcgcaccggcaccgtgggctgcggccccggcggcagaaggcgctccgcatgatcctcgcggtggtgctggtcttcttcgtctgctggctgccggagaacgtcttcatcagcgtgcacctcctgcagcggacgcagcctggggccgctccctgcaagcagtctttccgccatgcccaccccctcacgggccacattgtcaacctcgccgccttctccaacagctgcctaaaccccctcatctacagctttctcggggagaccttcagggacaagctgaggctgtacattgagcagaaaacaaatttgccggccctgaaccgcttctgtcacgctgccctgaaggccgtcattccagacagcaccgagcagtcggatgtgaggttcagcagtgccgtgtag

SEQ ID NO: 1017 - DNA, 1146 bp, Homo sapiens
atgagaagtcataccataacaatgacgacaacttcagtcagcagctggccttactcctcccacagaatgcgctttataaccaatcatagcgaccaaccgccacaaaacttctcagcaacaccaaatgttactacctgtcccatggatgaaaaattgctatctactgtgttaaccacatcctactctgttattttcatcgtgggactggttgggaacataatcgccctctatgtatttctgggtattcaccgtaaaagaaattccattcaaatttatctacttaacgtagccattgcagacctcctactcatcttctgcctccctttccgaatcatgtatcatattaaccaaaacaagtggacactaggtgtgattctgtgcaaggttgtgggaacactgttttatatgaacatgtacattagcattattttgcttggattcatcagtttggatcgctatataaaaattaatcggtctatacagcaacggaaggcaataacaaccaaacaaagtatttatgtctgttgtatagtatggatggttgctcttggtggattcctaactatgattattttaacacttaagaaaggagggcataattccacaatgtgtttccattacagagataagcataacgcaaaaggagaagccatttttaacttcattcttgtggtaatgttctggctaattttcttactaataatcctttcatatattaagattgggaagaatctattgaggatttctaaaaggaggtcaaaatttcctaattctggtaaatatgccactacagctcgtaactcctttattgtacttatcatttttactatatgttttgttccctatcatgcctttcgattcatctacatttcttcacagctaaatgtatcatcttgctactggaaagaaattgttcacaaaaccaatgagatcatgctggttctctcatctttcaatagttgcttagatccagtcatgtatttcctgatgtccagtaacattcgcaaaataatgtgccaacttctttttagacgatttcaaggtgaaccaagtaggagtgaaagcacttcagaatttaaaccaggatactccctgcatgatacatctgtggcagtgaaaatacagtctagttctaaaagtacttga

SEQ ID NO: 1018 - DNA, 930 bp, Homo sapiens
atgaatggcacctacaacacctgtggctccagcgacctcacctggcccccagcgatcaagctgggcttctacgcctacttgggcgtcctgctggtgctaggcctgctgctcaacagcctggcgctctgggtgttctgctgccgcatgcagcagtggacggagacccgcatctacatgaccaacctggcggtggccgacctctgcctgctgtgcaccttgcccttcgtgctgcactccctgcgagacacctcagacacgccgctgtgccagctctcccagggcatctacctgaccaacaggtacatgagcatcagcctggtcacggccatcgccgtggaccgctatgtggccgtgcggcacccgctgcgtgcccgcgggctgcggtcccccaggcaggctgcggccgtgtgcgcggtcctctgggtgctggtcatcggctccctggtggctcgctggctcctggggattcaggagggcggcttctgcttcaggagcacccggcacaatttcaactccatgcggttcccgctgctgggattctacctgcccctggccgtggtggtcttctgctccctgaaggtggtgactgccctggcccagaggccacccaccgacgtggggcaggcagaggccacccgcaaggctgcccgcatggtctgggccaacctcctggtgttcgtggtctgcttcctgcccctgcacgtggggctgacagtgcgcctcgcagtgggctggaacgcctgtgccctcctggagacgatccgtcgcgccctgtacataaccagcaagctctcagatgccaactgctgcctggacgccatctgctactactacatggccaaggagttccaggaggcgtctgcactggccgtggctccccgtgctaaggcccacaaaagccaggactctctgtgcgtgaccctcgcctaa

SEQ ID NO: 1019 - DNA, 1842 bp, Homo sapiens
atgcgagccccgggcgcgcttctcgcccgcatgtcgcggctactgcttctgctactgctcaaggtgtctgcctcttctgccctcggggtcgcccctgcgtccagaaacgaaacttgtctgggggagagctgtgcacctacagtgatccagcgccgcggcagggacgcctggggaccgggaaattctgcaagagacgttctgcgagcccgagcacccagggaggagcagggggcagcgtttcttgcgggaccctcctgggacctgccggcggccccgggccgtgacccggctgcaggcagaggggcggaggcgtcggcagccggacccccgggacctccaaccaggccacctggcccctggaggtggaaaggtgctcggggtcaggagccttctgaaactttggggagagggaaccccacggccctccagctcttccttcagatctcagaggaggaagagaagggtcccagaggcgctggcatttccgggcgtagccaggagcagagtgtgaagacagtccccggagccagcgatcttttttactggccaaggagagccgggaaactccagggttcccaccacaagcccctgtccaagacggccaatggactggcggggcacgaagggtggacaattgcactcccgggccgggcgctggcccagaatggatccttgggtgaaggaatccatgagcctgggggtccccgccggggaaacagcacgaaccggcgtgtgagactgaagaaccccttctacccgctgacccaggagtcctatggagcctacgcggtcatgtgtctgtccgtggtgatcttcgggaccggcatcattggcaacctggcggtgatgtgcatcgtgtgccacaactactacatgcggagcatctccaactccctcttggccaacctggccttctgggactttctcatcatcttcttctgccttccgctggtcatcttccacgagctgaccaagaagtggctgctggaggacttctcctgcaagatcgtgccctatatagaggtcgcttctctgggagtcaccactttcaccttatgtgctctgtgcatagaccgcttccgtgctgccaccaacgtacagatgtactacgaaatgatcgaaaactgttcctcaacaactgccaaacttgctgttatatgggtgggagctctattgttagcacttccagaagttgttctccgccagctgagcaaggaggatttggggtttagtggccgagctccggcagaaaggtgcattattaagatctctcctgatttaccagacaccatctatgttctagccctcacctacgacagtgcgagactgtggtggtattttggctgttacttttgtttgcccacgcttttcaccatcacctgctctctagtgactgcgaggaaaatccgcaaagcagagaaagcctgtacccgagggaataaacggcagattcaactagagagtcagatgaactgtacagtagtggcactgaccattttatatggattttgcattattcctgaaaatatctgcaacattgttactgcctacatggctacaggggtttcacagcagacaatggacctccttaatatcatcagccagttccttttgttctttaagtcctgtgtcaccccagtcctccttttctgtctctgcaaacccttcagtcgggccttcatggagtgctgctgctgttgctgtgaggaatgcattcagaagtcttcaacggtgaccagtgatgacaatgacaacgagtacaccacggaactcgaactctcgcctttcagtaccatacgccgtgaaatgtccacttttgcttctgtcggaactcattgctga

SEQ ID NO: 1020 - DNA, 903 bp, Homo sapiens
atggacctgcccccgcagctctccttcggcctctatgtggccgcctttgcgctgggcttcccgctcaacgtcctggccatccgaggcgcgacggcccacgcccggctccgtctcacccctagcctggtctacgccctgaacctgggctgctccgacctgctgctgacagtctctctgcccctgaaggcggtggaggcgctagcctccggggcctggcctctgccggcctcgctgtgccccgtcttcgcggtggcccacttcttcccactctatgccggcgggggcttcctggccgccctgagtgcaggccgctacctgggagcagccttccccttgggctaccaagccttccggaggccgtgctattcctggggggtgtgcgcggccatctgggccctcgtcctgtgtcacctgggtctggtctttgggttggaggctccaggaggctggctggaccacagcaacacctccctgggcatcaacacaccggtcaacggctctccggtctgcctggaggcctgggacccggcctctgccggcccggcccgcttcagcctctctctcctgctcttttttctgcccttggccatcacagccttctgctacgtgggctgcctccgggcactggcccgctccggcctgacgcacaggcggaagctgcgggccgcctgggtggccggcggggccctcctcacgctgctgctctgcgtaggaccctacaacgcctccaacgtggccagcttcctgtaccccaatctaggaggctcctggcggaagctggggctcatcacgggtgcctggagtgtggtgcttaatccgctggtgaccggttacttgggaaggggtcctggcctgaagacagtgtgtgcggcaagaacgcaagggggcaagtcccagaagtaa

SEQ ID NO: 1021 - DNA, 1041 bp, Homo sapiens
atggatacaggccccgaccagtcctacttctccggcaatcactggttcgtcttctcggtgtaccttctcactttcctggtggggctccccctcaacctgctggccctggtggtcttcgtgggcaagctgcagcgccgcccggtggccgtggacgtgctcctgctcaacctgaccgcctcggacctgctcctgctgctgttcctgcctttccgcatggtggaggcagccaatggcatgcactggcccctgcccttcatcctctgcccactctctggattcatcttcttcaccaccatctatctcaccgccctcttcctggcagctgtgagcattgaacgcttcctgagtgtggcccacccactgtggtacaagacccggccgaggctggggcaggcaggtctggtgagtgtggcctgctggctgttggcctctgctcactgcagcgtggtctacgtcatagaattctcaggggacatctcccacagccagggcaccaatgggacctgctacctggagttccggaaggaccagctagccatcctcctgcccgtgcggctggagatggctgtggtcctctttgtggtcccgctgatcatcaccagctactgctacagccgcctggtgtggatcctcggcagagggggcagccaccgccggcagaggagggtggcggggctgttggcggccacgctgctcaacttccttgtctgctttgggccctacaacgtgtcccatgtcgtgggctatatctgcggtgaaagcccggcatggaggatctacgtgacgcttctcagcaccctgaactcctgtgtcgacccctttgtctactacttctcctcctccgggttccaagccgactttcatgagctgctgaggaggttgtgtgggctctggggccagtggcagcaggagagcagcatggagctgaaggagcagaagggaggggaggagcagagagcggaccgaccagctgaaagaaagaccagtgaacactcacagggctgtggaactggtggccaggtggcctgtgctgaaagctag

SEQ ID NO: 1022 - DNA, 993 bp, Homo sapiens
atgctgccggactggaagagctccttgatcctcatggcttacatcatcatcttcctcactggcctccctgccaacctcctggccctgcgggcctttgtggggcggatccgccagccccagcctgcacctgtgcacatcctcctgctgagcctgacgctggccgacctcctcctgctgctgctgctgcccttcaagatcatcgaggctgcgtcgaacttccgctggtacctgcccaaggtcgtctgcgccctcacgagttttggcttctacagcagcatctactgcagcacgtggctcctggcgggcatcagcatcgagcgctacctgggagtggctttccccgtgcagtacaagctctcccgccggcctctgtatggagtgattgcagctctggtggcctgggttatgtcctttggtcactgcaccatcgtgatcatcgttcaatacttgaacacgactgagcaggtcagaagtggcaatgaaattacctgctacgagaacttcaccgataaccagttggacgtggtgctgcccgtgcggctggagctgtgcctggtgctcttcttcatccccatggcagtcaccatcttctgctactggcgttttgtgtggatcatgctctcccagccccttgtgggggcccagaggcggcgccgagccgtggggctggctgtggtgacgctgctcaatttcctggtgtgcttcggaccttacaacgtgtcccacctggtggggtatcaccagagaaaaagcccctggtggcggtcaatagccgtggtgttcagttcactcaacgccagtctggaccccctgctcttctatttctcttcttcagtggtgcgcagggcatttgggagagggctgcaggtgctgcggaatcagggctcctccctgttgggacgcagaggcaaagacacagcagaggggacaaatgaggacaggggtgtgggtcaaggagaagggatgccaagttcggacttcactacagagtag

SEQ ID NO: 1023 - DNA, 1188 bp, Homo sapiens
atgtcggccaacgccacactgaagccactctgccccatcctggagcagatgagccgtctccagagccacagcaacaccagcatccgctacatcgaccacgcggccgtgctgctgcacgggctggcctcgctgctgggcctggtggagaatggagtcatcctcttcgtggtgggctgccgcatgcgccagaccgtggtcaccacctgggtgctgcacctggcgctgtccgacctgttggcctctgcttccctgcccttcttcacctacttcttggccgtgggccactcgtgggagctgggcaccaccttctgcaaactgcactcctccatcttctttctcaacatgttcgccagcggcttcctgctcagcgccatcagcctggaccgctgcctgcaggtggtgcggccggtgtgggcgcagaaccaccgcaccgtggccgcggcgcacaaagtctgcctggtgctttgggcactagcggtgctcaacacggtgccctatttcgtgttccgggacaccatctcgcggctggacgggcgcattatgtgctactacaatgtgctgctcctgaacccggggcctgaccgcgatgccacgtgcaactcgcgccaggcggccctggccgtcagcaagttcctgctggccttcctggtgccgctggcgatcatcgcctcgagccacgcggccgtgagcctgcggttgcagcaccgcggccgccggcggccaggccgcttcgtgcgcctggtggcagccgtcgtggccgccttcgcgctctgctgggggccctaccacgtgttcagcctgctggaggcgcgggcgcacgcaaacccggggctgcggccgctcgtgtggcgcgggctgcccttcgtcaccagcctggccttcttcaacagcgtggccaacccggtgctctacgtgctcacctgccccgacatgctgcgcaagctgcggcgctcgctgcgcacggtgctggagagcgtgctggtggacgacagcgagctgggtggcgcgggaagcagccgccgccgccgcacctcctccaccgcccgctcggcctcccctttagctctctgcagccgcccggaggaaccgcggggccccgcgcgtctcctcggctggctgctgggcagctgcgcagcgtccccgcagacgggccccctgaaccgggcgctgagcagcacctcgagttag

SEQ ID NO: 1024 - DNA, 1119 bp, Homo sapiens
atggcctgcaacagcacgtcccttgaggcttacacatacctgctgctgaacaccagcaacgcctcagactcggggtccacccagttgcccgcacccctcaggatctccttggccatagtgatgctgctgatgaccgtggtggggttcctgggcaacactgtggtctgcatcatcgtgtaccagaggccggctatgcgctcggccatcaacctgctgctggccaccctggccttctccgacatcatgctgtccctctgctgcatgcccttcaccgccgtcaccctcatcaccgtgcgctggcactttggggaccacttctgccgcctctcagccacgctctactggttttttgtcctggagggcgtggccatcctgctcatcatcagcgtggaccgcttcctcatcatcgtccagcgccaggacaagctgaacccgcgcagggccaaggtgatcatcgcggtctcctgggtgctgtccttctgcatcgcggggccctcgctcacgggctggacgctggtggaggtgccggcgcgggccccacagtgcgtgctgggctacacggagctccccgctgaccgcgcatacgtggtcaccttggtggtggccgtgttcttcgcgccctttggcgtcatgctgtgcgcctacatgtgcatcctcaacacggtccgcaagaacgccgtgcgcgtgcacaaccagtcggacagcctggacctgcggcagctcaccagggcgggcctgcggcgcctgcagcggcagcaacaggtcagcgtggacttgagcttcaagaccaaggccttcaccaccatcctgatcctcttcgtgggcttctccctctgctggctgccccactccgtctacagcctcctgtctgtgtttagccagcgcttttactgcggttcctccttctacgccaccagcacctgcgtcctgtggttcagttacctcaagtccgtcttcaaccccatcgtctactgctggagaatcaaaaaattccgcgaggcctgcatagagttgctgccccagaccttccaaatcctccccaaagtgcctgagcggatccgaaggagaatccagccaagcacagtatacgtgtgcaatgaaaaccagtctgcggtttag

SEQ ID NO: 1025 - DNA, 2724 bp, Homo sapiens
atggacacctcccggctcggtgtgctcctgtccttgcctgtgctgctgcagctggcgaccgggggcagctctcccaggtctggtgtgttgctgaggggctgccccacacactgtcattgcgagcccgacggcaggatgttgctcagggtggactgctccgacctggggctctcggagctgccttccaacctcagcgtcttcacctcctacctagacctcagtatgaacaacatcagtcagctgctcccgaatcccctgcccagtctccgcttcctggaggagttacgtcttgcgggaaacgctctgacatacattcccaagggagcattcactggcctttacagtcttaaagttcttatgctgcagaataatcagctaagacacgtacccacagaagctctgcagaatttgcgaagccttcaatccctgcgtctggatgctaaccacatcagctatgtgcccccaagctgtttcagtggcctgcattccctgaggcacctgtggctggatgacaatgcgttaacagaaatccccgtccaggcttttagaagtttatcggcattgcaagccatgaccttggccctgaacaaaatacaccacataccagactatgcctttggaaacctctccagcttggtagttctacatctccataacaatagaatccactccctgggaaagaaatgctttgatgggctccacagcctagagactttagatttaaattacaataaccttgatgaattccccactgcaattaggacactctccaaccttaaagaactaggatttcatagcaacaatatcaggtcgatacctgagaaagcatttgtaggcaacccttctcttattacaatacatttctatgacaatcccatccaatttgttgggagatctgcttttcaacatttacctgaactaagaacactgactctgaatggtgcctcacaaataactgaatttcctgatttaactggaactgcaaacctggagagtctgactttaactggagcacagatctcatctcttcctcaaaccgtctgcaatcagttacctaatctccaagtgctagatctgtcttacaacctattagaagatttacccagtttttcagtctgccaaaagcttcagaaaattgacctaagacataatgaaatctacgaaattaaagttgacactttccagcagttgcttagcctccgatcgctgaatttggcttggaacaaaattgctattattcaccccaatgcattttccactttgccatccctaataaagctggacctatcgtccaacctcctgtcgtcttttcctataactgggttacatggtttaactcacttaaaattaacaggaaatcatgccttacagagcttgatatcatctgaaaactttccagaactcaaggttatagaaatgccttatgcttaccagtgctgtgcatttggagtgtgtgagaatgcctataagatttctaatcaatggaataaaggtgacaacagcagtatggacgaccttcataagaaagatgctggaatgtttcaggctcaagatgaacgtgaccttgaagatttcctgcttgactttgaggaagacctgaaagcccttcattcagtgcagtgttcaccttccccaggccccttcaaaccctgtgaacacctgcttgatggctggctgatcagaattggagtgtggaccatagcagttctggcacttacttgtaatgctttggtgacttcaacagttttcagatcccctctgtacatttcccccattaaactgttaattggggtcatcgcagcagtgaacatgctcacgggagtctccagtgccgtgctggctggtgtggatgcgttcacttttggcagctttgcacgacatggtgcctggtgggagaatggggttggttgccatgtcattggttttttgtccatttttgcttcagaatcatctgttttcctgcttactctggcagccctggagcgtgggttctctgtgaaatattctgcaaaatttgaaacgaaagctccattttctagcctgaaagtaatcattttgctctgtgccctgctggccttgaccatggccgcagttcccctgctgggtggcagcaagtatggcgcctcccctctctgcctgcctttgccttttggggagcccagcaccatgggctacatggtcgctctcatcttgctcaattccctttgcttcctcatgatgaccattgcctacaccaagctctactgcaatttggacaagggagacctggagaatatttgggactgctctatggtaaaacacattgccctgttgctcttcaccaactgcatcctaaactgccctgtggctttcttgtccttctcctctttaataaaccttacatttatcagtcctgaagtaattaagtttatccttctggtggtagtcccacttcctgcatgtctcaatccccttctctacatcttgttcaatcctcactttaaggaggatctggtgagcctgagaaagcaaacctacgtctggacaagatcaaaacacccaagcttgatgtcaattaactctgatgatgtcgaaaaacagtcctgtgactcaactcaagccttggtaacctttaccagctccagcatcacttatgacctgcctcccagttccgtgccatcaccagcttatccagtgactgagagctgccatctttcctctgtggcatttgtcccatgtctctaa

SEQ ID NO: 1026 - DNA, 1842 bp, Homo sapiens
atggggcccaccctagcggttcccaccccctatggctgtattggctgtaagctaccccagccagaatacccaccggctctaatcatctttatgttctgcgcgatggttatcaccatcgttgtagacctaatcggcaactccatggtcattttggctgtgacgaagaacaagaagctccggaattctggcaacatcttcgtggtcagtctctctgtggccgatatgctggtggccatctacccataccctttgatgctgcatgccatgtccattgggggctgggatctgagccagttacagtgccagatggtcgggttcatcacagggctgagtgtggtcggctccatcttcaacatcgtggcaatcgctatcaaccgttactgctacatctgccacagcctccagtacgaacggatcttcagtgtgcgcaatacctgcatctacctggtcatcacctggatcatgaccgtcctggctgtcctgcccaacatgtacattggcaccatcgagtacgatcctcgcacctacacctgcatcttcaactatctgaacaaccctgtcttcactgttaccatcgtctgcatccacttcgtcctccctctcctcatcgtgggtttctgctacgtgaggatctggaccaaagtgctggcggcccgtgaccctgcagggcagaatcctgacaaccaacttgctgaggttcgcaattttctaaccatgtttgtgatcttcctcctctttgcagtgtgctggtgccctatcaacgtgctcactgtcttggtggctgtcagtccgaaggagatggcaggcaagatccccaactggctttatcttgcagcctacttcatagcctacttcaacagctgcctcaacgctgtgatctacgggctcctcaatgagaatttccgaagagaatactggaccatcttccatgctatgcggcaccctatcatattcttccctggcctcatcagtgatattcgtgagatgcaggaggcccgtaccctggcccgcgcccgtgcccatgctcgcgaccaagctcgtgaacaagaccgtgcccatgcctgtcctgctgtggaggaaaccccgatgaatgtccggaatgttccattacctggtgatgctgcagctggccaccccgaccgtgcctctggccaccctaagccccattccagatcctcctctgcctatcgcaaatctgcctctacccaccacaagtctgtctttagccactccaaggctgcctctggtcacctcaagcctgtctctggccactccaagcctgcctctggtcaccccaagtctgccactgtctaccctaagcctgcctctgtccatttcaagggtgactctgtccatttcaagggtgactctgtccatttcaagcctgactctgttcatttcaagcctgcttccagcaaccccaagcccatcactggccaccatgtctctgctggcagccactccaagtctgccttcagtgctgccaccagccaccctaaacccatcaagccagctaccagccatgctgagcccaccactgctgactatcccaagcctgccactaccagccaccctaagcccgctgctgctgacaaccctgagctctctgcctcccattgccccgagatccctgccattgcccaccctgtgtctgacgacagtgacctccctgagtcggcctctagccctgccgctgggcccaccaagcctgctgccagccagctggagtctgacaccatcgctgaccttcctgaccctactgtagtcactaccagtaccaatgattaccatgatgtcgtggttgttgatgttgaagatgatcctgatgaaatggctgtgtga

SEQ ID NO: 1027 - DNA, 1197 bp, Homo sapiens
atgcacaccgtggctacgtccggacccaacgcgtcctggggggcaccggccaacgcctccggctgcccgggctgtggcgccaacgcctcggacggcccagtcccttcgccgcgggccgtggacgcctggctcgtgccgctcttcttcgcggcgctgatgctgctgggcctggtggggaactcgctggtcatctacgtcatctgccgccacaagccgatgcggaccgtgaccaacttctacatcgccaacctggcggccacggacgtgaccttcctcctgtgctgcgtccccttcacggccctgctgtacccgctgcccggctgggtgctgggcgacttcatgtgcaagttcgtcaactacatccagcaggtctcggtgcaggccacgtgtgccactctgaccgccatgagtgtggaccgctggtacgtgacggtgttcccgttgcgcgccctgcaccgccgcacgccccgcctggcgctggctgtcagcctcagcatctgggtaggctctgcggcggtgtctgcgccggtgctcgccctgcaccgcctgtcacccgggccgcgcgcctactgcagtgaggccttccccagccgcgccctggagcgcgccttcgcactgtacaacctgctggcgctgtacctgctgccgctgctcgccacctgcgcctgctatgcggccatgctgcgccacctgggccgggtcgccgtgcgccccgcgcccgccgatagcgccctgcaggggcaggtgctggcagagcgcgcaggcgccgtgcgggccaaggtctcgcggctggtggcggccgtggtcctgctcttcgccgcctgctggggccccatccagctgttcctggtgctgcaggcgctgggccccgcgggctcctggcacccacgcagctacgccgcctacgcgcttaagacctgggctcactgcatgtcctacagcaactccgcgctgaacccgctgctctacgccttcctgggctcgcacttccgacaggccttccgccgcgtctgcccctgcgcgccgcgccgcccccgccgcccccgccggcccggaccctcggaccccgcagccccacacgcggagctgcaccgcctggggtcccacccggcccccgccagggcgcagaagccagggagcagtgggctggccgcgcgcgggctgtgcgtcctgggggaggacaacgcccctctctga

SEQ ID NO: 1028 - DNA, 960 bp, Homo sapiens
atgagtcagcaaaacaccagtggggactgcctgtttgacggtgtcaacgagctgatgaaaaccctacagtttgcagtccacatccccaccttcgtcctgggcctgctcctcaacctgctggccatccatggcttcagcaccttccttaagaacaggtggcccgattatgctgccacctccatctacatgatcaacctggcagtctttgacctgctgctggtgctctccctcccattcaagatggtcctgtcccaggtacagtcccccttcccgtccctgtgcaccctggtggagtgcctttacttcgtcagcatgtacggaagcgtcttcaccatctgcttcatcagcatggaccggttcttggccatccgttacccgctactggtgagccactccggtcccccaggaagatctttgggatctgcatgcacaatctgggtcctggtgtggaccggaagcatccctatctacagtttccatgggaaagtggaaaaatacatgtgcttccacaacatgtctgatgatacctggagcgccaaggtcttcttcccgctggaggtgtttggcttcctccttcccatgggcatcatgggcttctgctgctccaggagcatccacatcctgctgggccgccgagaccacacccaggactgggtgcagcagaaagcctgcatctacagcatcgcagccagcctggctgtattcgtggtctccttcctcccagtccacctggggttcttcctgcagttcctggtgagaaacagctttatcgtagagtgcagagccaagcagagcatcagcttcttcttgcaattgtccatgtgtttctccaatgtcaactgctgcctggatgttttctgctactactttgtcatcaaagaattccgcatgaacatcagggcccaccggccttccagggtccagctggtcctgcaggacaccacgatctcccggggctaa

SEQ ID NO: 1029 - DNA, 2064 bp, Homo sapiens
atgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaaggaggccctcggctgcccccgccagccagcagttgcagagcctggagtcgaaactgacctctgtgagattcatgggggacatggtgtccttcgaggaggaccggatcaacgccacggtgtggaagctccagcccacagccggcctccaggacctgcacatccactcccggcaggaggaggagcagagcgagatcatggagtactcggtgctgctgcctcgaacactcttccagaggacgaaaggccggaggggggaggctgagaagagactcctcctggtggacttcagcagccaagccctgttccaggacaagaattccagccacgtcctgggtgagaaggtcttggggattgtggtacagaacaccaaagtagccaacctcacggagcccgtggtgctcaccttccagcaccagctacagccgaagaatgtgactctgcaatgtgtgttctgggttgaagaccccacattgagcagcccggggcattggagcagtgctgggtgtgagaccgtcaggagagaaacccaaacatcctgcttctgcaaccacttgacctactttgcagtgctgatggtctcctcggtggaggtggacgccgtgcacaagcactacctgagcctcctctcctacgtgggctgtgtcgtctctgccctggcctgccttgtcaccattgccgcctacctctgctccaggaggaaacctcgggactacaccatcaaggtgcacatgaacctgctgctggccgtcttcctgctggacacgagcttcctgctcagcgagccggtggccctgacaggctctgaggctggctgccgagccagtgccatcttcctgcacttctccctgctcacctgcctttcctggatgggcctcgaggggtacaacctctaccgactcgtggtggaggtctttggcacctatgtccctggctacctactcaagctgagcgccatgggctggggcttccccatctttctggtgacgctggtggccctggtggatgtggacaactatggccccatcatcttggctgtgcataggactccagagggcgtcatctacccttccatgtgctggatccgggactccctggtcagctacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgatcttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagacagcgccaggctccccatcagctcgggcagcacctcgtccagccgcatctag

SEQ ID NO: 1030 - DNA, 1032 bp, Homo sapiens
atggatctaacttatattcccgaagacctatccagttgtccaaaatttgtaaataagatcctgtcctcccaccaaccgctcttttcatgtccaggtgataatgtattcggttatgactggagccatgattatccactattcggaaacttggttataatggtttccatatcgcatttcaaacagcttcactctcccacaaactttctgatcctctccatggcaaccacggactttctgctgggttttgtcattatgccatacagcataatgcgatcagtggagagttgctggtactttggggatggcttttgtaaattccacacaagctttgacatgatgctcagactgacctccattttccacctctgttccattgctattgaccgattttatgccgtgtgttaccctttacattacacaaccaaaatgacgaactccaccataaagcaactgctggcattttgctggtcagttcctgctcttttttcttttggtttagttctatctgaggccgatgtttccggtatgcagagctataagatacttgttgcttgcttcaatttctgtgcccttactttcaacaaattctgggggacaatattgttcactacatgtttctttacccctggctccatcatggttggtatttatggcaaaatctttatcgtttccaaacagcatgctcgagtcatcagccatgtgcctgaaaacacaaagggggcagtgaaaaaacacctatccaagaaaaaggacaggaaagcagcgaagacactgggtatagtaatgggggtgtttctggcttgctggttgccttgttttcttgctgttctgattgacccatacctagactactccactcccatactaatattggatcttttagtgtggctccggtacttcaactctacttgcaaccctcttattcatggcttttttaatccatggtttcagaaagcattcaagtacatagtgtcaggaaaaatatttagctcccattcagaaactgcaaatttgtttcctgaagcacattaa

SEQ ID NO: 1031 - DNA, 1089 bp, Homo sapiens
atgaacgcgagcgccgcctcgctcaacgactcccaggtggtggtagtggcggccgaaggagcggcggcggcggccacagcagcaggggggccggacacgggcgaatggggaccccctgctgcggcggctctaggagccggcggcggagctaatgggtctctggagctgtcctcgcagctgtcggctgggccaccgggactcctgctgccagcggtgaatccgtgggacgtgctcctgtgcgtgtcggggacagtgatcgctggagaaaacgcgctggtggtggcgctcatcgcgtccactccggcgctgcgcacgcccatgttcgtgctggtaggcagcctggccaccgctgacctgttggcgggctgtggcctcatcttgcactttgtgttccagtacttggtgccctcggagactgtgagtctgctcacggtgggcttcctcgtggcctccttcgccgcctctgtcagcagcctgctggccattacggtggaccgctacctgtccctgtataacgcgctcacctattactcgcgccggaccctgttgggcgtgcacctcctgcttgccgccacttggaccgtgtccctaggcctggggctgctgcccgtgctgggctggaactgcctggcagagcgcgccgcctgcagcgtggtgcgcccgctggcgcgcagccacgtggctctgctctccgccgccttcttcatggtcttcggcatcatgctgcacctgtacgtgcgcatctgccaggtggtctggcgccacgcgcaccagatcgcgctgcagcagcactgcctggcgccaccccatctcgctgccaccagaaagggtgtgggtacactggctgtggtgctgggcactttcggcgccagctggctgcccttcgccatctattgcgtggtgggcagccatgaggacccggcggtctacacttacgccaccctgctgcccgccacctacaactccatgatcaatcccatcatctatgccttccgcaaccaggagatccagcgcgccctgtggctcctgctctgtggctgtttccagtccaaagtgccctttcgttccaggtctcccagcgaggtctga

SEQ ID NO: 1032 - DNA, 2489 bp, Homo sapiens
  misc_feature (2008)..(2008): n is a, c, g, or t
  misc_feature (2086)..(2086): n is a, c, g, or t
  misc_feature (2179)..(2179): n is a, c, g, or t
  misc_feature (2189)..(2190): n is a, c, g, or t
tcagcagccttggagaagcatcagctgagaggagctatcacatgggagccgggactgctcagcaaagatggatttatgaggaaactgaaattcagaagattcacagagttagtaatacccagaactgggactacaaactaaattttgtgctccttctactccccagcagctcttgccattctgaggagacaagaaatcaggaaatttacataaggaaccctaaaactgaggcactatcccagagatcagcagggtcgctggactaggatgggggatgggcctgtgacaggaggtaccctgggtgccctctttcggccccatggagtcctcacccatcccccagtcatcagggaactcttccactttggggagggtccctcaaaccccaggtccctctactgccagtggggtcccggaggtggggctacgggatgttgcttcggaatctgtggccctcttcttcatgctcctgctggacttgactgctgtggctggcaatgccgctgtgatggccgtgatcgccaagacgcctgccctccgaaaatttgtcttcgtcttccacctctgcctggtggacctgctggctgccccgaccctcatgcccctggccatgctctccagctctgccctctttgaccacgccctctttggggagatggcctgccgcctctacttgtttctgagcgtgtgctttgtcagcctggccatcctctcggtgtcagccatcaatgtggagcgctactattacgtagtccaccccatgcgctacgaggtgcgcatgacgctggggctggtggcctctgtgctggtgggtgtgtgggtgaaggccttggccatggcttctgtgccagtgttgggaagggtctcctgggaggaaggagctcccagtgtccccccaggctgttcactccagtggagccacagtgcctactgccagctttttgtggtggtctttgctgtcctttactttctgttgcccctgctcctcatacttgtggtctactgcagcatgttccgagtggcccgcgtggctgccatgcagcacgggccgctgcccacgtggatggagacaccccggcaacgctccgaatctctcagcagccgctccacgatggtcaccagctcgggggccccccagaccaccccacaccggacgtttgggggagggaaagcagcggtggttctcctggctgtggggggacagttcctgctctgttggttgccctacttctctttccacctctatgttgccctgagtgctcagcccatttcaactgggcaggtggagagtgtggtcacctggattggctacttttgcttcacttccaaccctttcttctatggatgtctcaaccggcagatccggggggagctcagcaagcagtttgtctgcttcttcaagccagctccagaggaggagctgaggctgcctagccgggagggctccattgaggagaacttcctgcagttccttcaggggactggctgtccttctgagtcctgggtttcccgacccctacccagccccaagcaggagccacctgctgttgacttccgaatcccaggccagatagctgaggagacctctgagttcctggagcagcaactcaccagcgacatcatcatgtcagacagctacctccgtcctgccgcctcaccccggctggagtcatgatgggccgctggacactcggagggatatggggctggggccagttatgattgcaaggaccaccttgtgggatcaccttttcccagctggctagggctgaggctggggtctctgcacacagcttttgcttagtgtttcctgggtcaggaacagagccaacaggatgaacgtgtgcaaaagccttggacttggctgtgatctttgactgctaggggagggaacctgggtatggtgagacggtgacgagagaaaagggtcacaaaggactggcctccctgatctctctcctcatggcagcgacccacctccagtcccctggacaatcgggtacaaganacttaatgttgggcatgggaagggtggggtttccatgatccattaaatgccttcctactcccattcatcgctctcaanattagcttcagtgacaaagacttaaatctctctcctatctgcagcactgggttggagagagggcacgggagttggtcttggctgttcattgantgagactgtnngaactgtgttggttggtattggtggtggtattttcaacacacagggaataactgcaaactggacaggacacccatctgggaccacctgtccatcctacttccctcaattgaatcaggtaacactaacggatcacggcagggccagagggtggtgtggtctctatttgaacaaattcctggctcactgagcatcaaaaggggaaatgggctggtgggagtgggatagtctcccatttaagcagctaataaataatttttatgataaaaggccaaaaaaaaaaaaaaaaaaaaaaaaaaaa

SEQ ID NO: 1033 - DNA, 1260 bp, Homo sapiens
atggtcttctcggcagtgttgactgcgttccataccgggacatccaacacaacatttgtcgtgtatgaaaacacctacatgaatattacactccctccaccattccagcatcctgacctcagtccattgcttagatatagttttgaaaccatggctcccactggtttgagttccttgaccgtgaatagtacagctgtgcccacaacaccagcagcatttaagagcctaaacttgcctcttcagatcaccctttctgctataatgatattcattctgtttgtgtcttttcttgggaacttggttgtttgcctcatggtttaccaaaaagctgccatgaggtctgcaattaacatcctccttgccagcctagcttttgcagacatgttgcttgcagtgctgaacatgccctttgccctggtaactattcttactacccgatggatttttgggaaattcttctgtagggtatctgctatgtttttctggttatttgtgatagaaggagtagccatcctgctcatcattagcatagataggttccttattatagtccagaggcaggataagctaaacccatatagagctaaggttctgattgcagtttcttgggcaacttccttttgtgtagcttttcctttagccgtaggaaaccccgacctgcagataccttcccgagctccccagtgtgtgtttgggtacacaaccaatccaggctaccaggcttatgtgattttgatttctctcatttctttcttcatacccttcctggtaatactgtactcatttatgggcatactcaacacccttcggcacaatgccttgaggatccatagctaccctgaaggtatatgcctcagccaggccagcaaactgggtctcatgagtctgcagagacctttccagatgagcattgacatgggctttaaaacacgtgccttcaccactattttgattctctttgctgtcttcattgtctgctgggccccattcaccacttacagccttgtggcaacattcagtaagcacttttactatcagcacaacttttttgagattagcacctggctactgtggctctgctacctcaagtctgcattgaatccgctgatctactactggaggattaagaaattccatgatgcttgcctggacatgatgcctaagtccttcaagtttttgccgcagctccctggtcacacaaagcgacggatacgtcctagtgctgtctatgtgtgtggggaacatcggacggtggtgtga

SEQ ID NO: 1034 - DNA, 1014 bp, Homo sapiens
atgaacagcacatgtattgaagaacagcatgacctggatcactatttgtttcccattgtttacatctttgtgattatagtcagcattccagccaatattggatctctgtgtgtgtctttcctgcaacccaagaaggaaagtgaactaggaatttacctcttcagtttgtcactatcagatttactctatgcattaactctccctttatggattgattatacttggaataaagacaactggactttctctcctgccttgtgcaaagggagtgcttttctcatgtacatgaagttttacagcagcacagcattcctcacctgcattgccgttgatcggtatttggctgttgtctaccctttgaagttttttttcctaaggacaagaagaattgcactcatggtcagcctgtccatctggatattggaaaccatcttcaatgctgtcatgttgtgggaagatgaaacagttgttgaatattgcgatgccgaaaagtctaattttactttatgctatgacaaataccctttagagaaatggcaaatcaacctcaacttgttcaggacgtgtacaggctatgcaatacctttggtcaccatcctgatctgtaaccggaaagtctaccaagctgtgcggcacaataaagccacggaaaacaaggaaaagaagagaatcataaaactacttgtcagcatcacagttacttttgtcttatgctttactccctttcatgtgatgttgctgattcgctgcattttagagcatgctgtgaacttcgaagaccacagcaattctgggaagcgaacttacacaatgtatagaatcacggttgcattaacaagtttaaattgtgttgctgatccaattctgtactgttttgttaccgaaacaggaagatatgatatgtggaatatattaaaattctgcactgggaggtgtaatacatcacaaagacaaagaaaacgcatactttctgtgtctacaaaagatactatggaattagaggtccttgagtag

SEQ ID NO: 1035 - DNA, 1212 bp, Homo sapiens
atggcttgcaatggcagtgcggccagggggcactttgaccctgaggacttgaacctgactgacgaggcactgagactcaagtacctggggccccagcagacagagctgttcatgcccatctgtgccacatacctgctgatcttcgtggtgggcgctgtgggcaatgggctgacctgtctggtcatcctgcgccacaaggccatgcgcacgcctaccaactactacctcttcagcctggccgtgtcggacctgctggtgctgctggtgggcctgcccctggagctctatgagatgtggcacaactaccccttcctgctgggcgttggtggctgctatttccgcacgctactgtttgagatggtctgcctggcctcagtgctcaacgtcactgccctgagcgtggaacgctatgtggccgtggtgcacccactccaggccaggtccatggtgacgcgggcccatgtgcgccgagtgcttggggccgtctggggtcttgccatgctctgctccctgcccaacaccagcctgcacggcatccggcagctgcacgtgccctgccggggcccagtgccagactcagctgtttgcatgctggtccgcccacgggccctctacaacatggtagtgcagaccaccgcgctgctcttcttctgcctgcccatggccatcatgagcgtgctctacctgctcattgggctgcgactgcggcgggagaggctgctgctcatgcaggaggccaagggcaggggctctgcagcagccaggtccagatacacctgcaggctccagcagcacgatcggggccggagacaagtgaccaagatgctgtttgtcctggtcgtggtgtttggcatctgctgggccccgttccacgccgaccgcgtcatgtggagcgtcgtgtcacagtggacagatggcctgcacctggccttccagcacgtgcacgtcatctccggcatcttcttctacctgggctcggcggccaaccccgtgctctatagcctcatgtccagccgcttccgagagaccttccaggaggccctgtgcctcggggcctgctgccatcgcctcagaccccgccacagctcccacagcctcagcaggatgaccacaggcagcaccctgtgtgatgtgggctccctgggcagctgggtccaccccctggctgggaacgatggcccagaggcgcagcaagagaccgatccatcctga

SEQ ID NO: 1036 - DNA, 987 bp, Homo sapiens
atggacaacgcctcgttctcggagccctggcccgccaacgcatcgggcccggacccggcgctgagctgctccaacgcgtcgactctggcgccgctgccggcgccgctggcggtggctgtaccagttgtctacgcggtgatctgcgccgtgggtctggcgggcaactccgccgtgctgtacgtgttgctgcgggcgccccgcatgaagaccgtcaccaacctgttcatcctcaacctggccatcgccgacgagctcttcacgctggtgctgcccatcaacatcgccgacttcctgctgcggcagtggcccttcggggagctcatgtgcaagctcatcgtggctatcgaccagtacaacaccttctccagcctctacttcctcaccgtcatgagcgccgaccgctacctggtggtgttggccactgcggagtcgcgccgggtggccggccgcacctacagcgccgcgcgcgcggtgagcctggccgtgtgggggatcgtcacactcgtcgtgctgcccttcgcagtcttcgcccggctagacgacgagcagggccggcgccagtgcgtgctagtctttccgcagcccgaggccttctggtggcgcgcgagccgcctctacacgctcgtgctgggcttcgccatccccgtgtccaccatctgtgtcctctataccaccctgctgtgccggctgcatgccatgcggctggacagccacgccaaggccctggagcgcgccaagaagcgggtgaccttcctggtggtggcaatcctggcggtgtgcctcctctgctggacgccctaccacctgagcaccgtggtggcgctcaccaccgacctcccgcagacgccgctggtcatcgctatctcctacttcatcaccagcctgacgtacgccaacagctgcctcaaccccttcctctacgccttcctggacgccagcttccgcaggaacctccgccagctgataacttgccgcgcggcagcctga

SEQ ID NO: 1037 - DNA, 1179 bp, Homo sapiens
atggagaccaccatggggttcatggatgacaatgccaccaacacttccaccagcttcctttctgtgctcaaccctcatggagcccatgccacttccttcccattcaacttcagctacagcgactatgatatgcctttggatgaagatgaggatgtgaccaattccaggacgttctttgctgccaagattgtcattgggatggccctggtgggcatcatgctggtctgcggcattggaaacttcatctttatcgctgccctggtccgctacaagaaactgcgcaacctcaccaacctgctcatcgccaacctggccatctctgacttcctggtggccattgtctgctgcccctttgagatggactactatgtggtgcgccagctctcctgggagcacggccacgtcctgtgcacctctgtcaactacctgcgcactgtctctctctatgtctccaccaatgccctgctggccatcgccattgacaggtatctggctattgtccatccgctgagaccacggatgaagtgccaaacagccactggcctgattgccttggtgtggacggtgtccatcctgatcgccatcccttccgcctacttcaccaccgagacggtcctcgtcattgtcaagagccaggaaaagatcttctgcggccagatctggcctgtggaccagcagctctactacaagtcctacttcctctttatctttggcatagaattcgtgggccccgtggtcaccatgaccctgtgctatgccaggatctcccgggagctctggttcaaggcggtccctggattccagacagagcagatccgcaagaggctgcgctgccgcaggaagacggtcctggtgctcatgtgcatcctcaccgcctacgtgctatgctgggcgcccttctacggcttcaccatcgtgcgcgacttcttccccaccgtgtttgtgaaggagaagcactacctcactgccttctacatcgtcgagtgcatcgccatgagcaacagcatgatcaacactctgtgcttcgtgaccgtcaagaacgacaccgtcaagtacttcaaaaagatcatgttgctccactggaaggcttcttacaatggcggtaagtccagtgcagacctggacctcaagacaattgggatgcctgccaccgaagaggtggactgcatcagactaaaa

SEQ ID NO: 1038 - DNA, 1152 bp, Homo sapiens
atggcagcccagaatggaaacaccagtttcacacccaactttaatccaccccaagaccatgcctcctccctctcctttaacttcagttatggtgattatgacctccctatggatgaggatgaggacatgaccaagacccggaccttcttcgcagccaagatcgtcattggcattgcactggcaggcatcatgctggtctgcggcatcggtaactttgtctttatcgctgccctcacccgctataagaagttgcgcaacctcaccaatctgctcattgccaacctggccatctccgacttcctggtggccatcatctgctgccccttcgagatggactactacgtggtacggcagctctcctgggagcatggccacgtgctctgtgcctccgtcaactacctgcgcaccgtctccctctacgtctccaccaatgccttgctggccattgccattgacagatatctcgccatcgttcaccccttgaaaccacggatgaattatcaaacggcctccttcctgatcgccttggtctggatggtgtccattctcattgccatcccatcggcttactttgcaacagaaacggtcctctttattgtcaagagccaggagaagatcttctgtggccagatctggcctgtggatcagcagctctactacaagtcctacttcctcttcatctttggtgtcgagttcgtgggccctgtggtcaccatgaccctgtgctatgccaggatctcccgggagctctggttcaaggcagtccctgggttccagacggagcagattcgcaagcggctgcgctgccgcaggaagacggtcctggtgctcatgtgcattctcacggcctatgtgctgtgctgggcacccttctacggtttcaccatcgttcgtgacttcttccccactgtgttcgtgaaggaaaagcactacctcactgccttctacgtggtcgagtgcatcgccatgagcaacagcatgatcaacaccgtgtgcttcgtgacggtcaagaacaacaccatgaagtacttcaagaagatgatgctgctgcactggcgtccctcccagcgggggagcaagtccagtgctgaccttgacctcagaaccaacggggtgcccaccacagaagaggtggactgtatcaggctgaag

SEQ ID NO: 1039 - DNA, 1569 bp, Homo sapiens
atgaatagcttcttcggaaccccagcggccagctggtgcctcctggaaagtgacgtctcatctgcaccggacaaggaggcggggagggagcgcagagcactcagcgtccagcagcgcggcgggccagcctggagcggaagcctggagtggagcaggcagtccgcgggggacagacgtcggctgggattgagccggcagactgcgaaaagtagctggagccggagcagggacagaacctgttgctgcagacgggcttggtggattctggttcctgccgccgacagggctcgccgggagaggttcatcatgaatgagaaatgggacacaaactcttcagaaaactggcatcccatctggaatgtcaatgacacaaagcatcatctgtactcagatattaatattacctatgtgaactactatcttcaccagcctcaagtggcagcaatcttcattatttcctactttctgatcttctttttgtgcatgatgggaaatactgtggtttgctttattgtaatgaggaacaaacatatgcacacagtcactaatctcttcatcttaaacctggccataagtgatttactagttggcatattctgcatgcctataacactgctggacaatattatagcaggatggccatttggaaacacgatgtgcaagatcagtggattggtccagggaatatctgtcgcagcttcagtctttacgttagttgcaattgctgtagataggttccagtgtgtggtctacccttttaaaccaaagctcactatcaagacagcgtttgtcattattatgatcatctgggtcctagccatcaccattatgtctccatctgcagtaatgttacatgtgcaagaagaaaaatattaccgagtgagactcaactcccagaataaaaccagtccagtctactggtgccgggaagactggccaaatcaggaaatgaggaagatctacaccactgtgctgtttgccaacatctacctggctcccctctccctcattgtcatcatgtatggaaggattggaatttcactcttcagggctgcagttcctcacacaggcaggaagaaccaggagcagtggcacgtggtgtccaggaaaaagcagaagatcattaagatgctcctgattgtggccctgctttttattctctcatggctgcccctgtggactctaatgatgctctcagactacgctgacctttctccaaatgaactgcagatcatcaacatctacatctacccttttgcacactggctggcattcggcaacagcagtgtcaatcccatcatttatggtttcttcaacgagaatttccgccgtggtttccaagaagctttccagctccagctctgccaaaaaagagcaaagcctatggaagcttataccctaaaagctaaaagccatgtgctcataaacacatctaatcagcttgtccaggaatctacatttcaaaaccctcatggggaaaccttgctttataggaaaagtgctgaaaaaccccaacaggaattagtgatggaagaattaaaagaaactactaacagcagtgagatttaa

SEQ ID NO: 1040 - DNA, 1623 bp, Homo sapiens
atgaactcaacaggccaccttcaggatgcccccaatgccacctcgctccatgtgcctcactcacaggaaggaaacagcacctctctccaggagggtcttcaggatctcatccacacagccaccttggtgacctgtacttttctactggcggtcatcttctgcctgggttcctatggcaacttcattgtcttcttgtccttcttcgatccagccttcaggaaattcagaaccaactttgatttcatgatcctgaacctgtccttctgtgacctcttcatttgtggagtgacagcccccatgttcacctttgtgttattcttcagctcagccagtagtatcccggatgctttctgcttcactttccatctcaccagttcaggcttcatcatcatgtctctgaagacagtggcagtgatcgccctgcaccggctccggatggtgttggggaaacagcctaatcgcacggcctcctttccctgcaccgtactcctcaccctgcttctctgggccaccagtttcacccttgccaccttggctaccttgaaaaccagcaagtcccacctctgtcttcccatgtccagtctgattgctggaaaagggaaagccattttgtctctctatgtggtcgacttcaccttctgtgttgctgtggtctctgtctcttacatcatgattgctcagaccctgcggaagaacgctcaagtcagaaagtgcccccctgtaatcacagtcgatgcttccagaccacagcctttcatgggggtccctgtgcagggaggtggagatcccatccagtgtgccatgccggctctgtataggaaccagaattacaacaaactgcagcacgttcagacccgtggatataccaagagtcccaaccaactggtcacccctgcagcaagccgactccagctcgtatcagccatcaacctctccactgccaaggattccaaagccgtggtcacctgtgtgatcattgtgctgtcagtcctggtgtgctgtcttccactggggatttccttggtacaggtggttctctccagcaatgggagcttcattctttaccagtttgaattgtttggatttactcttatatttttcaagtcaggattaaacccttttatatattctcggaacagtgcagggctgagaaggaaagtgctctggtgcctccaatacataggcctgggttttttctgctgcaaacaaaagactcgacttcgagccatgggaaaagggaacctcgaagtcaacagaaacaaatcctcccatcatgaaacaaactctgcctacatgttatctccaaagccacagaagaaatttgtggaccaggcttgtggcccaagtcattcaaaagaaagtatggtgagtcccaagatctctgctggacatcaacactgtggtcagagcagctcgacccccatcaacactcggattgaaccttactacagcatctataacagcagcccttcccaggaggagagcagcccatgtaacttacagccagtaaactcttttggatttgccaattcatatattgccatgcattatcacaccactaatgacttagtgcaggaatatgacagcacttcagccaagcagattccagtcccctccgtttaa

SEQ ID NO: 1041 - DNA, 1014 bp, Homo sapiens
atggggaacgattctgtcagctacgagtatggggattacagcgacctctcggaccgccctgtggactgcctggatggcgcctgcctggccatcgacccgctgcgcgtggccccgctcccactgtatgccgccatcttcctggtgggggtgccgggcaatgccatggtggcctgggtggctgggaaggtggcccgccggagggtgggtgccacctggttgctccacctggccgtggcggatttgctgtgctgtttgtctctgcccatcctggcagtgcccattgcccgtggaggccactggccgtatggtgcagtgggctgtcgggcgctgccctccatcatcctgctgaccatgtatgccagcgtcctgctcctggcagctctcagtgccgacctctgcttcctggctctcgggcctgcctggtggtctacggttcagcgggcgtgcggggtgcaggtggcctgtggggcagcctggacactggccttgctgctcaccgtgccctccgccatctaccgccggctgcaccaggagcacttcccagcccggctgcagtgtgtggtggactacggcggctcctccagcaccgagaatgcggtgactgccatccggtttctttttggcttcctggggcccctggtggccgtggccagctgccacagtgccctcctgtgctgggcagcccgacgctgccggccgctgggcacagccattgtggtggggttttttgtctgctgggcaccctaccacctgctggggctggtgctcactgtggcggccccgaactccgcactcctggccagggccctgcgggctgaacccctcatcgtgggccttgccctcgctcacagctgcctcaatcccatgctcttcctgtattttgggagggctcaactccgccggtcactgccagctgcctgtcactgggccctgagggagtcccagggccaggacgaaagtgtggacagcaagaaatccaccagccatgacctggtctcggagatggaggtgtag

SEQ ID NO: 1042 - DNA, 1014 bp, Homo sapiens
atgaatgagccactagactatttagcaaatgcttctgatttccccgattatgcagctgcttttggaaattgcactgatgaaaacatcccactcaagatgcactacctccctgttatttatggcattatcttcctcgtgggatttccaggcaatgcagtagtgatatccacttacattttcaaaatgagaccttggaagagcagcaccatcattatgctgaacctggcctgcacagatctgctgtatctgaccagcctccccttcctgattcactactatgccagtggcgaaaactggatctttggagatttcatgtgtaagtttatccgcttcagcttccatttcaacctgtatagcagcatcctcttcctcacctgtttcagcatcttccgctactgtgtgatcattcacccaatgagctgcttttccattcacaaaactcgatgtgcagttgtagcctgtgctgtggtgtggatcatttcactggtagctgtcattccgatgaccttcttgatcacatcaaccaacaggaccaacagatcagcctgtctcgacctcaccagttcggatgaactcaatactattaagtggtacaacctgattttgactgcaactactttctgcctccccttggtgatagtgacactttgctataccacgattatccacactctgacccatggactgcaaactgacagctgccttaagcagaaagcacgaaggctaaccattctgctactccttgcattttacgtatgttttttacccttccatatcttgagggtcattcggatcgaatctcgcctgctttcaatcagttgttccattgagaatcagatccatgaagcttacatcgtttctagaccattagctgctctgaacacctttggtaacctgttactatatgtggtggtcagcgacaactttcagcaggctgtctgctcaacagtgagatgcaaagtaagcgggaaccttgagcaagcaaagaaaattagttactcaaacaacccttga

SEQ ID NO: 1043 - DNA, 1041 bp, Homo sapiens
atgtacaacgggtcgtgctgccgcatcgagggggacaccatctcccaggtgatgccgccgctgctcattgtggcctttgtgctgggcgcactaggcaatggggtcgccctgtgtggtttctgcttccacatgaagacctggaagcccagcactgtttaccttttcaatttggccgtggctgatttcctccttatgatctgcctgccttttcggacagactattacctcagacgtagacactgggcttttggggacattccctgccgagtggggctcttcacgttggccatgaacagggccgggagcatcgtgttccttacggtggtggctgcggacaggtatttcaaagtggtccacccccaccacgcggtgaacactatctccacccgggtggcggctggcatcgtctgcaccctgtgggccctggtcatcctgggaacagtgtatcttttgctggagaaccatctctgcgtgcaagagacggccgtctcctgtgagagcttcatcatggagtcggccaatggctggcatgacatcatgttccagctggagttctttatgcccctcggcatcatcttattttgctccttcaagattgtttggagcctgaggcggaggcagcagctggccagacaggctcggatgaagaaggcgacccggttcatcatggtggtggcaattgtgttcatcacatgctacctgcccagcgtgtctgctagactctatttcctctggacggtgccctcgagtgcctgcgatccctctgtccatggggccctgcacataaccctcagcttcacctacatgaacagcatgctggatcccctggtgtattatttttcaagcccctcctttcccaaattctacaacaagctcaaaatctgcagtctgaaacccaagcagccaggacactcaaaaacacaaaggccggaagagatgccaatttcgaacctcggtcgcaggagttgcatcagtgtggcaaatagtttccaaagccagtctgatgggcaatgggatccccacattgttgagtggcactga

SEQ ID NO: 1044 - DNA, 1277 bp, Homo sapiens
gcaaaatggtccctcacctcttgctgctctgtctcctccccttggtgcgagccaccgagccccacgagggccgggccgacgagcagagcgcggaggcggccctggccgtgcccaatgcctcgcacttcttctcttggaacaactacaccttctccgactggcagaactttgtgggcaggaggcgctacggcgctgagtcccagaaccccacggtgaaagccctgctcattgtggcttactccttcatcattgtcttctcactctttggcaacgtcctggtctgtcatgtcatcttcaagaaccagcgaatgcactcggccaccagcctcttcatcgtcaacctggcagttgccgacataatgatcacgctgctcaacacccccttcactttggttcgctttgtgaacagcacatggatatttgggaagggcatgtgccatgtcagccgctttgcccagtactgctcactgcacgtctcagcactgacactgacagccattgcggtggatcgccaccaggtcatcatgcaccccttgaaaccccggatctcaatcacaaagggtgtcatctacatcgctgtcatctggaccatggctacgttcttttcactcccacatgctatctgccagaaattatttaccttcaaatacagtgaggacattgtgcgctccctctgcctgccagacttccctgagccagctgacctcttctggaagtacctggacttggccaccttcatcctgctctacatcctgcccctcctcatcatctctgtggcctacgctcgtgtggccaagaaactgtggctgtgtaatatgattggcgatgtgaccacagagcagtactttgccctgcggcgcaaaaagaagaagaccatcaagatgttgatgctggtggtagtcctctttgccctctgctggttccccctcaactgctacgtcctcctcctgtccagcaaggtcatccgcaccaacaatgccctctactttgccttccactggtttgccatgagcagcacctgctataaccccttcatatactgctggctgaacgagaacttcaggattgagctaaaggcattactgagcatgtgtcaaagacctcccaagcctcaggaggacaggcaaccctccccagttccttccttcagggtggcctggacagagaagaatgatggccagagggctccccttgccaataacctcctgcccacctcccaactccagtctgggaagacagacctgtcatctgtggaacccattgtgacgatgagttag

SEQ ID NO: 1045 - DNA, 1191 bp, Homo sapiens
atgtggaacagctctgacgccaacttctcctgctaccatgagtctgtgctgggctatcgttatgttgcagttagctggggggtggtggtggctgtgacaggcaccgtgggcaatgtgctcaccctactggccttggccatccagcccaagctccgtacccgattcaacctgctcatagccaacctcacactggctgatctcctctactgcacgctccttcagcccttctctgtggacacctacctccacctgcactggcgcaccggtgccaccttctgcagggtatttgggctcctcctttttgcctccaattctgtctccatcctgaccctctgcctcatcgcactgggacgctacctcctcattgcccaccctaagctttttccccaagttttcagtgccaaggggatagtgctggcactggtgagcacctgggttgtgggcgtggccagctttgctcccctctggcctatttatatcctggtacctgtagtctgcacctgcagctttgaccgcatccgaggccggccttacaccaccatcctcatgggcatctactttgtgcttgggctcagcagtgttggcatcttctattgcctcatccaccgccaggtcaaacgagcagcacaggcactggaccaatacaagttgcgacaggcaagcatccactccaaccatgtggccaggactgatgaggccatgcctggtcgtttccaggagctggacagcaggttagcatcaggaggacccagtgaggggatttcatctgagccagtcagtgctgccaccacccagaccctggaaggggactcatcagaagtgggagaccagatcaacagcaagagagctaagcagatggcagagaaaagccctccagaagcatctgccaaagcccagccaattaaaggagccagaagagctccggattcttcatcggaatttgggaaggtgactcgaatgtgttttgctgtgttcctctgctttgccctgagctacatccccttcttgctgctcaacattctggatgccagagtccaggctccccgggtggtccacatgcttgctgccaacctcacctggctcaatggttgcatcaaccctgtgctctatgcagccatgaaccgccaattccgccaagcatatggctccattttaaaaagagggccccggagtttccataggctccattag

SEQ ID NO: 1046 - DNA, 1113 bp, Homo sapiens
atggcgaactatagccatgcagctgacaacattttgcaaaatctctcgcctctaacagcctttctgaaactgacttccttgggtttcataataggagtcagcgtggtgggcaacctcctgatctccattttgctagtgaaagataagaccttgcatagagcaccttactacttcctgttggatctttgctgttcagatatcctcagatctgcaatttgtttcccatttgtgttcaactctgtcaaaaatggctctacctggacttatgggactctgacttgcaaagtgattgcctttctgggggttttgtcctgtttccacactgctttcatgctcttctgcatcagtgtcaccagatacttagctatcgcccatcaccgcttctatacaaagaggctgaccttttggacgtgtctggctgtgatctgtatggtgtggactctgtctgtggccatggcatttcccccggttttagacgtgggcacttactcattcattagggaggaagatcaatgcaccttccaacaccgctccttcagggctaatgattccttaggatttatgctgcttcttgctctcatcctcctagccacacagcttgtctacctcaagctgatatttttcgtccacgatcgaagaaaaatgaagccagtccagtttgtagcagcagtcagccagaactggacttttcatggtcctggagccagtggccaggcagctgccaattggctagcaggatttggaaggggtcccacaccacccaccttgctgggcatcaggcaaaatgcaaacaccacaggcagaagaaggctattggtcttagacgagttcaaaatggagaaaagaatcagcagaatgttctatataatgacttttctgtttctaaccttgtggggcccctacctggtggcctgttattggagagtttttgcaagagggcctgtagtaccagggggatttctaacagctgctgtctggatgagttttgcccaagcaggaatcaatccttttgtctgcattttctcaaacagggagctgaggcgctgtttcagcacaacccttctttactgcagaaaatccaggttaccaagggaaccttactgtgttatatga

SEQ ID NO: 1047 - DNA, 1002 bp, Homo sapiens
atgaacaccacagtgatgcaaggcttcaacagatctgagcggtgccccagagacactcggatagtacagctggtattcccagccctctacacagtggttttcttgaccggcatcctgctgaatactttggctctgtgggtgtttgttcacatccccagctcctccaccttcatcatctacctcaaaaacactttggtggccgacttgataatgacactcatgcttcctttcaaaatcctctctgactcacacctggcaccctggcagctcagagcttttgtgtgtcgtttttcttcggtgatattttatgagaccatgtatgtgggcatcgtgctgttagggctcatagcctttgacagattcctcaagatcatcagacctttgagaaatatttttctaaaaaaacctgtttttgcaaaaacggtctcaatcttcatctggttctttttgttcttcatctccctgccaaatatgatcttgagcaacaaggaagcaacaccatcgtctgtgaaaaagtgtgcttccttaaaggggcctctggggctgaaatggcatcaaatggtaaataacatatgccagtttattttctggactgtttttatcctaatgcttgtgttttatgtggttattgcaaaaaaagtatatgattcttatagaaagtccaaaagtaaggacagaaaaaacaacaaaaagctggaaggcaaagtatttgttgtcgtggctgtcttctttgtgtgttttgctccatttcattttgccagagttccatatactcacagtcaaaccaacaataagactgactgtagactgcaaaatcaactgtttattgctaaagaaacaactctctttttggcagcaactaacatttgtatggatcccttaatatacatattcttatgtaaaaaattcacagaaaagctaccatgtatgcaagggagaaagaccacagcatcaagccaagaaaatcatagcagtcagacagacaacataaccttaggctga

SEQ ID NO: 1048 - DNA, 1077 bp, Homo sapiens
atggggttcaacttgacgcttgcaaaattaccaaataacgagctgcacggccaagagagtcacaattcaggcaacaggagcgacgggccaggaaagaacaccacccttcacaatgaatttgacacaattgtcttgccggtgctttatctcattatatttgtggcaagcatcttgctgaatggtttagcagtgtggatcttcttccacattaggaataaaaccagcttcatattctatctcaaaaacatagtggttgcagacctcataatgacgctgacatttccatttcgaatagtccatgatgcaggatttggaccttggtacttcaagtttattctctgcagatacacttcagttttgttttatgcaaacatgtatacttccatcgtgttccttgggctgataagcattgatcgctatctgaaggtggtcaagccatttggggactctcggatgtacagcataaccttcacgaaggttttatctgtttgtgtttgggtgatcatggctgttttgtctttgccaaacatcatcctgacaaatggtcagccaacagaggacaatatccatgactgctcaaaacttaaaagtcctttgggggtcaaatggcatacggcagtcacctatgtgaacagctgcttgtttgtggccgtgctggtgattctgatcggatgttacatagccatatccaggtacatccacaaatccagcaggcaattcataagtcagtcaagccgaaagcgaaaacataaccagagcatcagggttgttgtggctgtgttttttacctgctttctaccatatcacttgtgcagaattccttttacttttagtcacttagacaggcttttagatgaatctgcacaaaaaatcctatattactgcaaagaaattacacttttcttgtctgcgtgtaatgtttgcctggatccaataatttactttttcatgtgtaggtcattttcaagaaggctgttcaaaaaatcaaatatcagaaccaggagtgaaagcatcagatcactgcaaagtgtgagaagatcggaagttcgcatatattatgattacactgatgtgtag

SEQ ID NO: 1049 - DNA, 1155 bp, Homo sapiens
atgaccaactcctcctccacatccacctcctccaccaccggtggctcgctgctgctgctctgcgaggaagaggagtcgtgggcgggccggcgcatcccggtgtcactcctgtattcgggcctggccatcgggggcacgctggccaacggcatggtcatctatctcgtgtcgtccttccgaaagctgcagaccaccagcaacgccttcattgtgaacggctgcgccgccgacctcagcgtctgcgccctctggatgccgcaggaggcggtgctcgggctcctgcccaccggctctgcggagccccccgcagactgggacggcgctgggggcagctaccgcctgctacggggtgggctgctgggcctcggactcacggtgtccctcctctcccactgcctcgtggccctgaaccgctacctgctcatcacccgggcgcccgccacctaccaggcgctgtaccagaggcgccacacggcgggcatgctggcgctgtcctgggcgctcgccctgggcctcgtgctgctgctcccgccctgggcaccgcggcccggcgccgcgccaccgcgaatccactacccggcgctgctggccgccgcggcgctgctggcgcagacagctctgctgctgcactgctacctgggcatcgtgcgccgcgtgcgtgtcagcgtcaagcgggtcagcgtgctcaacttccacctgctgcaccagttgcccggctgcgccgccgccgccgccgccttcccgggcgcccagcacgcgccgggccccggtggcgccgcgcacccggcgcaggcccagcccctgccgcccgcgctgcacccgcggcgggcacagcggcgtctcagcggcctgtcggtgctgctgctctgctgcgtcttcctgctggccacgcagccactggtgtgggtgagcctggccagcggcttctcgctgccggtgccctggggagtgcacgcggccagctggctcctgtgctgcgccctgtccgcgctcaacccgctgctctacacgtggaggaacgaggagttccgccgctccgtgcgctcagtcctgccgggcgtcggcgacgcggcggccgctgccgttgccgccacagccgtgcccgcagtgtcccaggcgcaactgggcacccgcgccgcgggccagcactggtaa

SEQ ID NO: 1050 - DNA, 1670 bp, Homo sapiens
ccaaccacaagcaccaaagcagaggggcaggcagcacaccacccagcagccagagcaccagcccagccatggtccttgaggtgagtgaccaccaagtgctaaatgacgccgaggttgccgccctcctggagaacttcagctcttcctatgactatggagaaaacgagagtgactcgtgctgtacctccccgccctgcccacaggacttcagcctgaacttcgaccgggccttcctgccagccctctacagcctcctctttctgctggggctgctgggcaacggcgcggtggcagccgtgctgctgagccggcggacagccctgagcagcaccgacaccttcctgctccacctagctgtagcagacacgctgctggtgctgacactgccgctctgggcagtggacgctgccgtccagtgggtctttggctctggcctctgcaaagtggcaggtgccctcttcaacatcaacttctacgcaggagccctcctgctggcctgcatcagctttgaccgctacctgaacatagttcatgccacccagctctaccgccgggggcccccggcccgcgtgaccctcacctgcctggctgtctgggggctctgcctgcttttcgccctcccagacttcatcttcctgtcggcccaccacgacgagcgcctcaacgccacccactgccaatacaacttcccacaggtgggccgcacggctctgcgggtgctgcagctggtggctggctttctgctgcccctgctggtcatggcctactgctatgcccacatcctggccgtgctgctggtttccaggggccagcggcgcctgcgggccatgcggctggtggtggtggtcgtggtggcctttgccctctgctggaccccctatcacctggtggtgctggtggacatcctcatggacctgggcgctttggcccgcaactgtggccgagaaagcagggtagacgtggccaagtcggtcacctcaggcctgggctacatgcactgctgcctcaacccgctgctctatgcctttgtaggggtcaagttccgggagcggatgtggatgctgctcttgcgcctgggctgccccaaccagagagggctccagaggcagccatcgtcttcccgccgggattcatcctggtctgagacctcagaggcctcctactcgggcttgtgaggccggaatccgggctcccctttcgcccacagtctgacttccccgcattccaggctcctccctccctctgccggctctggctctccccaatatcctcgctcccgggactcactggcagccccagcaccaccaggtctcccgggaagccaccctcccagctctgaggactgcaccattgctgctccttagctgccaagccccatcctgccgcccgaggtggctgcctggagccccactgcccttctcatttggaaactaaaacttcatcttccccaagtgcggggagtacaaggcatggcgtagagggtgctgccccatgaagccacagcccaggcctccagctcagcagtgactgtggccatggtccccaagacctctatatttgctcttttatttttatgtctaaaatcctgcttaaaacttttcaataaacaagatcgtcaggaccaaaaaaaaaaaaaaaaaaaaaaaaaaaaaaaaaaaaaaaaaaaaaaa

SEQ ID NO: 1051 - DNA, 993 bp, Homo sapiens
atggcatggaatgcaacttgcaaaaactggctggcagcagaggctgccctggaaaagtactacctttccattttttatgggattgagttcgttgtgggagtccttggaaataccattgttgtttacggctacatcttctctctgaagaactggaacagcagtaatatttatctctttaacctctctgtctctgacttagcttttctgtgcaccctccccatgctgataaggagttatgccaatggaaactggatatatggagacgtgctctgcataagcaaccgatatgtgcttcatgccaacctctataccagcattctctttctcacttttatcagcatagatcgatacttgataattaagtatcctttccgagaacaccttctgcaaaagaaagagtttgctattttaatctccttggccatttgggttttagtaaccttagagttactacccatacttccccttataaatcctgttataactgacaatggcaccacctgtaatgattttgcaagttctggagaccccaactacaacctcatttacagcatgtgtctaacactgttggggttccttattcctctttttgtgatgtgtttcttttattacaagattgctctcttcctaaagcagaggaataggcaggttgctactgctctgccccttgaaaagcctctcaacttggtcatcatggcagtggtaatcttctctgtgctttttacaccctatcacgtcatgcggaatgtgaggatcgcttcacgcctggggagttggaagcagtatcagtgcactcaggtcgtcatcaactccttttacattgtgacacggcctttggcctttctgaacagtgtcatcaaccctgtcttctattttcttttgggagatcacttcagggacatgctgatgaatcaactgagacacaacttcaaatcccttacatcctttagcagatgggctcatgaactcctactttcattcagagaaaagtga

SEQ ID NO: 1052 - DNA, 1212 bp, Homo sapiens
atgttcgtggcatcagagagaaagatgagagctcaccaggtgctcaccttcctcctgctcttcgtgatcacctcggtggcctctgaaaacgccagcacatcccgaggctgtgggctggacctcctccctcagtacgtgtccctgtgcgacctggacgccatctggggcattgtggtggaggcggtggccggggcgggcgccctgatcacactgctcctgatgctcatcctcctggtgcggctgcccttcatcaaggagaaggagaagaagagccctgtgggcctccactttctgttcctcctggggaccctgggcctctttgggctgacgtttgccttcatcatccaggaggacgagaccatctgctctgtccgccgcttcctctggggcgtcctctttgcgctctgcttctcctgcctgctgagccaggcatggcgcgtgcggaggctggtgcggcatggcacgggccccgcgggctggcagctggtgggcctggcgctgtgcctgatgctggtgcaagtcatcatcgctgtggagtggctggtgctcaccgtgctgcgtgacacaaggccagcctgcgcctacgagcccatggactttgtgatggccctcatctacgacatggtactgcttgtggtcaccctggggctggccctcttcactctgtgcggcaagttcaagaggtggaagctgaacggggccttcctcctcatcacagccttcctctctgtgctcatctgggtggcctggatgaccatgtacctcttcggcaatgtcaagctgcagcagggggatgcctggaacgaccccaccttggccatcacgctggcggccagcggctgggtcttcgtcatcttccacgccatccctgagatccactgcacccttctgccagccctgcaggagaacacgcccaactacttcgacacgtcgcagcccaggatgcgggagacggccttcgaggaggacgtgcagctgccgcgggcctatatggagaacaaggccttctccatggatgaacacaatgcagctctccgaacagcaggatttcccaacggcagcttgggaaaaagacccagtggcagcttggggaaaagacccagcgctccgtttagaagcaacgtgtatcagccaactgagatggccgtcgtgctcaacggtgggaccatcccaactgctccgccaagtcacacaggaagacacctttggtga

SEQ ID NO: 1053 - DNA, 1326 bp, Homo sapiens
atggccatccacaaagccttggtgatgtgcctgggactgcctctcttcctgttcccaggggcctgggcccagggccatgtcccacccggctgcagccaaggcctcaaccccctgtactacaacctgtgtgaccgctctggggcgtggggcatcgtcctggaggccgtggctggggcgggcattgtcaccacgtttgtgctcaccatcatcctggtggccagcctcccctttgtgcaggacaccaagaaacggagcctgctggggacccaggtattcttccttctggggaccctgggcctcttctgcctcgtgtttgcctgtgtggtgaagcccgacttctccacctgtgcctctcggcgcttcctctttggggttctgttcgccatctgcttctcttgtctggcggctcacgtctttgccctcaacttcctggcccggaagaaccacgggccccggggctgggtgatcttcactgtggctctgctgctgaccctggtagaggtcatcatcaatacagagtggctgatcatcaccctggttcggggcagtggcgagggcggccctcagggcaacagcagcgcaggctgggccgtggcctccccctgtgccgtcgccaacatggactttgtcatggcactcatctacgtcatgctgctgctgctgggtgccttcctgggggcctggcccgccctgtgtggccgctacaagcgctggcgtaagcatggggtctttgtgctcctcaccacagccacctccgttgccatatgggtggtgtggatcgtcatgtatacttacggcaacaagcagcacaacagtcccacctgggatgaccccacgctggccatcgccctcgccgccaatgcctgggccttcgtcctcttctacgtcatccccgaggtctcccaggtgaccaagtccagcccagagcaaagctaccagggggacatgtaccccacccggggcgtgggctatgagaccatcctgaaagagcagaagggtcagagcatgttcgtggagaacaaggccttttccatggatgagccggttgcagctaagaggccggtgtcaccatacagcgggtacaatgggcagctgctgaccagtgtgtaccagcccactgagatggccctgatgcacaaagttccgtccgaaggagcttacgacatcatcctcccacgggccaccgccaacagccaggtgatgggcagtgccaactcgaccctgcgggctgaagacatgtactcggcccagagccaccaggcggccacaccgccgaaagacggcaagaactctcaggtctttagaaacccctacgtgtgggactga

SEQ ID NO: 1054 - DNA, 1038 bp, Homo sapiens
atgtacaaggactgcatcgagtccactggagactattttcttctctgtgacgccgaggggccatggggcatcattctggagtccctggccatacttggcatcgtggtcacaattctgctactcttagcatttctcttcctcatgcgaaagatccaagactgcagccagtggaatgtcctccccacccagctcctcttcctcctgagtgtcctggggctcttcggactcgcttttgccttcatcatcgagctcaatcaacaaactgcccccgtacgctactttctctttggggttctctttgctctctgtttctcatgcctcttagctcatgcctccaatctagtgaagctggttcggggttgtgtctccttctcctggacgacaattctgtgcattgctattggttgcagtctgttgcaaatcattattgccactgagtatgtgactctcatcatgaccagaggtatgatgtttgtgaatatgacaccctgccagctcaatgtggactttgttgtactcctggtctatgtcctcttcctgatggccctcacattcttcgtctccaaagccaccttctgtggcccgtgtgagaactggaagcagcatggaaggctcatctttatcactgtgctcttctccatcatcatctgggtggtgtggatctccatgctcctgagaggcaacccgcagttccagcgacagccccagtgggacgacccggtcgtctgcattgctctggtcaccaacgcatgggttttcctgctgctgtacatcgtccctgagctctgcattctctacagatcgtgtagacaggagtgccctttacaaggcaatgcctgccccgtcacagcctaccaacacagcttccaagtggagaaccaggagctctccagagcccgagacagtgatggagctgaggaggatgtagcattaacttcatatggtactcccattcagccgcagactgttgatcccacacaagagtgtttcatcccacaggctaaactaagcccccagcaagatgcaggaggagtataa

SEQ ID NO: 1055 - DNA, 2860 bp, Homo sapiens
actgagcaaatgagatagaaacatggcattcttaattatactaattacctgctttgtgattattcttgctacttcacagccttgccagacccctgatgactttgtggctgccacttctccgggacatatcataattggaggtttgtttgctattcatgaaaaaatgttgtcctcagaagactctcccagacgaccacaaatccaggagtgtgttggctttgaaatatcagtttttcttcaaactcttgccatgatacacagcattgagatgatcaacaattcaacactcttatctggagtcaaactggggtatgaaatctatgacacttgtacagaagtcacagtggcaatggcagccactctgaggtttctttctaaattcaactgctccagagaaactgtggagtttaagtgtgactattccagctacatgccaagagttaaggctgtcataggttctgggtactcagaaataactatggctgtctccaggatgttgaatttacagctcatgccacaggtgggttatgaatcaactgcagaaatcctgagtgacaaaattcgctttccttcatttttacggactgtgcccagtgacttccatcaaattaaagcaatggctcacctgattcagaaatctggttggaactggattggcatcataaccacagatgatgactatggacgattggctcttaacacttttataattcaggctgaagcaaataacgtgtgcatagccttcaaagaggttcttccagcctttctttcagataataccattgaagtcagaatcaatcggacactgaagaaaatcattttagaagcccaggttaatgtcattgtggtatttctgaggcaattccatgtttttgatctcttcaataaagccattgaaatgaatataaataagatgtggattgctagtgataattggtcaactgccaccaagattaccaccattcctaatgttaaaaagattggcaaagttgtagggtttgcctttagaagagggaatatatcctctttccattcctttcttcaaaatctgcacttgcttcccagtgacagtcacaaactcttacatgaatatgccatgcatttatctgcctgcgcatatgtcaaggacactgatttgagtcaatgcatattcaatcattctcaaaggactttggcctacaaggctaacaaggctatagaaaggaacttcgtcatgagaaatgacttcctctgggactatgctgagccaggactcattcatagtattcagcttgcagtgtttgcccttggttatgccattcgggatctgtgtcaagctcgtgactgtcagaaccccaacgcctttcaaccatgggagttacttggtgtgctaaaaaatgtgacattcactgatggatggaattcatttcattttgatgctcacggggatttaaatactggatatgatgttgtgctctggaaggagatcaatggacacatgactgtcactaagatggcagaatatgacctacagaatgatgtcttcatcatcccagatcaggaaacaaaaaatgagttcaggaatcttaagcaaattcaatctaaatgctccaaggaatgcagtcctgggcaaatgaagaaaactacaagaagtcaacacatctgttgctatgaatgtcagaactgtcctgaaaatcattacactaatcagacagatatgcctcactgccttttatgcaacaacaaaactcactgggcccctgttaggagcactatgtgctttgaaaaggaagtggaatatctcaactggaatgactccttggccatcctactcctgattctctccctactgggaatcatatttgttctggttgttggcataatatttacaagaaacctgaacacacctgttgtgaaatcatccgggggattaagagtctgctatgtgatccttctctgtcatttcctcaattttgccagcacgagctttttcattggagaaccacaagacttcacatgtaaaaccaggcagacaatgtttggagtgagctttactctttgcatctcctgcattttgacgaagtctctgaaaattttgctagccttcagctttgatcccaaattacagaaatttctgaagtgcctctatagaccgatccttattatcttcacttgcacgggcatccaggttgtcatttgcacactctggctaatctttgcagcacctactgtagaggtgaatgtctccttgcccagagtcatcatcctggagtgtgaggagggatccatacttgcatttggcaccatgctgggctacattgccatcctggccttcatttgcttcatatttgctttcaaaggcaaatatgagaattacaatgaagccaaattcattacatttggcatgctcatttacttcatagcttggatcacattcatccctatctatgctaccacatttggcaaatatgtaccagctgtggagattattgtcatattaatatctaactatggaatcctgtattgcacattcatccccaaatgctatgttattatttgtaagcaagagattaacacaaagtctgcctttctcaagatgatctacagttattcttcccatagtgtgagcagcattgccctgagtcctgcttcactggactccatgagcggcaatgtcacaatgaccaatcccagctctagtggcaagtctgcaacctggcagaaaagcaaagatcttcaggcacaagcatttgcacacatatgcagggaaaatgccacaagtgtatctaaaactttgcctcgaaaaagaatgtcaagtatatgaataagccttaggagatgccacattccagaataaaatgtttccagggtctttgcatct

SEQ ID NO: 1056 - DNA, 1767 bp, Homo sapiens
atggctcggggcggggcgggggcagaggaggcctccctgcgctccaacgcattgtcctggctggcctgtgggctcctggcgctgctggccaatgcctggatcatcctcagcatctcggccaagcagcagaagcacaagccactggagctgctgctctgcttcctagcgggcacacacatactcatggcagctgtgcccctcaccacctttgccgtggtgcagctgcgtcgtcaggcttcctccgactatgactggaacgagagtatctgcaaggtcttcgtgtccacctactacaccctggcgctggccacctgcttcacggtcgcctccctctcctaccatcgcatgtggatggtgcgctggcccgtcaactaccgcctcagcaacgccaagaagcaggcactgcatgccgtcatgggcatctggatggtcagcttcatcctctccacactgccctccattggctggcacaacaacggcgagcgctactatgcccgcggctgccagttcatagtctccaagatcggcctcggctttggcgtttgcttcagcctcttgctacttgggggaattgtcatgggtctggtctgtgtggccatcaccttctaccagacactgtgggcccggccccggagggctcggcaggcccggagagtggggggtggtggggggaccaaagcgggtgggccaggggccttgggtacccggccagcttttgaggtaccagccattgtggtggaggatgcccgagggaagcggcggtcctcgctggatggctcggagtctgccaagacatccctgcaggtcaccaacttggtcagcgccatcgtctttctctatgactcactcacaggggtgcccatcttggtggtgagcttcttctccctcaagtcggactcggcgcccccctggatggtgctggctgtgctgtggtgctccatggcacagacgctgctgctgccctccttcatctggtcctgcgagcgctaccgcgccgacgtgcgcacagtgtgggagcaatgcgtggccatcatgtctgaggaggatggagatgacgatgggggctgtgacgactatgcagagggccgagtttgcaaagttcgctttgatgctaacggagccacaggaccagggagccgggaccccgcccaggtgaagctgctgcctggaaggcacatgctcttccctcctcttgagagagtccactacttacaggtccccctatcccggcgtctgtcccatgatgagacaaacatcttctctacccctcgggaaccaggctccttcctgcacaagtggtcatcctctgatgacatccgggtcctcccagcccagagccgggccctcgggggtcctcctgagtacctgggacaaagacacaggttggaggacgaggaggacgaggaagaggctgaaggtggggggctggccagccttcgccaattcttggagagtggggttctggggtcaggtgggggacccccacggggtcctggcttcttccgggaggagatcaccaccttcatcgatgagacacctctgccttctccgactgcctcaccagggcactctcctcgtcggccccggccactgggcctctcaccccgccgactctcccttgggtcccctgagagcagagccgttggacttcctttgggactaagcgcagggagacgctgctccctgacggggggtgaagaaagtgcaagggcttggggaggatcctggggcccaggcaaccccatctttccccagctgaccctgtga

SEQ ID NO: 1057 - DNA, 3585 bp, Homo sapiens
atggtcgggctccttttgttttttttcccagcgatctttttggaggtgtcccttctccccagaagccccggcaggaaagtgttgctggcaggagcgtcgtctcagcgctcggtggccagaatggacggagatgtcatcattggagccctcttctcagtccatcaccagcctccggccgagaaagtgcccgagaggaagtgtggggagatcagggagcagtatggcatccagagggtggaggccatgttccacacgttggataagatcaacgcggacccggtcctcctgcccaacatcaccctgggcagtgagatccgggactcctgctggcactcttccgtggctctggaacagagcattgagttcattagggactctctgatttccattcgagatgagaaggatgggatcaaccggtgtctgcctgacggccagtccctccccccaggcaggactaagaagcccattgcgggagtgatcggtcccggctccagctctgtagccattcaagtgcagaacctgctccagctcttcgacatcccccagatcgcttattcagccacaagcatcgacctgagtgacaaaactttgtacaaatacttcctgagggttgtcccttctgacactttgcaggcaagggccatgcttgacatagtcaaacgttacaattggacctatgtctctgcagtccacacggaagggaattatggggagagcggaatggacgctttcaaagagctggctgcccaggaaggcctctgtatcgcccattctgacaaaatctacagcaacgctggggagaagagctttgaccgactcttgcgcaaactccgagagaggcttcccaaggctagagtggtggtctgcttctgtgaaggcatgacagtgcgaggactcctgagcgccatgcggcgccttggcgtcgtgggcgagttctcactcattggaagtgatggatgggcagacagagatgaagtcattgaaggttatgaggtggaagccaacgggggaatcacgataaagctgcagtctccagaggtcaggtcatttgatgattatttcctgaaactgaggctggacactaacacgaggaatccctggttccctgagttctggcaacatcggttccagtgccgccttccaggacaccttctggaaaatcccaactttaaacgaatctgcacaggcaatgaaagcttagaagaaaactatgtccaggacagtaagatggggtttgtcatcaatgccatctatgccatggcacatgggctgcagaacatgcaccatgccctctgccctggccacgtgggcctctgcgatgccatgaagcccatcgacggcagcaagctgctggacttcctcatcaagtcctcattcattggagtatctggagaggaggtgtggtttgatgagaaaggagacgctcctggaaggtatgatatcatgaatctgcagtacactgaagctaatcgctatgactatgtgcacgttggaacctggcatgaaggagtgctgaacattgatgattacaaaatccagatgaacaagagtggagtggtgcggtctgtgtgcagtgagccttgcttaaagggccagattaaggttatacggaaaggagaagtgagctgctgctggatttgcacggcctgcaaagagaatgaatatgtgcaagatgagttcacctgcaaagcttgtgacttgggatggtggcccaatgcagatctaacaggctgtgagcccattcctgtgcgctatcttgagtggagcaacatcgaacccattatagccatcgccttttcatgcctgggaatccttgttaccttgtttgtcaccctaatctttgtactgtaccgggacacaccagtggtcaaatcctccagtcgggagctctgctacatcatcctagctggcatcttccttggttatgtgtgcccattcactctcattgccaaacctactaccacctcctgctacctccagcgcctcttggttggcctctcctctgcgatgtgctactctgctttagtgactaaaaccaatcgtattgcacgcatcctggctggcagcaagaagaagatctgcacccggaagcccaggttcatgagtgcctgggctcaggtgatcattgcctcaattctgattagtgtgcaactaaccctggtggtaaccctgatcatcatggaaccccctatgcccattctgtcctacccaagtatcaaggaagtctaccttatctgcaataccagcaacctgggtgtggtggcccctttgggctacaatggactcctcatcatgagctgtacctactatgccttcaagacccgcaacgtgcccgccaacttcaacgaggccaaatatatcgcgttcaccatgtacaccacctgtatcatctggctagcttttgtgcccatttactttgggagcaactacaagatcatcacaacttgctttgcagtgagtctcagtgtaacagtggctctggggtgcatgttcactcccaagatgtacatcattattgccaagcctgagaggaatgtccgcagtgccttcaccacctctgatgttgtccgcatgcatgttggcgatggcaagctgccctgccgctccaacactttcctcaacatcttccgaagaaagaaggcaggggcagggaatgccaattctaatggcaagtctgtgtcatggtctgaaccaggtggaggacaggtgcccaagggacagcatatgtggcaccgcctctctgtgcacgtgaagaccaatgagacggcctgcaaccaaacagccgtcatcaaacccctcactaaaagttaccaaggctctggcaagagcctgaccttttcagataccagcaccaagaccctttacaacgtagaggaggaggaggatgcccagccgattcgctttagcccgcctggtagcccttccatggtggtgcacaggcgcgtgccaagcgcggcgaccactccgcctctgccgccccacctgaccgcagaggagacccccctcttcctggccgaaccagccctccccaagggcttgccccctcctctccagcagcagcagcaaccccctccacagcagaaatcgctgatggaccagctccagggagtggtcagcaacttcagtaccgcgatcccggattttcacgcggtgctggcaggccccgggggtcccgggaacgggctgcggtccctgtacccgcccccgccacctccgcagcacctgcagatgctgccgctgcagctgagcacctttggggaggagctggtctccccgcccgcggacgacgacgacgacagcgagaggtttaagctcctccaggagtacgtgtatgagcacgagcgggaagggaacaccgaagaagacgaactggaagaggaggaggaggacctgcaggcggccagcaaactgaccccggatgattcgcctgcgctgacgcctccgtcgcctttccgcgactcggtggcctcgggcagctcggtgcccagctccccagtgtccgagtcggtgctctgcacccctcccaacgtatcctacgcctctgtcattctgcgggactacaagcaaagctcttccaccctgtaa

SEQ ID NO: 1058 - DNA, 2634 bp, Homo sapiens
atgttgacaagactgcaagttcttaccttagctttgttttcaaagggatttttactctctttaggggaccataactttctaaggagagagattaaaatagaaggtgaccttgttttagggggcctgtttcctattaacgaaaaaggcactggaactgaagaatgtgggcgaatcaatgaagaccgagggattcaacgcctggaagccatgttgtttgctattgatgaaatcaacaaagatgattacttgctaccaggagtgaagttgggtgttcacattttggatacatgttcaagggatacctatgcattggagcaatcactggagtttgtcagggcatctttgacaaaagtggatgaagctgagtatatgtgtcctgatggatcctatgccattcaagaaaacatcccacttctcattgcaggggtcattggtggctcttatagcagtgtttccatacaggtggcaaacctgctgcggctcttccagatccctcagatcagctacgcatccaccagcgccaaactcagtgataagtcgcgctatgattactttgccaggaccgtgccccccgacttctaccaggccaaagccatggctgagatcttgcgcttcttcaactggacctacgtgtccacagtagcctccgagggtgattacggggagacagggatcgaggccttcgagcaggaagcccgcctgcgcaacatctgcatcgctacggcggagaaggtgggccgctccaacatccgcaagtcctacgacagcgtgatccgagaactgttgcagaagcccaacgcgcgcgtcgtggtcctcttcatgcgcagcgacgactcgcgggagctcattgcagccgccagccgcgccaatgcctccttcacctgggtggccagcgacggctggggcgcgcaggagagcatcatcaagggcagcgagcatgtggcctacggcgccatcaccctggagctggcctcccagcctgtccgccagttcgaccgctacttccagagcctcaacccctacaacaaccaccgcaacccctggttccgggacttctgggagcaaaagtttcagtgcagcctccagaacaaacgcaaccacaggcgcgtctgcgacaagcacctggccatcgacagcagcaactacgagcaagagtccaagatcatgtttgtggtgaacgcggtgtatgccatggcccacgctttgcacaaaatgcagcgcaccctctgtcccaacactaccaagctttgtgatgctatgaagatcctggatgggaagaagttgtacaaggattacttgctgaaaatcaacttcacggctccattcaacccaaataaagatgcagatagcatagtcaagtttgacacttttggagatggaatggggcgatacaacgtgttcaatttccaaaatgtaggtggaaagtattcctacttgaaagttggtcactgggcagaaaccttatcgctagatgtcaactctatccactggtcccggaactcagtccccacttcccagtgcagcgacccctgtgcccccaatgaaatgaagaatatgcaaccaggggatgtctgctgctggatttgcatcccctgtgaaccctacgaatacctggctgatgagtttacctgtatggattgtgggtctggacagtggcccactgcagacctaactggatgctatgaccttcctgaggactacatcaggtgggaagacgcctgggccattggcccagtcaccattgcctgtctgggttttatgtgtacatgcatggttgtaactgtttttatcaagcacaacaacacacccttggtcaaagcatcgggccgagaactctgctacatcttattgtttggggttggcctgtcatactgcatgacattcttcttcattgccaagccatcaccagtcatctgtgcattgcgccgactcgggctggggagttccttcgctatctgttactcagccctgctgaccaagacaaactgcattgcccgcatcttcgatggggtcaagaatggcgctcagaggccaaaattcatcagccccagttctcaggttttcatctgcctgggtctgatcctggtgcaaattgtgatggtgtctgtgtggctcatcctggaggccccaggcaccaggaggtatacccttgcagagaagcgggaaacagtcatcctaaaatgcaatgtcaaagattccagcatgttgatctctcttacctacgatgtgatcctggtgatcttatgcactgtgtacgccttcaaaacgcggaagtgcccagaaaatttcaacgaagctaagttcataggttttaccatgtacaccacgtgcatcatctggttggccttcctccctatattttatgtgacatcaagtgactacagagtgcagacgacaaccatgtgcatctctgtcagcctgagtggctttgtggtcttgggctgtttgtttgcacccaaggttcacatcatcctgtttcaaccccagaagaatgttgtcacacacagactgcacctcaacaggttcagtgtcagtggaactgggaccacatactctcagtcctctgcaagcacgtatgtgccaacggtgtgcaatgggcgggaagtcctcgactccaccacctcatctctgtga

SEQ ID NO: 1059 - DNA, 2727 bp, Homo sapiens
atggtatgcgagggaaagcgatcagcctcttgcccttgtttcttcctcttgaccgccaagttctactggatcctcacaatgatgcaaagaactcacagccaggagtatgcccattccatacgggtggatggggacattattttggggggtctcttccctgtccacgcaaagggagagagaggggtgccttgtggggagctgaagaaggaaaaggggattcacagactggaggccatgctttatgcaattgaccagattaacaaggaccctgatctcctttccaacatcactctgggtgtccgcatcctcgacacgtgctctagggacacctatgctttggagcagtctctaacattcgtgcaggcattaatagagaaagatgcttcggatgtgaagtgtgctaatggagatccacccattttcaccaagcccgacaagatttctggcgtcataggtgctgcagcaagctccgtgtccatcatggttgctaacattttaagactttttaagatacctcaaatcagctatgcatccacagccccagagctaagtgataacaccaggtatgactttttctctcgagtggttccgcctgactcctaccaagcccaagccatggtggacatcgtgacagcactgggatggaattatgtttcgacactggcttctgaggggaactatggtgagagcggtgtggaggccttcacccagatctcgagggagattggtggtgtttgcattgctcagtcacagaaaatcccacgtgaaccaagacctggagaatttgaaaaaattatcaaacgcctgctagaaacacctaatgctcgagcagtgattatgtttgccaatgaggatgacatcaggaggatattggaagcagcaaaaaaactaaaccaaagtgggcattttctctggattggctcagatagttggggatccaaaatagcacctgtctatcagcaagaggagattgcagaaggggctgtgacaattttgcccaaacgagcatcaattgatggatttgatcgatactttagaagccgaactcttgccaataatcgaagaaatgtgtggtttgcagaattctgggaggagaattttggctgcaagttaggatcacatgggaaaaggaacagtcatataaagaaatgcacagggctggagcgaattgctcgggattcatcttatgaacaggaaggaaaggtccaatttgtaattgatgctgtatattccatggcttacgccctgcacaatatgcacaaagatctctgccctggatacattggcctttgtccacgaatgagtaccattgatgggaaagagctacttggttatattcgggctgtaaattttaatggcagtgctggcactcctgtcacttttaatgaaaacggagatgctcctggacgttatgatatcttccagtatcaaataaccaacaaaagcacagagtacaaagtcatcggccactggaccaatcagcttcatctaaaagtggaagacatgcagtgggctcatagagaacatactcacccggcgtctgtctgcagcctgccgtgtaagccaggggagaggaagaaaacggtgaaaggggtcccttgctgctggcactgtgaacgctgtgaaggttacaactaccaggtggatgagctgtcctgtgaactttgccctctggatcagagacccaacatgaaccgcacaggctgccagcttatccccatcatcaaattggagtggcattctccctgggctgtggtgcctgtgtttgttgcaatattgggaatcatcgccaccacctttgtgatcgtgacctttgtccgctataatgacacacctatcgtgagggcttcaggacgcgaacttagttacgtgctcctaacggggatttttctctgttattcaatcacgtttttaatgattgcagcaccagatacaatcatatgctccttccgacgggtcttcctaggacttggcatgtgtttcagctatgcagcccttctgaccaaaacaaaccgtatccaccgaatatttgagcaggggaagaaatctgtcacagcgcccaagttcattagtccagcatctcagctggtgatcaccttcagcctcatctccgtccagctccttggagtgtttgtctggtttgttgtggatcccccccacatcatcattgactatggagagcagcggacactagatccagagaaggccaggggagtgctcaagtgtgacatttctgatctctcactcatttgttcacttggatacagtatcctcttgatggtcacttgtactgtttatgccaataaaacgagaggtgtcccagagactttcaatgaagccaaacctattggatttaccatgtataccacctgcatcatttggttagctttcatccccatcttttttggtacagcccagtcagcagaaaagatgtacatccagacaacaacacttactgtctccatgagtttaagtgcttcagtatctctgggcatgctctatatgcccaaggtttatattataatttttcatccagaacagaatgttcaaaaacgcaagaggagcttcaaggctgtggtgacagctgccaccatgcaaagcaaactgatccaaaaaggaaatgacagaccaaatggcgaggtgaaaagtgaactctgtgagagtcttgaaaccaacacttcctctaccaagacaacatatatcagttacagcaatcattcaatctga

SEQ ID NO: 1060 - DNA, 1155 bp, Homo sapiens
atggctctaaatgactgtttccttctgaacttggaggtggaccatttcatgcactgcaacatctccagtcacagtgcggatctccccgtgaacgatgactggtcccacccggggatcctctatgtcatccctgcagtttatggggttatcattctgataggcctcattggcaacatcactttgatcaagatcttctgtacagtcaagtccatgcgaaacgttccaaacctgttcatttccagtctggctttgggagacctgctcctcctaataacgtgtgctccagtggatgccagcaggtacctggctgacagatggctatttggcaggattggctgcaaactgatcccctttatacagcttacctctgttggggtgtctgtcttcacactcacggcgctctcggcagacagatacaaagccattgtccggccaatggatatccaggcctcccatgccctgatgaagatctgcctcaaagccgcctttatctggatcatctccatgctgctggccattccagaggccgtgttttctgacctccatcccttccatgaggaaagcaccaaccagaccttcattagctgtgccccatacccacactctaatgagcttcaccccaaaatccattctatggcttcctttctggtcttctacgtcatcccactgtcgatcatctctgtttactactacttcattgctaaaaatctgatccagagtgcttacaatcttcccgtggaagggaatatacatgtcaagaagcagattgaatcccggaagcgacttgccaagacagtgctggtgtttgtgggcctgttcgccttctgctggctccccaatcatgtcatctacctgtaccgctcctaccactactctgaggtggacacctccatgctccactttgtcaccagcatctgtgcccgcctcctggccttcaccaactcctgcgtgaacccctttgccctctacctgctgagcaagagtttcaggaaacagttcaacactcagctgctctgttgccagcctggcctgatcatccggtctcacagcactggaaggagtacaacctgcatgacctccctcaagagtaccaacccctccgtggccacctttagcctcatcaatggaaacatctgtcacgagcggtatgtctag

SEQ ID NO: 1061 - DNA, 960 bp, Homo sapiens
atgacaaacagttcgttcttctgcccagtttataaagatctggagccattcacgtattttttttatttagttttccttgttggaattattggaagttgttttgcaacctgggcttttatacagaagaatacgaatcacaggtgtgtgagcatctacttaattaatttgcttacagccgatttcctgcttactctggcattaccagtgaaaattgttgttgacttgggtgtggcaccttggaagctgaagatattccactgccaagtaacagcctgcctcatctatatcaatatgtatttatcaattatcttcttagcatttgtcagcattgaccgctgtcttcagctgacacacagctgcaagatctaccgaatacaagaacccggatttgccaaaatgatatcaaccgttgtgtggctaatggtccttcttataatggtgccaaatatgatgattcccatcaaagacatcaaggaaaagtcaaatgtgggttgtatggagtttaaaaaggaatttggaagaaattggcatttgctgacaaatttcatatgtgtagcaatatttttaaatttctcagccatcattttaatatccaattgccttgtaattcgacagctctacagaaacaaagataatgaaaattacccaaatgtgaaaaaggctctcatcaacatacttttagtgaccacgggctacatcatatgctttgttccttaccacattgtccgaatcccgtataccctcagccagacagaagtcataactgattgctcaaccaggatttcactcttcaaagccaaagaggctacactgctcctggctgtgtcgaacctgtgctttgatcctatcctgtactatcacctctcaaaagcattccgctcaaaggtcactgagacttttgcctcacctaaagagaccaaggctcagaaagaaaaattaagatgtgaaaataatgcataa

SEQ ID NO: 1062 - DNA, 1125 bp, Homo sapiens
atgcccacactcaatacttctgcctctccacccacattcttctgggccaatgcctccggaggcagtgtgctgagtgctgatgatgctccgatgcctgtcaaattcctagccctgaggctcatggttgccctggcctatgggcttgtgggggccattggcttgctgggaaatttggcggtgctgtgggtactgagtaactgtgcccggagagcccctggcccaccttcagacaccttcgtcttcaacctggctctggcggacctgggactggcactcactctccccttttgggcagccgagtcggcactggactttcactggcccttcggaggtgccctctgcaagatggttctgacggccactgtcctcaacgtctatgccagcatcttcctcatcacagcgctgagcgttgctcgctactgggtggtggccatggctgcggggccaggcacccacctctcactcttctgggcccgaatagccaccctggcagtgtgggcggcggctgccctggtgacggtgcccacagctgtcttcggggtggagggtgaggtgtgtggtgtgcgcctttgcctgctgcgtttccccagcaggtactggctgggggcctaccagctgcagagggtggtgctggctttcatggtgcccttgggcgtcatcaccaccagctacctgctgctgctggccttcctgcagcggcggcaacggcggcggcaggacagcagggtcgtggcccgctctgtccgcatcctggtggcttccttcttcctctgctggtttcccaaccatgtggtcactctctggggtgtcctggtgaagtttgacctggtgccctggaacagtactttctatactatccagacgtatgtcttccctgtcactacttgcttggcacacagcaatagctgcctcaaccctgtgctgtactgtctcctgaggcgggagccccggcaggctctggcaggcaccttcagggatctgcggttgaggctgtggccccagggcggaggctgggtgcaacaggtggccctaaagcaggtaggcaggcggtgggtcgcaagcaacccccgggagagccgcccttctaccctgctcaccaacctggacagagggacacccgggtga

SEQ ID NO: 1063 - DNA, 1665 bp, Homo sapiens
atgtttaattggcaattaattgaaaaattctgtgtatcagcgaacatgatacagcccacagcctgcgggtctgcgcccctggattaacatgctgccctgccaggaggacacgacctgcagccccatcctaactctggccaccccatcctgcaggcatgccggctgccgctccaggactcccctgtccccaggaccaagatgacgcccaacagcactggcgaggtgcccagccccattcccaagggggctttggggctctccctggccctggcaagcctcatcatcaccgcgaacctgctcctagccctgggcatcgcctgggaccgccgcctgcgcagcccacctgctggctgcttcttcctgagcctactgctggctgggctgctcacgggtctggcattgcccacattgccagggctgtggaaccagagtcgccggggttactggtcctgcctcctcgtctacttggctcccaacttctccttcctctccctgcttgccaacctcttgctggtgcacggggagcgctacatggcagtcctgaggccactccagccccctgggagcattcggctggccctgctcctcacctgggctggtcccctgctctttgccagtctgcccgctctggggtggaaccactggacccctggtgccaactgcagctcccaggctatcttcccagccccctacctgtacctcgaagtctatgggctcctgctgcccgccgtgggtgctgctgccttcctctctgtccgcgtgctggccactgcccaccgccagctgcaggacatctgccggctggagcgggcagtgtgccgcgatgagccctccgccctggcccgggcccttacctggaggcaggcaagggcacaggctggagccatgctgctcttcgggctgtgctgggggccctacgtggccacactgctcctctcagtcctggcctatgagcagcgcccgccactggggcctgggacactgttgtccctcctctccctaggaagtgccagtgcagcggcagtgcccgtagccatggggctgggcgatcagcgctacacagccccctggagggcagccgcccaaaggtgcctgcaggggctgtggggaagagcctcccgggacagtcccggccccagcattgcctaccacccaagcagccaaagcagtgtcgacctggacttgaactaaaggaagggcctctgctgactcctaccagagcatccgtccagctcagccatccagcctgtctctaccgggccccacttctctggatcagagaccctgcctctgtttgaccccgcactgactgaataaagctcctctggccgtttatgattatctcattccatatctcagggcgaggcaggaggaaatggctcaacacaccaacaatagaaagaacctacagacatacgcgtggattaaggcagagtccgactccaggcaggcaagaagtgtcgtgcgcacagaccacccctggagatggggagctggcacatctcaacatccagccgattctgcgggacagccttgccctgacggggccctcgctagctcctcctagggtccagccatcacaaaatccacacagactctgtctctgggaagtatattttatttacatttttaaaatctttaactagtatctcttcctcctttcca

SEQ ID NO: 1064 - DNA, 1008 bp, Homo sapiens
atggaatcatctttctcatttggagtgatccttgctgtcctggcctccctcatcattgctactaacacactagtggctgtggctgtgctgctgttgatccacaagaatgatggtgtcagtctctgcttcaccttgaatctggctgtggctgacaccttgattggtgtggccatctctggcctactcacagaccagctctccagcccttctcggcccacacagaagaccctgtgcagcctgcggatggcatttgtcacttcctccgcagctgcctctgtcctcacggtcatgctgatcacctttgacaggtaccttgccatcaagcagcccttccgctacttgaagatcatgagtgggttcgtggccggggcctgcattgccgggctgtggttagtgtcttacctcattggcttcctcccactcggaatccccatgttccagcagactgcctacaaagggcagtgcagcttctttgctgtatttcaccctcacttcgtgctgaccctctcctgcgttggcttcttcccagccatgctcctctttgtcttcttctactgcgacatgctcaagattgcctccatgcacagccagcagattcgaaagatggaacatgcaggagccatggctggaggttatcgatccccacggactcccagcgacttcaaagctctccgtactgtgtctgttctcattgggagctttgctctatcctggacccccttccttatcactggcattgtgcaggtggcctgccaggagtgtcacctctacctagtgctggaacggtacctgtggctgctcggcgtgggcaactccctgctcaacccactcatctatgcctattggcagaaggaggtgcgactgcagctctaccacatggccctaggagtgaagaaggtgctcacctcattcctcctctttctctcggccaggaattgtggcccagagaggcccagggaaagttcctgtcacatcgtcactatctccagctcagagtttgatggctaa

SEQ ID NO: 1065 - DNA, 1164 bp, Homo sapiens
atgaatcggcaccatctgcaggatcactttctggaaatagacaagaagaactgctgtgtgttccgagatgacttcattgccaaggtgttgccgccggtgttggggctggagtttatctttgggcttctgggcaatggccttgccctgtggattttctgtttccacctcaagtcctggaaatccagccggattttcctgttcaacctggcagtagctgactttctactgatcatctgcctgccgttcgtgatggactactatgtgcggcgttcagactggaactttggggacatcccttgccggctggtgctcttcatgtttgccatgaaccgccagggcagcatcatcttcctcacggtggtggcggtagacaggtatttccgggtggtccatccccaccacgccctgaacaagatctccaattggacagcagccatcatctcttgccttctgtggggcatcactgttggcctaacagtccacctcctgaagaagaagttgctgatccagaatggccctgcaaatgtgtgcatcagcttcagcatctgccataccttccggtggcacgaagctatgttcctcctggagttcctcctgcccctgggcatcatcctgttctgctcagccagaattatctggagcctgcggcagagacaaatggaccggcatgccaagatcaagagagccatcaccttcatcatggtggtggccatcgtctttgtcatctgcttccttcccagcgtggttgtgcggatccgcatcttctggctcctgcacacttcgggcacgcagaattgtgaagtgtaccgctcggtggacctggcgttctttatcactctcagcttcacctacatgaacagcatgctggaccccgtggtgtactacttctccagcccatcctttcccaacttcttctccactttgatcaaccgctgcctccagaggaagatgacaggtgagccagataataaccgcagcacgagcgtcgagctcacaggggaccccaacaaaaccagaggcgctccagaggcgttaatggccaactccggtgagccatggagcccctcttatctgggcccaacctcaaataaccattccaagaagggacattgtcaccaagaaccagcatctctggagaaacagttgggctgttgcatcgagtaa

SEQ ID NO: 1066 - DNA, 1464 bp, Homo sapiens
atgagcctccccaattcctcctgcctcttagaagacaagatgtgtgagggcaacaagaccactatggccagcccccagctgatgcccctggtggtggtcctgagcactatctgcttggtcacagtagggctcaacctgctggtgctgtatgccgtacggagtgagcggaagctccacactgtggggaacctgtacatcgtcagcctctcggtggcggacttgatcgtgggtgccgtcgtcatgcctatgaacatcctctacctgctcatgtccaagtggtcactgggccgtcctctctgcctcttttggctttccatggactatgtggccagcacagcgtccattttcagtgtcttcatcctgtgcattgatcgctaccgctctgtccagcagcccctcaggtaccttaagtatcgtaccaagacccgagcctcggccaccattctgggggcctggtttctctcttttctgtgggttattcccattctaggctggaatcacttcatgcagcagacctcggtgcgccgagaggacaagtgtgagacagacttctatgatgtcacctggttcaaggtcatgactgccatcatcaacttctacctgcccaccttgctcatgctctggttctatgccaagatctacaaggccgtacgacaacactgccagcaccgggagctcatcaataggtccctcccttccttctcagaaattaagctgaggccagagaaccccaagggggatgccaagaaaccagggaaggagtctccctgggaggttctgaaaaggaagccaaaagatgctggtggtggatctgtcttgaagtcaccatcccaaacccccaaggagatgaaatccccagttgtcttcagccaagaggatgatagagaagtagacaaactctactgctttccacttgatattgtgcacatgcaggctgcggcagaggggagtagcagggactatgtagccgtcaaccggagccatggccagctcaagacagatgagcagggcctgaacacacatggggccagcgagatatcagaggatcagatgttaggtgatagccaatccttctctcgaacggactcagataccaccacagagacagcaccaggcaaaggcaaattgaggagtgggtctaacacaggcctggattacatcaagtttacttggaagaggctccgctcgcattcaagacagtatgtatctgggttgcacatgaaccgcgaaaggaaggccgccaaacagttgggttttatcatggcagccttcatcctctgctggatcccttatttcatcttcttcatggtcattgccttctgcaagaactgttgcaatgaacatttgcacatgttcaccatctggctgggctacatcaactccacactgaaccccctcatctaccccttgtgcaatgagaacttcaagaagacattcaagagaattctgcatattcgctcctaa

SEQ ID NO: 1067 - DNA, 1847 bp, Homo sapiens
ctcctgccctccactgactccagagagggagatccccagtacttgactccatcacgcagatgggagcaggcaccagctatggagagggatacagctgcgtctccacatgacccatcctgcatgacaccaaagccaccgccagacagtgcctcggattctatgcaaaacctgggaagcggagacctaccccagccccgggaggaagctagctcttcaggggaccgtctgaggactggagtttgatccatgaacctggcttcgaggccttgcttttctctcttcttcattcatattcattcccaacaccttagaaggtgttgcttaatttatttctagaaaagcagcccagagtcagtcattgaagccttccccaccccctggccaaaaaaaaaaaaaaaaaaaaactggacacattttggatctgttgggagcttggagtccagtggttggcatagttgtcacattgggagcagagaagaagcaaccaggggccctgatcaggggactgagccgtagagtcccaggatggcacccaatggcacagcctcttccttttgcctggactctaccgcatgcaagatcaccatcaccgtggtccttgcggtcctcatcctcatcaccgttgctggcaatgtggtcgtctgtctggccgtgggcttgaaccgccggctccgcaacctgaccaattgtttcatcgtgtccttggctatcactgacctgctcctcggcctcctggtgctgcccttctctgccatctaccagctgtcctgcaagtggagctttggcaaggtcttctgcaatatctacaccagcctggatgtgatgctctgcacagcctccattcttaacctcttcatgatcagcctcgaccggtactgcgctgtcatggacccactgcggtaccctgtgctggtcaccccagttcgggtcgccatctctctggtcttaatttgggtcatctccattaccctgtcctttctgtctatccacctggggtggaacagcaggaacgagaccagcaagggcaatcataccacctctaagtgcaaagtccaggtcaatgaagtgtacgggctggtggatgggctggtcaccttctacctcccgctactgatcatgtgcatcacctactaccgcatcttcaaggtcgcccgggatcaggccaagaggatcaatcacattagctcctggaaggcagccaccatcagggagcacaaagccacagtgacactggccgccgtcatgggggccttcatcatctgctggtttccctacttcaccgcgtttgtgtaccgtgggctgagaggggatgatgccatcaatgaggtgttagaagccatcgttctgtggctgggctatgccaactcagccctgaaccccatcctgtatgctgcgctgaacagagacttccgcaccgggtaccaacagctcttctgctgcaggctggccaaccgcaactcccacaaaacttctctgaggtccaacgcctctcagctgtccaggacccaaagccgagaacccaggcaacaggaagagaaacccctgaagctccaggtgtggagtgggacagaagtcacggccccccagggagccacagacaggtaatagccctagccattggtgcacaggatgggggcaatgggaggggatgctactgatgggaatgattaagggagctgctgtttaggtggtgctggtttatgttctaggaactcttcatgagcactttgtaaacaccctcttgcttaatcctcccaacggcccccaaaggtagaacttagctcccttttaaaaggagcacattaaaattctcagaggacttggcaagggccgcacagctggggcat

SEQ ID NO: 1068 - DNA, 1338 bp, Homo sapiens
atggagcgcgcgccgcccgacgggccgctgaacgcttcgggggcgctggcgggcgaggcggcggcggcgggcggggcgcgcggcttctcggcagcctggaccgcggtgctggccgcgctcatggcgctgctcatcgtggccacggtgctgggcaacgcgctggtcatgctcgccttcgtggccgactcgagcctccgcacccagaacaacttcttcctgctcaacctcgccatctccgacttcctcgtcggcgccttctgcatcccactgtatgtaccctacgtgctgacaggccgctggaccttcggccggggcctctgcaagctgtggctggtagtggactacctgctgtgcacctcctctgccttcaacatcgtgctcatcagctacgaccgcttcctgtcggtcacccgagcggtctcataccgggcccagcagggtgacacgcggcgggcagtgcggaagatgctgctggtgtgggtgctggccttcctgctgtacggaccagccatcctgagctgggagtacctgtccgggggcagctccatccccgagggccactgctatgccgagttcttctacaactggtacttcctcatcacggcttccaccctggagttctttacgcccttcctcagcgtcaccttctttaacctcagcatctacctgaacatccagaggcgcacccgcctccggctggatggggctcgagaggcagccggccccgagccccctcccgaggcccagccctcaccacccccaccgcctggctgctggggctgctggcagaaggggcacggggaggccatgccgctgcacaggtatggggtgggtgaggcggccgtaggcgctgaggccggggaggcgaccctcgggggtggcggtgggggcggctccgtggcttcacccacctccagctccggcagctcctcgaggggcactgagaggccgcgctcactcaagaggggctccaagccgtcggcgtcctcggcctcgctggagaagcgcatgaagatggtgtcccagagcttcacccagcgctttcggctgtctcgggacaggaaagtggccaagtcgctggccgtcatcgtgagcatctttgggctctgctgggccccatacacgctgctgatgatcatccgggccgcctgccatggccactgcgtccctgactactggtacgaaacctccttctggctcctgtgggccaactcggctgtcaaccctgtcctctaccctctgtgccaccacagcttccgccgggccttcaccaagctgctctgcccccagaagctcaaaatccagccccacagctccctggagcactgctggaagtga

SEQ ID NO: 1069 - DNA, 3689 bp, Homo sapiens
ggaagactacacattttaggtatgtgattagaaaacatacttgtcagaattgtctggctggattaatttgctaatttgaccttcttcatcatttgatgtgatgccagatactaatagcacaatcaatttatcactaagcactcgtgttactttagcattttttatgtccttagtagcttttgctataatgctaggaaatgctttggtcattttagcttttgtggtggacaaaaaccttagacatcgaagtagttatttttttcttaacttggccatctctgacttctttgtgggtgtgatctccattcctttgtacatccctcacacgctgttcgaatgggattttggaaaggaaatctgtgtattttggctcactactgactatctgttatgtacagcatctgtatataacattgtcctcatcagctatgatcgatacctgtcagtctcaaatgctgtgtcttatagaactcaacatactggggtcttgaagattgttactctgatggtggccgtttgggtgctggccttcttagtgaatgggccaatgattctagtttcagagtcttggaaggatgaaggtagtgaatgtgaacctggatttttttcggaatggtacatccttgccatcacatcattcttggaattcgtgatcccagtcatcttagtcgcttatttcaacatgaatatttattggagcctgtggaagcgtgatcatctcagtaggtgccaaagccatcctggactgactgctgtctcttccaacatctgtggacactcattcagaggtagactatcttcaaggagatctctttctgcatcgacagaagttcctgcatcctttcattcagagagacagaggagaaagagtagtctcatgttttcctcaagaaccaagatgaatagcaatacaattgcttccaaaatgggttccttctcccaatcagattctgtagctcttcaccaaagggaacatgttgaactgcttagagccaggagattagccaagtcactggccattctcttaggggtttttgctgtttgctgggctccatattctctgttcacaattgtcctttcattttattcctcagcaacaggtcctaaatcagtttggtatagaattgcattttggcttcagtggttcaattcctttgtcaatcctcttttgtatccattgtgtcacaagcgctttcaaaaggctttcttgaaaatattttgtataaaaaagcaacctctaccatcacaacacagtcggtcagtatcttcttaaagacaattttctcacctctgtaaattttagtctcaatctcacctaaatgaatcaggtctgccctttatcttgcccttttcattctaccaacagatctgcactttgaagtcaatggtaaattactccagtgaataatagcagtataatatgacttgataatatttttgtaaacttgtagtcataatagtactatattcttcttagtcctcacctcttccttgtcttttagatcttaatttcatgctgattacaaaaatccagttttgttttctttctatgttccatgcataatacagtcttaagtgaatttctcttttttaattttatcgtaatagaaacttatccagtttgaaaatcattccctaaagcatgcaataggaaaaagaacctcctggctgggactgcccaactctgttctgatcagtgggtgggtgaggtagggtttgagttggcaagagcagggaacgggcatgtgcccaggtgagctcctgtgtgtgtccagattttatattcctaatcccagtaaggaagaaagcgtagtgtgggagaggagagagctgatgactgcagttctcaaaggtcctcagtgaagttattttggaggccctggtggtcacaggatcagaaggcaagggataggcagtggtcaccaatggttgaaagtatggcttgtcccatttcttcctgttctctttttctagcttccacatcagcttccttttttgagaacatatagaagaagaaggctaagagatggtgaagagactgcatgattaaactagatagacctggtatacagtcactgaactagtagatgtcaataattattatttttaaaaatttttatttgttggccgggcatggtggctcacgcctgaaatcccagcactttgggaggccaaggtgggcggatcatgaggtcaggagatcgagaccatcctggccaacatggtgaaaccccatctgtactaaaatacaaacaagtagctggttgtggcgccgcatgcctgtagtcccagctactcgggaggctgaggcaggggaattgcttgaacccgggaggcggagttttgccagcctggcaacagagcaagactctgtctaaaaagaaaaaaaaatttttttgtttgagacagcatcttgctctgtctcccaggctggagcgtagtaatgcaatcatagctcactgcagcctggaactccttggctcaagcaatcctgctgccttggcctcccaagtatgtgggactacaggtactcgccaccacacctggataattaaaaaattatttctgtagagatgaagtctcactgtgttgcccagcctgggtgtcaataattattttttaaaaaaaatttttaaaaaggttttttgagacagattcttgctctgtcacccaggctggagtgcagtagcatgatcagggatcactgcaacctctgcctcctgggttcaagcgattcttgtgcctaagccacctgagcagctgggattgcaggtgcatgccaccatgcctggctaattttggtatttttagtagagatgaggttttgccattttggtcaggctggaattttttttttttttaattttgataagacagggtattgccgtgttggccagactggtctcaaactcctgggctgaaacaatcctcccgccttggcctcccaaagtgctgggattataggcacaagacaccacaataattattgcctgtatgtcaattattattttaaaatattgttgtatttacttaatgtctttaatgcatttgcccaatattttacattgttactgctcagaggtattcctttattatgtggttagcataggttatactttgctgacgattcacattttattagtttggttatgttttgtccttttaaaacattttcttttgagatgggggtcttgctctgttgcccacgcaggagtgcagtggcatgctctcagctcactgcagccctgactgcctaggctccagcaatcttcttacgtcagcctccagagtagctgggaccgcaggcacttgccaccacgccccactaaaaattttttaaattgttgcctttcttgaagtgttctctgcctgtctttgtcacaaaatttcatttttctcatagttaatttcatctctccggtaagattttattggtgtttcttttataactttgcagttcttacaccgtttggtgattttcatgtttcttagaaactttaaacctttaacttcaaacattaaaatacaagtcttttaagtacatgagtgcttagaaatgtacataatgtttatatacacttatgccttacattaaagtccaatatgagaaatacatgtttaacattcaataataattttaaaaatttgagaaataaactctcataaatgcaaaaaaaaaaaaaaaaaaa

SEQ ID NO: 1070 - DNA, 1266 bp, Homo sapiens
atggatgtgctcagccctggtcagggcaacaacaccacatcaccaccggctccctttgagaccggcggcaacactactggtatctccgacgtgaccgtcagctaccaagtgatcacctctctgctgctgggcacgctcatcttctgcgcggtgctgggcaatgcgtgcgtggtggctgccatcgccttggagcgctccctgcagaacgtggccaattatcttattggctctttggcggtcaccgacctcatggtgtcggtgttggtgctgcccatggccgcgctgtatcaggtgctcaacaagtggacactgggccaggtaacctgcgacctgttcatcgccctcgacgtgctgtgctgcacctcatccatcttgcacctgtgcgccatcgcgctggacaggtactgggccatcacggaccccatcgactacgtgaacaagaggacgccccggccgcgtgcgctcatctcgctcacttggcttattggcttcctcatctctatcccgcccatcctgggctggcgcaccccggaagaccgctcggaccccgacgcatgcaccattagcaaggatcatggctacactatctattccacctttggagctttctacatcccgctgctgctcatgctggttctctatgggcgcatattccgagctgcgcgcttccgcatccgcaagacggtcaaaaaggtggagaagaccggagcggacacccgccatggagcatctcccgccccgcagcccaagaagagtgtgaatggagagtcggggagcaggaactggaggctgggcgtggagagcaaggctgggggtgctctgtgcgccaatggcgcggtgaggcaaggtgacgatggcgccgccctggaggtgatcgaggtgcaccgagtgggcaactccaaagagcacttgcctctgcccagcgaggctggtcctaccccttgtgcccccgcctctttcgagaggaaaaatgagcgcaacgccgaggcgaagcgcaagatggccctggcccgagagaggaagacagtgaagacgctgggcatcatcatgggcaccttcatcctctgctggctgcccttcttcatcgtggctcttgttctgcccttctgcgagagcagctgccacatgcccaccctgttgggcgccataatcaattggctgggctactccaactctctgcttaaccccgtcatttacgcatacttcaacaaggactttcaaaacgcgtttaagaagatcattaagtgtaacttctgccgccagtga

SEQ ID NO: 1071 - DNA, 1173 bp, Homo sapiens
atggaggaaccgggtgctcagtgcgctccaccgccgcccgcgggctccgagacctgggttcctcaagccaacttatcctctgctccctcccaaaactgcagcgccaaggactacatttaccaggactccatctccctaccctggaaagtactgctggttatgctattggcgctcatcaccttggccaccacgctctccaatgcctttgtgattgccacagtgtaccggacccggaaactgcacaccccggctaactacctgatcgcctctctggcggtcaccgacctgcttgtgtccatcctggtgatgcccatcagcaccatgtacactgtcaccggccgctggacactgggccaggtggtctgtgacttctggctgtcgtcggacatcacttgttgcactgcctccatcctgcacctctgtgtcatcgccctggaccgctactgggccatcacggacgccgtggagtactcagctaaaaggactcccaagagggcggcggtcatgatcgcgctggtgtgggtcttctccatctctatctcgctgccgcccttcttctggcgtcaggctaaggccgaagaggaggtgtcggaatgcgtggtgaacaccgaccacatcctctacacggtctactccacggtgggtgctttctacttccccaccctgctcctcatcgccctctatggccgcatctacgtagaagcccgctcccggattttgaaacagacgcccaacaggaccggcaagcgcttgacccgagcccagctgataaccgactcccccgggtccacgtcctcggtcacctctattaactcgcgggttcccgacgtgcccagcgaatccggatctcctgtgtatgtgaaccaagtcaaagtgcgagtctccgacgccctgctggaaaagaagaaactcatggccgctagggagcgcaaagccaccaagaccctagggatcattttgggagcctttattgtgtgttggctacccttcttcatcatctccctagtgatgcctatctgcaaagatgcctgctggttccacctagccatctttgacttcttcacatggctgggctatctcaactccctcatcaaccccataatctataccatgtccaatgaggactttaaacaagcattccataaactgatacgttttaagtgcacaagttga

SEQ ID NO: 1072 - DNA, 1134 bp, Homo sapiens
atgtccccactgaaccagtcagcagaaggccttccccaggaggcctccaacagatccctgaatgccacagaaacctcagaggcttgggatcccaggaccctccaggcgctcaagatctcccttgccgtggtcctttccgtcatcacactggccacagtcctctccaatgcctttgtactcaccaccatcttactcaccaggaagctccacacccctgccaactacctgattggctccctggccaccaccgacctcttggtttccatcttggtaatgcccatcagcatcgcctataccatcacccacacctggaactttggccaaatcttgtgtgacatctggctgtcctctgacatcacgtgctgcacagcctccatcctgcatctctgtgtcattgctctggacaggtactgggcaatcacagatgccctggaatacagtaaacgcaggacggctggccacgcggccaccatgatcgccattgtctgggccatctccatctgcatctccatccccccgctcttctggcggcaggccaaggcccaggaggagatgtcggactgtctggtgaacacctctcagatctcctacaccatctactccacctgtggggccttctacattccctcggtgttgctcatcatcctatatggccggatctaccgggctgcccggaaccgcatcctgaatccaccctcactctatgggaagcgcttcaccacggcccacctcatcacaggctctgccgggtcctcgctctgctcgctcaactccagcctccatgaggggcactcgcactcggctggctcccctctctttttcaaccacgtgaaaatcaagcttgctgacagtgccctggaacgcaagaggatttctgctgctcgagaaaggaaagccactaaaatcctgggcatcattctgggggcctttatcatctgctggctgcccttcttcgtggtgtctctggtcctccccatctgccgggactcctgctggatccacccggcgctctttgacttcttcacctggctaggctatttaaactccctcatcaatccaataatctacactgtgtttaatgaagagtttcggcaagcttttcagaaaattgtccctttccggaaggcctcctag

SEQ ID NO: 1073 - DNA, 1101 bp, Homo sapiens
atggatttcttaaattcatctgatcaaaacttgacctcagaggaactgttaaacagaatgccatccaaaattctggtgtccctcactctgtctgggctggcactgatgacaacaactatcaactcccttgtgatcgctgcaattattgtgacccggaagctgcaccatccagccaattatttaatttgttcccttgcagtcacagattttcttgtggctgtcctggtgatgcccttcagcattgtgtatattgtgagagagagctggattatggggcaagtggtctgtgacatttggctgagtgttgacattacctgctgcacgtgctccatcttgcatctctcagctatagctttggatcggtatcgagcaatcacagatgctgttgagtatgccaggaaaaggactccaaagcatgctggcattatgattacaatagtttggattatatctgtttttatctctatgcctcctctattctggaggcaccaaggaactagcagagatgatgaatgcatcatcaagcacgaccacattgtttccaccatttactcaacatttggagctttctacatcccactggcattgattttgatcctttactacaaaatatatagagcagcaaagacattataccacaagagacaagcaagtaggattgcaaaggaggaggtgaatggccaagtccttttggagagtggtgagaaaagcactaaatcagtttccacatcctatgtactagaaaagtctttatctgacccatcaacagactttgataaaattcatagcacagtgagaagtctcaggtctgaattcaagcatgagaaatcttggagaaggcaaaagatctcaggtacaagagaacggaaagcagccactaccctgggattaatcttgggtgcatttgtaatatgttggcttcctttttttgtaaaagaattagttgttaatgtctgtgacaaatgtaaaatttctgaagaaatgtccaattttttggcatggcttgggtatctcaattcccttataaatccactgatttacacaatctttaatgaagacttcaagaaagcattccaaaagcttgtgcgatgtcgatgttag

SEQ ID NO: 1074 - DNA, 3016 bp, Homo sapiens
gaattcgggtgagccagctccgggagaacagcatgtacaccagcctcagtgttacagagtgtgggtacatcaaggtgaatggtgagcagaaactataacctgttagtccttctacacctcatctgctacaagttctggcttagacatggatattctttgtgaagaaaatacttctttgagctcaactacgaactccctaatgcaattaaatgatgacaccaggctctacagtaatgactttaactctggagaagctaacacttctgatgcatttaactggacagtcgactctgaaaatcgaaccaacctttcctgtgaagggtgcctctcaccgtcgtgtctctccttacttcatctccaggaaaaaaactggtctgctttactgacagccgtagtgattattctaactattgctggaaacatactcgtcatcatggcagtgtccctagagaaaaagctgcagaatgccaccaactatttcctgatgtcacttgccatagctgatatgctgctgggtttccttgtcatgcccgtgtccatgttaaccatcctgtatgggtaccggtggcctctgccgagcaagctttgtgcagtctggatttacctggacgtgctcttctccacggcctccatcatgcacctctgcgccatctcgctggaccgctacgtcgccatccagaatcccatccaccacagccgcttcaactccagaactaaggcatttctgaaaatcattgctgtttggaccatatcagtaggtatatccatgccaataccagtctttgggctacaggacgattcgaaggtctttaaggaggggagttgcttactcgccgatgataactttgtcctgatcggctcttttgtgtcatttttcattcccttaaccatcatggtgatcacctactttctaactatcaagtcactccagaaagaagctactttgtgtgtaagtgatcttggcacacgggccaaattagcttctttcagcttcctccctcagagttctttgtcttcagaaaagctcttccagcggtcgatccatagggagccagggtcctacacaggcaggaggactatgcagtccatcagcaatgagcaaaaggcatgcaaggtgctgggcatcgtcttcttcctgtttgtggtgatgtggtgccctttcttcatcacaaacatcatggccgtcatctgcaaagagtcctgcaatgaggatgtcattggggccctgctcaatgtgtttgtttggatcggttatctctcttcagcagtcaacccactagtctacacactgttcaacaagacctataggtcagccttttcacggtatattcagtgtcagtacaaggaaaacaaaaaaccattgcagttaattttagtgaacacaataccggctttggcctacaagtctagccaacttcaaatgggacaaaaaaagaattcaaagcaagatgccaagacaacagataatgactgctcaatggttgctctaggaaagcagcattctgaagaggcttctaaagacaatagcgacggagtgaatgaaaaggtgagctgtgtgtgataggctagttgccgtggcaactgtggaaggcacactgagcaagttttcacctatctggaaaaaaaaaatatgagattggaaaaaattagacaagtctagtggaaccaacgatcatatctgtatgcctcattttattctgtcaatgaaaagcggggttcaatgctacaaaatgtgtgcttggaaaatgttctgacagcatttcagctgtgagctttctgatacttatttataacattgtaaatgatatgtctttaaaatgattcacttttattgtataattatgaagccctaagtaaatctaaattaacttctattttcaagtggaaaccttgctgctatgctgttcattgatgacatgggattgagttggttacctattgccgtaaataaaaatagctataaatagtgaaaattttattgaatataatggcctcttaaaaattatctttaaaacttactatggtatatattttgaaaggagaaaaaaaaaaagccactaaggtcagtgttataaaatctgtattgctaagataattaaatgaaatacttgacaacatttttcatagataccattttgaaatattcacaaggttgctggcatttgctgcatttcaagttaattctcagaagtgaaaaagacttcaaatgttattcaataactattgctgctttctcttctacttcttgtgctttactctgaatttccagtgtggtcttgtttaatatttgttcctctaggtaaactagcaaaaggatgatttaacattaccaaatgcctttctagcaattgcttctctaaaacagcactatcgaggtatttggtaacttgctgtgaaatgactgcatcatgcatgcactcttttgagcagtaaatgtatattgatgtaactgtgtcaggattgaggatgaactcaggtttccggctactgacagtggtagagtcctaggacatctctgtaaaaagcaggtgactttcctatgacactcatcaggtaaactgatgctttcagatccatcggtttatactatttattaaaaccattctgcttggttccacaatcatctattgagtgtacatttatgtgtgaagcaaatttctagatatgagaaatataaaaataattaaaacaaaatccttgccttcaaacgaaatggctcggccaggcacggaggctcgtgcatgtaatcctagcactttgggaggctgagatgggaggatcacttgaggccaagagtttgagaccaacctgggtaacaaagtgagacctccctgtctctacaaaaaaaatcaaaaaattatctgatccttgtggcacacaactgtggtcccagctacaggggaggctgagacgcaaggatcacttgagcccagaagctcaaggctgcagtgagccaagttcacaccactgccatttcctcctgggcaacagagtgagaccctatcaccccgaattc

SEQ ID NO: 1075 - DNA, 1446 bp, Homo sapiens
atggctctctcttacagagtgtctgaacttcaaagcacaattcctgagcacattttgcagagcacctttgttcacgttatctcttctaactggtctggattacagacagaatcaataccagaggaaatgaaacagattgttgaggaacagggaaataaactgcactgggcagctcttctgatactcatggtgataatacccacaattggtggaaatacccttgttattctggctgtttcactggagaagaagctgcagtatgctactaattactttctaatgtccttggcggtggctgatttgctggttggattgtttgtgatgccaattgccctcttgacaataatgtttgaggctatgtggcccctcccacttgttctatgtcctgcctggttatttcttgacgttctcttttcaaccgcatccatcatgcatctctgtgccatttcagtggatcgttacatagccatcaaaaagccaatccaggccaatcaatataactcacgggctacagcattcatcaagattacagtggtgtggttaatttcaataggcattgccattccagtccctattaaagggatagagactgatgtggacaacccaaacaatatcacttgtgtgctgacaaaggaacgttttggcgatttcatgctctttggctcactggctgccttcttcacacctcttgcaattatgattgtcacctactttctcactatccatgctttacagaagaaggcttacttagtcaaaaacaagccacctcaacgcctaacatggttgactgtgtctacagttttccaaagggatgaaacaccttgctcgtcaccggaaaaggtggcaatgctggatggttctcgaaaggacaaggctctgcccaactcaggtgatgaaacacttatgcgaagaacatccacaattgggaaaaagtcagtgcagaccatttccaacgaacagagagcctcaaaggtcctagggattgtgtttttcctctttttgcttatgtggtgtcccttctttattacaaatataactttagttttatgtgattcctgtaaccaaactactctccaaatgctcctggagatatttgtgtggataggctatgtttcctcaggagtgaatcctttggtctacaccctcttcaataagacatttcgggatgcatttggccgatatatcacctgcaattaccgggccacaaagtcagtaaaaactctcagaaaacgctccagtaagatctacttccggaatccaatggcagagaactctaagtttttcaagaaacatggaattcgaaatgggattaaccctgccatgtaccagagtccaatgaggctccgaagttcaaccattcagtcttcatcaatcattctactagatacgcttctcctcactgaaaatgaaggtgacaaaactgaagagcaagttagttatgtatag

SEQ ID NO: 1076 - DNA, 1377 bp, Homo sapiens
atggtgaacctgaggaatgcggtgcattcattccttgtgcacctaattggcctattggtttggcaatgtgatatttctgtgagcccagtagcagctatagtaactgacattttcaatacctccgatggtggacgcttcaaattcccagacggggtacaaaactggccagcactttcaatcgtcatcataataatcatgacaataggtggcaacatccttgtgatcatggcagtaagcatggaaaagaaactgcacaatgccaccaattacttcttaatgtccctagccattgctgatatgctagtgggactacttgtcatgcccctgtctctcctggcaatcctttatgattatgtctggccactacctagatatttgtgccccgtctggatttctttagatgttttattttcaacagcgtccatcatgcacctctgcgctatatcgctggatcggtatgtagcaatacgtaatcctattgagcatagccgtttcaattcgcggactaaggccatcatgaagattgctattgtttgggcaatttctataggtgtatcagttcctatccctgtgattggactgagggacgaagaaaaggtgttcgtgaacaacacgacgtgcgtgctcaacgacccaaatttcgttcttattgggtccttcgtagctttcttcataccgctgacgattatggtgattacgtattgcctgaccatctacgttctgcgccgacaagctttgatgttactgcacggccacaccgaggaaccgcctggactaagtctggatttcctgaagtgctgcaagaggaatacggccgaggaagagaactctgcaaaccctaaccaagaccagaacgcacgccgaagaaagaagaaggagagacgtcctaggggcaccatgcaggctatcaacaatgaaagaaaagcttcgaaagtccttgggattgttttctttgtgtttctgatcatgtggtgcccatttttcattaccaatattctgtctgttctttgtgagaagtcctgtaaccaaaagctcatggaaaagcttctgaatgtgtttgtttggattggctatgtttgttcaggaatcaatcctctggtgtatactctgttcaacaaaatttaccgaagggcattctccaactatttgcgttgcaattataaggtagagaaaaagcctcctgtcaggcagattccaagagttgccgccactgctttgtctgggagggagcttaatgttaacatttatcggcataccaatgaaccggtgatcgagaaagccagtgacaatgagcccggtatagagatgcaagttgagaatttagagttaccagtaaatccctccagtgtggttagcgaaaggattagcagtgtgtga

SEQ ID NO: 1077 - DNA, 3005 bp, Homo sapiens
gcggcagsgcgcggcagcagaagctcggctcagcggctgggggtggccgctcgaatctgccagggcacctcgctccctcgcctctggcagcgggaccctgtgggcattgaaatccaactcactcatgcttatttcctgtaatggacaaacttgatgctaatgtgagttctgaggagggtttcgggtcagtggagaaggtggtgctgctcacgtttctctcgacggttatcctgatggccatcttggggaacctgctggtgatggtggctgtgtgctgggacaggcagctcaggaaaataaaaacaaattatttcattgtatctcttgcttttgcggatctgctggtttcggtgctggtgatgccctttggtgccattgagctggttcaagacatctggatttatggggaggtgttttgtcttgttcggacatctctggacgtcctgctcacaacggcatcgatttttcacctgtgctgcatttctctggataggtattacgccatctgctgccagcctttggtctataggaacaagatgacccctctgcgcatcgcattaatgctgggaggctgctgggtcatccccacgtttatttcttttctccctataatgcaaggctggaataacattggcataattgatttgatagaaaagaggaagttcaaccagaactctaactctacgtactgtgtcttcatggtcaacaagccctacgccatcacctgctctgtggtggccttctacatcccatttctcctcatggtgctggcctattaccgcatctatgtcacagctaaggagcatgcccatcagatccagatgttacaacgggcaggagcctcctccgagagcaggcctcagtcggcagaccagcatagcactcatcgcatgaggacagagaccaaagcagccaagaccctgtgcatcatcatgggttgcttctgcctctgctgggcaccattctttgtcaccaatattgtggatcctttcatagactacactgtccctgggcaggtgtggactgctttcctctggctcggctatatcaattccgggttgaacccttttctctacgccttcttgaataagtcttttagacgtgccttcctcatcatcctctgctgtgatgatgagcgctaccgaagaccttccattctgggccagactgtcccttgttcaaccacaaccattaatggatccacacatgtactaagggatgcagtggagtgtggtggccagtgggagagtcagtgtcacccgccagcaacttctcctttggtggctgctcagcccagtgacacttaggcccctgggacaatgacccagaagacagccatgcctccgaaagagggccaggtcctaagctgctgcttgtgcgcgactgcacccggtattctcttcacctgaggctttccgtccgccagtgcaggaacccggtgctcgctgggcttttcctctgagattccagcaggtggcgctggagggagtcaggggacataatggcctccttgttcactttttatttcccaacactccctcttcccagattctctgcttttgccgcgtggtctctggtgtctctgacatgttcccgtcactcactgtgtctgatctgtctcactcacgttctaagcacgatagcttgctgcgtcctatctcggtcactgatgtctccaaatacgccttctttgctgtgtgggcttccagatatcaacaaaatactccctctctgttcctgtcttagccagaggcgtcgctcctgtcttgcttacttgcttggtcacgtccgtcacagccatgttcaagctatccctgcctcttcttcgccctgttctgtgccagacgctaacacacttttctccctgtgtctgggtccaaacgtgcatcctcttggttggcccccttgtcagtcccagacgtccacttgctcttccttatgtccaatgtctgtcctcctcttcaggacatgctccatttattttccatggaagacacagggtcagagatctgtcagaggaaaatggtctccacagcaactctggagggaagctgaagacagatagcttcctcctggtgtcctggccgctggcgtgtctgccctgagatgctcgctctcctgctgggctagaacgggacgtcttctaaaaagccttgggcagggctagcaacatcgtaggtgtttattaggcttcaggatctttcccatgaacttgtgatatcattttgaaacccttcaatctggctttgttgctgccaaaggagataactgttggaagttcacactggggaaactcattttcccctgcagctcccccaaggtgcaggagggcaggatccagcagcactggggatgccgaggcaatgctgtacttgaagccagaggacccaaattgccgccctggctgtgctgcaaacaagctgtgagatcttgaatagtgttctttcatctctggaccccactttccacatctgtgcactcaagcttggactagaggacctttaagttttctttctgtttctaagacaacagtatgctgctatagccgtctgctacctcgagaagccatggcctgcctgccttttggctttgtttcaaaggaacgaccctcctcatttgggccttttagacccctgacctttccagctttgtccttcagattaatctggatgtcttttattcaaagctgagtcagtggctcttgcgaatgccccatagcagaagtcccgggaaggtaaatgccaaacccagagccatgtgagattctgactttgatcttggctgtggtttaatagcatctcaggattatttatcatattctctttttttcttattgcttataaggtgtcagttattgtttccattgttgtttactttagttctggaactgaaaccgacaggaagaaactttggaataaggaagagaagattgaccaaaccatccaaatgccaaaaagraaaaaaaaaaaaaaaaaaaaaaaaaaaaaaaaaaaaagcggccgctg

SEQ ID NO: 1078 - DNA, 1074 bp, Homo sapiens
atggatttaccagtgaacctaacctccttttccctctccaccccctcccctttggagaccaaccacagcctcggcaaagacgacctgcgccccagctcgcccctgctctcggtcttcggagtgcttattctcaccttgctgggctttctggtggcggcgacgttcgcctggaacctgctggtgctggcgaccatcctccgtgtacgcaccttccaccgcgtgccccacaacctggtggcatccatggccgtctcggatgtcctggtggccgcgctggtcatgccgctgagcctggtgcatgagctgtccgggcgccgctggcagctaggtcggaggctgtgccagctttggatcgcgtgcgacgtgctttgctgcacggccagcatctggaacgtgacggccatagccctggaccgctactggtccatcacgcgccacatggaatacacgctccgcacccgcaagtgcgtctccaacgtcatgatcgcgctcacctgggcactctccgctgtcatctctctggccccgctgctttttggctggggagagacgtactctgagggcagcgaggagtgccaggtaagccgcgagccttcctacgccgtgttctccaccgtaggcgccttctacctgccgctctgtgtggtgctcttcgtgtactggaagatctacaaggctgccaagttccgcgtgggctccaggaagaccaatagcgtctcacccatatccgaagctgtggaggtgaaggactctgccaaacagccccagatggtgttcacggtccgccacgccaccgtcaccttccagccagaaggggacacgtggcgggagcagaaggagcagcgggccgccctcatggtgggcatcctcattggcgtgttcgtgctctgctggatccccttctttctcaccgagctcatcagtcccctctgctcctgtgacatccccgccatctggaaaagcatcttcctgtggcttggctactccaactccttctttaaccccctgatctatacggctttcaacaagaactacaacagcgccttcaagaacttcttttctaggcaacactga

SEQ ID NO: 1079 - DNA, 1323 bp, Homo sapiens
atggtcccagagccgggcccaaccgccaatagcaccccggcctggggggcagggccgccgtcggccccggggggcagcggctgggtggcggccgcgctgtgcgtggtcatcgcgctgacggcggcggccaactcgctgctgatcgcgctcatctgcactcagcccgcgctgcgcaacacgtccaacttcttcctggtgtcgctcttcacgtctgacctgatggtggggctggtggtgatgccgccggccatgctgaacgcgctgtacgggcgctgggtgctggcgcgcggcctctgcctgctctggaccgccttcgacgtgatgtgctgcagcgcctccatcctcaacctctgcctcatcagcctggaccgctacctgctcatcctctcgccgctgcgctacaagctgcgcatgacgcccctgcgtgccctggccctagtcctgggcgcctggagcctcgccgctctcgcctccttcctgcccctgctgctgggctggcacgagctgggccacgcacggccacccgtccctggccagtgccgcctgctggccagcctgccttttgtccttgtggcgtcgggcctcaccttcttcctgccctcgggtgccatatgcttcacctactgcaggatcctgctagctgcccgcaagcaggccgtgcaggtggcctccctcaccaccggcatggccagtcaggcctcggagacgctgcaggtgcccaggaccccacgcccaggggtggagtctgctgacagcaggcgtctagccacgaagcacagcaggaaggccctgaaggccagcctgacgctgggcatcctgctgggcatgttctttgtgacctggttgcccttctttgtggccaacatagtccaggccgtgtgcgactgcatctccccaggcctcttcgatgtcctcacatggctgggttactgtaacagcaccatgaaccccatcatctacccactcttcatgcgggacttcaagcgggcgctgggcaggttcctgccatgtccacgctgtccccgggagcgccaggccagcctggcctcgccatcactgcgcacctctcacagcggcccccggcccggccttagcctacagcaggtgctgccgctgcccctgccgccggactcagattcggactcagacgcaggctcaggcggctcctcgggcctgcggctcacggcccagctgctgcttcctggcgaggccacccaggaccccccgctgcccaccagggccgctgccgccgtcaatttcttcaacatcgaccccgcggagcccgagctgcggccgcatccacttggcatccccacgaactga

SEQ ID NO: 1080 - DNA, 1385 bp, Homo sapiens
ccatgggcagcggcacacggcggcgcgatgatggacgttaacagcagcggccgcccggacctctacgggcacctccgctctttccttctgccagaagtggggcgcgggctgcccgacttgagccccgacggtggcgccgacccggtcgcgggctcctgggcgccgcacctgctgagcgaggtgacagccagcccggcgcccacctgggacgcgcccccggacaatgcctccggctgtggggaacagatcaactacggcagagtcgagaaagttgtgatcggctccatcctgacgctcatcacgctgctgacgatcgcgggcaactgcctggtggtgatctccgtgtgcttcgtcaagaagctccgccagccctccaactacctgatcgtgtccctggcgctggccgacctctcggtggctgtggcggtcatgcccttcgtcagcgtcaccgacctcatcgggggcaagtggatctttggacactttttctgtaatgtcttcatcgccatggacgtcatgtgctgcacggcctcgatcatgaccctgtgcgtgatcagcattgacaggtaccttgggatcacaaggcccctcacataccctgtgaggcagaatgggaaatgcatggcgaagatgattctctccgtctggcttctctccgcctccatcaccttacctccactctttggatgggctcagaatgtaaatgatgataaggtgtgcttgatcagccaggactttggctatacgatttactctaccgcagtggcattttatatccccatgtccgtcatgcttttcatgtactaccagatttacaaggctgccaggaagagtgctgccaaacacaagtttcctggcttccctcgagtggagccagacagcgtcatcgccctgaatggcatagtgaagctccagaaggaggtggaagagtgtgcaaacctttcgagactcctcaagcatgaaaggaaaaacatctccatctttaagcgagaacagaaagcagccaccaccctggggatcatcgtcggggcctttaccgtgtgctggctgccatttttcctcctctcgacagccagacccttcatctgtggcacttcctgcagctgcatcccactgtgggtggagaggacatttctgtggctaggctatgcaaactctctcattaacccttttatatatgccttcttcaaccgggacctgaggaccacctatcgcagcctgctccagtgccagtaccggaatatcaaccggaagctctcagctgcaggcatgcatgaagccctgaagcttgctgagaggccagagagacctgagtttgtgctacaaaatgctgactactgtagaaaaaaaggtcatgattcatgattgaaagcagaacaatggag

SEQ ID NO: 1081 - DNA, 1449 bp, Homo sapiens
atggccttactgggcagccagcactccggcgccccctccgcggccggcccacctggcgggacttcctccgcggccacggcggccgtgctctccttcagcaccgtggcgaccgcggcgctggggaacctgagcgacgcaagcggaggcggcacagctgccgctcccggtggcggcggccttggcgggtccggggcagcgcgggaggcgggggcggcggtgaggcggccgctaggcccggaggcggcgccgctgctgtcgcacggagctgcagtggcggcccaggcgctcgtcctcctgctcatcttcctgctgtctagccttggcaactgcgcggtgatgggggtgattgtgaagcaccggcagctccgcaccgtcaccaacgccttcatcctgtcgctgtccctatcggatctgctcacggcgctgctctgcctgcccgccgccttcctggacctcttcactccgcccgggggttcggcgcctgccgccgccgcggggccctggcgcggcttctgcgccgccagccgcttcttcagctcgtgcttcggcatcgtgtccacgctcagcgtggcgctcatctcgttggaccgttactgcgctatcgtgcggccgccgcgggagaagatcggccgccgccgcgcgctgcagctgctggcgggcgcctggctgacggccctgggcttctccttgccctgggagctgctcggggcgccccgggaactcgcggcggcgcagagcttccacggctgcctctaccggacctccccggaccccgcgcagctgggcgcggccttcagcgtggggctggtggtggcctgctacctgctgcccttcctgctcatgtgcttctgccactaccacatctgcaagacggtgcgcctgtcggacgtgcgcgtgcggccggtgaacacctacgcgcgcgtgctgcgcttcttcagcgaggtgcgcacggccaccaccgtcctcatcatgatcgtcttcgtcatctgctgctgggggccctactgcttcctggtgctgctggccgccgcccggcaggcccagaccatgcaggccccctcgctcctcagcgtggtggccgtctggctgacctgggccaatggggccatcaaccctgtcatctacgccatccgcaatcccaacatttcgatgctcctagggcgcaaccgcgaggagggctaccggactaggaatgtggacgctttcctgcccagccagggcccgggtctgcaagccagaagccgcagtcgccttcgaaaccgctatgccaaccggctgggggcctgcaacaggatgtcctcttccaacccggccagcggagtggcaggggacgtggccatgtgggcccgcaaaaatccagttgtacttttctgccgagagggaccaccagagccggtgacggcagtgaccaaacagcctaaatccgaagctggggataccagcctctaa

SEQ ID NO: 1082 - DNA, 1053 bp, Homo sapiens
atgtcaaatattacagatccacagatgtgggattttgatgatctaaatttcactggcatgccacctgcagatgaagattacagcccctgtatgctagaaactgagacactcaacaagtatgttgtgatcatcgcctatgccctagtgttcctgctgagcctgctgggaaactccctggtgatgctggtcatcttatacagcagggtcggccgctccgtcactgatgtctacctgctgaacctggccttggccgacctactctttgccctgaccttgcccatctgggccgcctccaaggtgaatggctggatttttggcacattcctgtgcaaggtggtctcactcctgaaggaagtcaacttctacagtggcatcctgctgttggcctgcatcagtgtggaccgttacctggccattgtccatgccacacgcacactgacccagaagcgtcacttggtcaagtttgtttgtcttggctgctggggactgtctatgaatctgtccctgcccttcttccttttccgccaggcttaccatccaaacaattccagtccagtttgctatgaggtcctgggaaatgacacagcaaaatggcggatggtgttgcggatcctgcctcacacctttggcttcatcgtgccgctgtttgtcatgctgttctgctatggattcaccctgcgtacactgtttaaggcccacatggggcagaagcaccgagccatgagggtcatctttgctgtcgtcctcatcttcctgctttgctggctgccctacaacctggtcctgctggcagacaccctcatgaggacccaggtgatccaggagagctgtgagcgccgcaacaacatcggccgggccctggatgccactgagattctgggatttctccatagctgcctcaaccccatcatctacgccttcatcggccaaaattttcgccatggattcctcaagatcctggctatgcatggcctggtcagcaaggagttcttggcacgtcatcgtgttacctcctacacttcttcgtctgtcaatgtctcttccaacctctga

SEQ ID NO: 1083 - DNA, 1083 bp, Homo sapiens
atggaagattttaacatggagagtgacagctttgaagatttctggaaaggtgaagatcttagtaattacagttacagctctaccctgcccccttttctactagatgccgccccatgtgaaccagaatccctggaaatcaacaagtattttgtggtcattatctatgccctggtattcctgctgagcctgctgggaaactccctcgtgatgctggtcatcttatacagcagggtcggccgctccgtcactgatgtctacctgctgaacctagccttggccgacctactctttgccctgaccttgcccatctgggccgcctccaaggtgaatggctggatttttggcacattcctgtgcaaggtggtctcactcctgaaggaagtcaacttctatagtggcatcctgctactggcctgcatcagtgtggaccgttacctggccattgtccatgccacacgcacactgacccagaagcgctacttggtcaaattcatatgtctcagcatctggggtctgtccttgctcctggccctgcctgtcttacttttccgaaggaccgtctactcatccaatgttagcccagcctgctatgaggacatgggcaacaatacagcaaactggcggatgctgttacggatcctgccccagtcctttggcttcatcgtgccactgctgatcatgctgttctgctacggattcaccctgcgtacgctgtttaaggcccacatggggcagaagcaccgggccatgcgggtcatctttgctgtcgtcctcatcttcctgctctgctggctgccctacaacctggtcctgctggcagacaccctcatgaggacccaggtgatccaggagacctgtgagcgccgcaatcacatcgaccgggctctggatgccaccgagattctgggcatccttcacagctgcctcaaccccctcatctacgccttcattggccagaagtttcgccatggactcctcaagattctagctatacatggcttgatcagcaaggactccctgcccaaagacagcaggccttcctttgttggctcttcttcagggcacacttccactactctctaa

SEQ ID NO: 1084 - DNA, 2838 bp, Homo sapiens
actcactatagggctcgagcggccgcccgggcaggtgaacttactacatcagaactcctgctgaggtataagaggatacgtctaataactcaattgctgtaaacctatgattgtttttctggtttttaaacatctcttcagcctcagattgattacaatgttctttctacttcatttcatcgttctgatcaatgtcaaagattttgcactgactcaaggtagcatgatcactccttcatgccaaaaaggatattttccctgtgggaatcttaccaagtgcttaccccgagcttttcactgtgatggcaaggatgactgtgggaacggggcggacgaagagaactgtggtgacactagtggatgggcgaccatatttggcacagtgcatggaaatgctaacagcgtggccttaacacaggagtgctttctaaaacagtatccacaatgctgtgactgcaaagaaactgaattggaatgtgtaaatggtgacttaaagtctgtgccgatgatttctaacaatgtgacattactgtctcttaagaaaaacaaaatccacagtcttccagataaagttttcatcaaatacacaaaacttaaaaagatatttcttcagcataattgcattagacacatatccaggaaagcattttttggattatgtaatctgcaaatattatatctcaaccacaactgcatcacaaccctcagacctggaatattcaaagacttacatcagctaacttggctaattctagatgacaatccaataaccagaatttcacagcgcttgtttacgggattaaattccttgtttttcctgtctatggttaataactacttagaagctcttcccaagcagatgtgtgcccaaatgcctcaactcaactgggtggatttggaaggcaatagaataaagtatctcacaaattctacgtttctgtcgtgcgattcgctcacagtgctgtttctgcctagaaatcaaattggttttgttccagagaagacattttcttcattaaaaaatttaggagaactggatctgtctagcaatacgataacggagctatcacctcacctttttaaagacttgaagcttctacaaaagctgaacctgtcatccaatcctcttatgtatcttcacaagaaccagtttgaaagtcttaaacaacttcagtctctagacctggaaaggatagagattccaaatataaacacacgaatgtttcaacccatgaagaatctttctcacatttatttcaaaaactttcgatactgctcctatgctccccatgtccgaatatgtatgcccttgacggacggcatttcttcatttgaggacctcttggctaacaatatcctcagaatatttgtctgggttatagctttcattacctgctttggaaatctttttgtcattggcatgagatctttcattaaagctgaaaatacaactcacgctatgtccatcaaaatcctttgttgtgctgattgcctgatgggtgtttacttgttctttgttggcattttcgatataaaataccgagggcagtatcagaagtatgccttgctgtggatggagagcgtgcagtgccgcctcatggggttcctggccatgctgtccaccgaagtctctgttctgctactgacctacttgactttggagaagttcctggtcattgtcttccccttcagtaacattcgacctggaaaacggcagacctcagtcatcctcatttgcatctggatggcgggatttttaatagctgtaattccattttggaataaggattattttggaaacttttatgggaaaaatggagtatgtttcccactttattatgaccaaacagaagatattggaagcaaagggtattctcttggaattttcctaggtgtgaacttgctggcttttctcatcattgtgttttcctatattactatgttctgttccattcaaaaaaccgccttgcagaccacagaagtaaggaattgttttggaagagaggtggctgttgcaaatcgtttcttttttatagtgttctctgatgccatctgctggattcctgtatttgtagttaaaatcctttccctcttccgggtggaaataccagacacaatgacttcctggatagtgatttttttccttccagttaacagtgctttgaatccaatcctctatactctcacaaccaacttttttaaggacaagttgaaacagctgctgcacaaacatcagaggaaatcaattttcaaaattaaaaaaaaaagtttatctacatccattgtgtggatagaggactcctcttccctgaaacttggggttttgaacaaaataacacttggagacagtataatgaaaccagtttcctagcaatcattttggatcactggactttcagtggactacctaaaacaggggacagcttttggaagatgacatctgcaatgcttttcatctttaccaacggcaagcctttctgcacagagagcacagcagaatggctcctgtcactgcattccaatggcagctgtactatctaccaaccatgctgaggacagcaccaaaggttcctctcctcaccccacatgcctgaaaagcacatgtgaattcgtgtatagtgggctgaggtgcagctgatctctagctaatcaacacaacccaccaacaaatgaccacaggttggcactgtgtggtctttcacatcgggttgcactgtccatgaaatagaaacactcacaacatctgattccagtgtggccataataacagaaatctaacaactctttccttgccttttcaatatcaaataaaaccatcagcatcctgctggattgata

SEQ ID NO: 1085 - DNA, 2995 bp, Homo sapiens
ggccgcccatgaagcagcggttctcggcgctgcagctgctgaagctgctgctgctgctgcagccgccgctgccacgagcgctgcgcgaggcgctctgccctgagccctgcaactgcgtgcccgacggcgccctgcgctgccccggccccacggccggtctcactcgactatcacttgcctacctccctgtcaaagtgatcccatctcaagctttcagaggacttaatgaggtcataaaaattgaaatctctcagattgattccctggaaaggatagaagctaatgcctttgacaacctcctcaatttgtctgaaatactgatccagaacaccaaaaatctgagatacattgagcccggagcatttataaatcttcccggattaaaatacttgagcatctgtaacacaggcatcagaaagtttccagatgttacgaaggtcttctcctctgaatcaaatttcattctggaaatttgtgataacttacacataaccaccataccaggaaatgcttttcaagggatgaataatgaatctgtaacactcaaactatatggaaatggatttgaagaagtacaaagtcatgcattcaatgggacgacactgacttcactggagctaaaggaaaacgtacatctggagaagatgcacaatggagccttccgtggggccacagggccgaaaaccttggatatttcttccaccaaattgcaggccctgccgagctatggcctagagtccattcagaggctaattgccacgtcatcctattctctaaaaaaattgccatcaagagaaacatttgtcaatctcctggaggccacgttgacttaccccagccactgctgtgcttttagaaacttgccaacaaaagaacagaatttttcacattccatttctgaaaacttttccaaacaatgtgaaagcacagtaaggaaagtgagtaacaaaacactttattcttccatgcttgctgagagtgaactgagtggctgggactatgaatatggtttctgcttacccaagacaccccgatgtgctcctgaaccagatgcttttaatccctgtgaagacattatgggctatgacttccttagggtcctgatttggctgattaatattctagccatcatgggaaacatgactgttctttttgttctcctgacaagtcgttacaaacttacagtgcctcgttttctcatgtgcaatctctcctttgcagacttttgcatggggctctatctgctgctcatagcctcagttgattcccaaaccaagggccagtactataaccatgccatagactggcagacagggagtgggtgcagcactgctggctttttcactgtattcgcaagtgaactttctgtctacaccctcaccgtcatcactctagaaagatggcacaccatcacctatgctattcacctggaccaaaagctgcgattaagacatgccattctgattatgcttggaggatggctcttttcttctctaattgctatgttgccccttgtcggtgtcagcaattacatgaaggtcagtatttgcttccccatggatgtggaaaccactctctcacaagtctatatattaaccatcctgattctcaatgtggtggccttcttcataatttgtgcttgctacattaaaatttattttgcagttcgaaacccagaattaatggctaccaataaagatacaaagattgctaagaaaatggcaatcctcatcttcaccgatttcacctgcatggcacctatctctttttttgccatctcagctgccttcaaagtacctcttatcacagtaaccaactctaaagttttactggttcttttttatcccatcaattcttgtgccaatccatttctgtatgcaatattcactaagacattccaaagagatttctttcttttgctgagcaaatttggctgctgtaaacgtcgggctgaactttatagaaggaaagatttttcagcttacacctccaactgcaaaaatggcttcactggatcaaataagccttctcaatccaccttgaagttgtccacattgcactgtcaaggtacagctctcctagacaagactcgctacacagagtgttaactgttacatcagtaactgcattattgaattgttcttaaacctgtaaaaaaaaattacctgtaccagtaattttaacataaagggttggatttaggaaattatttatttttaggtacattaggcaagagacctctacctagtagaaagtgtagtctatgaccactgccacacgtaaaaactatttgtcattgttacatggcataaatatgaagttgagagtgtttagaaatttttatagaaattttgacacagtaattttgtttgatgaatcttttaaaaaacagaggaggtattttgcatatctttttttcattttcgtaatttgtattgcattctataaaaatattagttcataacagatcagaaatttaaaataaggggctttttcctcaggtagtttgaaaaacacactctagagatgcactgttcaattcggtacgcactagccacatgtggctaaattaaaattaaataaaatgagaaatgtagtttctcagttgcactacgtttcaagttctcaatggctacgtcaagttctcaatggctacgtgtgactagtgcttaccatactggacagcacagacacagaatattttcatcaccacagaaagttctatctgttctattatagagacttttatgtatgccctatctggattctacttatttataatttaaggtaaacatctgaaagcacatttcagcctatttgcttagtgaaacattaagctgtagactgtaaactcctcgtgagtaggaaccctgtctcagtgcattttgttttcctgcttcctacctcaagatcttggcaatggtacactacaaatgtgctgagttagaattactctgaagttatgaaacatataatgaaaacaatttttccggcc

SEQ ID NO: 1086 - DNA, 1059 bp, Homo sapiens
atgaacactacatcttctgcagcacccccctcactaggtgtagagttcatctctctgctggctatcatcctgctgtcagtggcgctggctgtggggcttcccggcaacagctttgtggtgtggagtatcctgaaaaggatgcagaagcgctctgtcactgccctgatggtgctgaacctggccctggccgacctggccgtattgctcactgctccctttttccttcacttcctggcccaaggcacctggagttttggactggctggttgccgcctgtgtcactatgtctgcggagtcagcatgtacgccagcgtcctgcttatcacggccatgagtctagaccgctcactggcggtggcccgcccctttgtgtcccagaagctacgcaccaaggcgatggcccggcgggtgctggcaggcatctgggtgttgtcctttctgctggccacacccgtcctcgcgtaccgcacagtagtgccctggaaaacgaacatgagcctgtgcttcccgcggtaccccagcgaagggcaccgggccttccatctaatcttcgaggctgtcacgggcttcctgctgcccttcctggctgtggtggccagctactcggacatagggcgtcggctacaggcccggcgcttccgccgcagccgccgcaccggccgcctggtggtgctcatcatcctgaccttcgccgccttctggctgccctaccacgtggtgaacctggctgaggcgggccgcgcgctggccggccaggccgccgggttagggctcgtggggaagcggctgagcctggcccgcaacgtgctcatcgcactcgccttcctgagcagcagcgtgaaccccgtgctgtacgcgtgcgccggcggcggcctgctgcgctcggcgggcgtgggcttcgtcgccaagctgctggagggcacgggttccgaggcgtccagcacgcgccgcgggggcagcctgggccagaccgctaggagcggccccgccgctctggagcccggcccttccgagagcctcactgcctccagccctctcaagttaaacgaactgaactag

SEQ ID NO: 1087 - DNA, 1170 bp, Homo sapiens
atggcaccttctcatcgggcatcacaggtggggttttgccccacccctgaacgccctctgtggcgccttccacccacctgtaggcccagaaggatgtcggtctgctaccgtcccccagggaacgagacactgctgagctggaagacttcgcgggccacaggcacagccttcctgctgctggcggcgctgctggggctgcctggcaacggcttcgtggtgtggagcttggcgggctggcggcctgcacgggggcgaccgctggcggccacgcttgtgctgcacctggcgctggccgacggcgcggtgctgctgctcacgccgctctttgtggccttcctgacccggcaggcctggccgctgggccaggcgggctgcaaggcggtgtactacgtgtgcgcgctcagcatgtacgccagcgtgctgctcaccggcctgctcagcctgcagcgctgcctcgcagtcacccgccccttcctggcgcctcggctgcgcagcccggccctggcccgccgcctgctgctggcggtctggctggccgccctgttgctcgccgtcccggccgccgtctaccgccacctgtggagggaccgcgtatgccagctgtgccacccgtcgccggtccacgccgccgcccacctgagcctggagactctgaccgctttcgtgcttcctttcgggctgatgctcggctgctacagcgtgacgctggcacggctgcggggcgcccgctggggctccgggcggcacggggcgcgggtgggccggctggtgagcgccatcgtgcttgccttcggcttgctctgggccccctaccacgcagtcaaccttctgcaggcggtcgcagcgctggctccaccggaaggggccttggcgaagctgggcggagccggccaggcggcgcgagcgggaactacggccttggccttcttcagttctagcgtcaacccggtgctctacgtcttcaccgctggagatctgctgccccgggcaggtccccgtttcctcacgcggctcttcgaaggctctggggaggcccgagggggcggccgctctagggaagggaccatggagctccgaactacccctcagctgaaagtggtggggcagggccgcggcaatggagacccggggggtgggatggagaaggacggtccggaatgggacctttga

SEQ ID NO: 1088 - DNA, 978 bp, Homo sapiens
atggatgggtcaaacgtgacatcatttgttgttgaggaacccacgaacatctcaactggcaggaacgcctcagtcgggaatgcacatcggcaaatccccatcgtgcactgggtcattatgagcatctccccagtggggtttgttgagaatgggattctcctctggttcctgtgcttccggatgagaagaaatcccttcactgtctacatcacccacctgtctatcgcagacatctcactgctcttctgtattttcatcttgtctatcgactatgctttagattatgagctttcttctggccattactacacaattgtcacattatcagtgacttttctgtttggctacaacacgggcctctatctgctgacggccattagtgtggagaggtgcctgtcagtcctttaccccatctggtaccgatgccatcgccccaagtaccagtcggcattggtctgtgcccttctgtgggctctttcttgcttggtgaccaccatggagtatgtcatgtgcatcgacagagaagaagagagtcactctcggaatgactgccgagcagtcatcatctttatagccatcctgagcttcctggtcttcacgcccctcatgctggtgtccagcaccatcttggtcgtgaagatccggaagaacacgtgggcttcccattcctccaagctttacatagtcatcatggtcaccatcattatattcctcatcttcgctatgcccatgagactcctttacctgctgtactatgagtattggtcgacctttgggaacctacaccacatttccctgctcttctccacaatcaacagtagcgccaaccctttcatttacttctttgtgggaagcagtaagaagaagagattcaaggagtccttaaaagttgttctgaccagggctttcaaagatgaaatgcaacctcggcgccagaaagacaattgtaatacggtcacagttgagactgtcgtctaa

SEQ ID NO: 1089 - DNA, 1270 bp, Homo sapiens
ggagagggtgtgagggcagatctgggggtgcccagatggaaggaggcaggcatgggggacacccaaggccccctggcagcaccatgaactaagcaggacacctggaggggaagaactgtggggacctggaggcctccaacgactccttcctgcttcctggacaggactatggctgtgcagggatcccagagaagacttctgggctccctcaactccacccccacagccatcccccagctggggctggctgccaaccagacaggagcccggtgcctggaggtgtccatctctgacgggctcttcctcagcctggggctggtgagcttggtggagaacgcgctggtggtggccaccatcgccaagaaccggaacctgcactcacccatgtactgcttcatctgctgcctggccttgtcggacctgctggtgagcgggagcaacgtgctggagacggccgtcatcctcctgctggaggccggtgcactggtggcccgggctgcggtgctgcagcagctggacaatgtcattgacgtgatcacctgcagctccatgctgtccagcctctgcttcctgggcgccatcgccgtggaccgctacatctccatcttctacgcactgcgctaccacagcatcgtgaccctgccgcgggcgcggcaagccgttgcggccatctgggtggccagtgtcgtcttcagcacgctcttcatcgcctactacgaccacgtggccgtcctgctgtgcctcgtggtcttcttcctggctatgctggtgctcatggccgtgctgtacgtccacatgctggcccgggcctgccagcacgcccagggcatcgcccggctccacaagaggcagcgcccggtccaccagggctttggccttaaaggcgctgtcaccctcaccatcctgctgggcattttcttcctctgctggggccccttcttcctgcatctcacactcatcgtcctctgccccgagcaccccacgtgcggctgcatcttcaagaacttcaacctctttctcgccctcatcatctgcaatgccatcatcgaccccctcatctacgccttccacagccaggagctccgcaggacgctcaaggaggtgctgacatgctcctggtgagcgcggtgcacgcgctttaagtgtgctgggcagagggaggtggtgatattgtgtggtctggttcctgtgtgaccctgggcagttccttacctccctggtccccgtttgtcaaagaggatggactaaatgatctctgaaagtgttgaag

SEQ ID NO: 1090 - DNA, 894 bp, Homo sapiens
atgaagcacattatcaactcgtatgaaaacatcaacaacacagcaagaaataattccgactgtcctcgtgtggttttgccggaggagatatttttcacaatttccattgttggagttttggagaatctgatcgtcctgctggctgtgttcaagaataagaatctccaggcacccatgtactttttcatctgtagcttggccatatctgatatgctgggcagcctatataagatcttggaaaatatcctgatcatattgagaaacatgggctatctcaagccacgtggcagttttgaaaccacagccgatgacatcatcgactccctgtttgtcctctccctgcttggctccatcttcagcctgtctgtgattgctgcggaccgctacatcaccatcttccacgcactgcggtaccacagcatcgtgaccatgcgccgcactgtggtggtgcttacggtcatctggacgttctgcacggggactggcatcaccatggtgatcttctcccatcatgtgcccacagtgatcaccttcacgtcgctgttcccgctgatgctggtcttcatcctgtgcctctatgtgcacatgttcctgctggctcgatcccacaccaggaagatctccaccctccccagagccaacatgaaaggggccatcacactgaccatcctgctcggggtcttcatcttctgctgggccccctttgtgcttcatgtcctcttgatgacattctgcccaagtaacccctactgcgcctgctacatgtctctcttccaggtgaacggcatgttgatcatgtgcaatgccgtcattgaccccttcatatatgccttccggagcccagagctcagggacgcattcaaaaagatgatcttctgcagcaggtactggtag

SEQ ID NO: 1091 - DNA, 1083 bp, Homo sapiens
atgagcatccaaaagaagtatctggagggagattttgtctttcctgtgagcagcagcagcttcctacggaccctgctggagccccagctcggatcagcccttctgacagcaatgaatgcttcgtgctgcctgccctctgttcagccaacactgcctaatggctcggagcacctccaagcccctttcttcagcaaccagagcagcagcgccttctgtgagcaggtcttcatcaagcccgagattttcctgtctctgggcatcgtcagtctgctggaaaacatcctggttatcctggccgtggtcaggaacggcaacctgcactccccgatgtacttctttctctgcagcctggcggtggccgacatgctggtaagtgtgtccaatgccctggagaccatcatgatcgccatcgtccacagcgactacctgaccttcgaggaccagtttatccagcacatggacaacatcttcgactccatgatctgcatctccctggtggcctccatctgcaacctcctggccatcgccgtcgacaggtacgtcaccatcttttacgcgctccgctaccacagcatcatgaccgtgaggaaggccctcaccttgatcgtggccatctgggtctgctgcggcgtctgtggcgtggtgttcatcgtctactcggagagcaaaatggtcattgtgtgcctcatcaccatgttcttcgccatgatgctcctcatgggcaccctctacgtgcacatgttcctctttgcgcggctgcacgtcaagcgcatagcagcactgccacctgccgacggggtggccccacagcaacactcatgcatgaagggggcagtcaccatcaccattctcctgggcgtgttcatcttctgctgggcccccttcttcctccacctggtcctcatcatcacctgccccaccaacccctactgcatctgctacactgcccacttcaacacctacctggtcctcatcatgtgcaactccgtcatcgacccactcatctacgctttccggagcctggaattgcgcaacacctttagggagattctctgtggctgcaacggcatgaacttgggatag

SEQ ID NO: 1092 - DNA, 999 bp, Homo sapiens
atggtgaactccacccaccgtgggatgcacacttctctgcacctctggaaccgcagcagttacagactgcacagcaatgccagtgagtcccttggaaaaggctactctgatggagggtgctacgagcaactttttgtctctcctgaggtgtttgtgactctgggtgtcatcagcttgttggagaatatcttagtgattgtggcaatagccaagaacaagaatctgcattcacccatgtactttttcatctgcagcttggctgtggctgatatgctggtgagcgtttcaaatggatcagaaaccattatcatcaccctattaaacagtacagatacggatgcacagagtttcacagtgaatattgataatgtcattgactcggtgatctgtagctccttgcttgcatccatttgcagcctgctttcaattgcagtggacaggtactttactatcttctatgctctccagtaccataacattatgacagttaagcgggttgggatcatcataagttgtatctgggcagcttgcacggtttcaggcattttgttcatcatttactcagatagtagtgctgtcatcatctgcctcatcaccatgttcttcaccatgctggctctcatggcttctctctatgtccacatgttcctgatggccaggcttcacattaagaggattgctgtcctccccggcactggtgccatccgccaaggtgccaatatgaagggagcgattaccttgaccatcctgattggcgtctttgttgtctgctgggccccattcttcctccacttaatattctacatctcttgtcctcagaatccatattgtgtgtgcttcatgtctcactttaacttgtatctcatactgatcatgtgtaattcaatcatcgatcctctgatttatgcactccggagtcaagaactgaggaaaaccttcaaagagatcatctgttgctatcccctgggaggcctttgtgacttgtctagcagatattaa

SEQ ID NO: 1093 - DNA, 978 bp, Homo sapiens
atgaattcctcatttcacctgcatttcttggatctcaacctgaatgccacagagggcaacctttcaggacccaatgtcaaaaacaagtcttcaccatgtgaagacatgggcattgctgtggaggtgtttctcactctgggtgtcatcagcctcttggagaacatcttggtcataggggccatagtgaagaacaaaaacctgcactcccccatgtacttcttcgtgtgcagcctggcagtggcggacatgctggtgagcatgtccagtgcctgggagaccatcaccatctacctactcaacaacaagcacctagtgatagcagacgcctttgtgcgccacattgacaatgtgtttgactccatgatctgcatttccgtggtggcatccatgtgcagcttactggccattgcagtggataggtacgtcaccatcttctacgccctgcgctaccaccacatcatgacggcgaggcgctcaggggccatcatcgccggcatctgggctttctgcacgggctgcggcattgtcttcatcctgtactcagaatccacctacgtcatcctgtgcctcatctccatgttcttcgctatgctgttcctcctggtgtctctgtacatacacatgttcctcctggcgcggactcacgtcaagcggatcgcggctctgcccggggccagctctgcgcggcagaggaccagcatgcagggcgcggtcaccgtcaccatgctgctgggcgtgtttaccgtgtgctgggccccgttcttccttcatctcactttaatgctttcttgccctcagaacctctactgctctcgcttcatgtctcacttcaatatgtacctcatactcatcatgtgtaattccgtgatggaccctctcatatatgccttccgcagccaagagatgcggaagacctttaaggagattatttgctgccgtggtttcaggatcgcctgcagctttcccagaagggattaa

SEQ ID NO: 1094 - DNA, 963 bp, Homo sapiens
atgaaccagactttgaatagcagtgggaccgtggagtcagccctaaactattccagagggagcacagtgcacacggcctacctggtgctgagctccctggccatgttcacctgcctgtgcgggatggcaggcaacagcatggtgatctggctgctgggctttcgaatgcacaggaaccccttctgcatctatatcctcaacctggcggcagccgacctcctcttcctcttcagcatggcttccacgctcagcctggaaacccagcccctggtcaataccactgacaaggtccacgagctgatgaagagactgatgtactttgcctacacagtgggcctgagcctgctgacggccatcagcacccagcgctgtctctctgtcctcttccctatctggttcaagtgtcaccggcccaggcacctgtcagcctgggtgtgtggcctgctgtggacactctgtctcctgatgaacgggttgacctcttccttctgcagcaagttcttgaaattcaatgaagatcggtgcttcagggtggacatggtccaggccgccctcatcatgggggtcttaaccccagtgatgactctgtccagcctgaccctctttgtctgggtgcggaggagctcccagcagtggcggcggcagcccacacggctgttcgtggtggtcctggcctctgtcctggtgttcctcatctgttccctgcctctgagcatctactggtttgtgctctactggttgagcctgccgcccgagatgcaggtcctgtgcttcagcttgtcacgcctctcctcgtccgtaagcagcagcgccaaccccgtcatctacttcctggtgggcagccggaggagccacaggctgcccaccaggtccctggggactgtgctccaacaggcgcttcgcgaggagcccgagctggaaggtggggagacgcccaccgtgggcaccaatgagatgggggct

SEQ ID NO: 1095 - DNA, 936 bp, Homo sapiens
atgatggagcccagagaagctggacagcacgtgggggccgccaacagcgcccaggaggatgtggccttcaacctcatcatcctgtccctcaccgaggggctcggcctcggtgggctgctggggaatggggcagtcctctggctgctcagctccaatgtctacagaaaccccttcgccatctacctcctggacgtggcctgcgcggatctcatcttccttggctgccacatggtggccatcgtccccgacttgctgcaaggccggctggacttcccgggcttcgtgcagaccagcctggcaacgctgcgcttcttctgctacatcgtgggcctgagtctcctggcggccgtcagcgtggagcagtgcctggccgccctcttcccagcctggtactcgtgccgccgcccacgccacctgaccacctgtgtgtgcgccctcacctgggccctctgcctgctgctgcacctgctgctcagcagcgcctgcacccagttcttcggggagcccagccgccacttgtgccggacgctgtggctggtggcagcggtgctgctggctctgctgtgttgcaccatgtgtggggccagccttatgctgctgctgcgggtggagcgaggcccccagcggcccccaccccggggcttccctgggctcatcctcctcaccgtcctcctcttcctcttctgcggcctgcccttcggcatctactggctgtcccggaacctgctctggtacatcccccactacttctaccacttcagcttcctcatggccgccgtgcactgcgcggccaagcccgtcgtctacttctgcctgggcagtgcccagggccgcaggctgcccctccggctggtcctccagcgagcgctgggagacgaggctgagctgggggccgtcagggagacctcccgccggggcctggtggacatagcagcc

SEQ ID NO: 1096 - DNA, 1029 bp, Homo sapiens
atggctggaaactgctcctgggaggcccatcccggcaacaggaacaagatgtgccctggcctgagcgaggccccggaactctacagccggggcttcctgaccatcgagcagatcgcgatgctgccgcctccggccgtcatgaactacatcttcctgctcctctgcctgtgtggcctggtgggcaacgggctggtcctctggtttttcggcttctccatcaagaggaaccccttctccatctacttcctgcacctggccagcgccgatgtgggctacctcttcagcaaggcggtgttctccatcctgaacacggggggcttcctgggcacgtttgccgactacatccgcagcgtgtgccgggtcctggggctctgcatgttccttaccggcgtgagcctcctgccggccgtcagcgccgagcgctgcgcctcggtcatcttccccgcctggtactggcgccggcggcccaagcgcctgtcggccgtggtgtgcgccctgctgtgggtcctgtccctcctggtcacctgcctgcacaactacttctgcgtgttcctgggccgcggggcccccggcgcggcctgcaggcacatggacatcttcctgggcatcctcctgttcctgctctgctgcccgctcatggtgctgccctgcctggccctcatcctgcacgtggagtgccgggcccgacggcgccagcgctctgccaagctcaaccacgtcatcctggccatggtctccgtcttcctggtgtcctccatctacttagggatcgactggttcctcttctgggtcttccagatcccggcccccttccccgagtacgtcactgacctgtgcatctgcatcaacagcagcgccaagcccatcgtctacttcctggccgggagggacaagtcgcagcggctgtgggagccgctcagggtggtcttccagcgggccctgcgggacggcgctgagctgggggaggccgggggcagcacgcccaacacagtcaccatggagatgcagtgtcccccggggaacgcctcc

SEQ ID NO: 1097 - DNA, 1053 bp, Homo sapiens
atgcagggcaacggcagcgcgctgcccaacgcctcccagcccgtgctccgcggggacggcgcgcggccctcgtggctggcgtccgccctagcctgcgtcctcatcttcaccatcgtggtggacatcctgggcaacctcctggtcatcctgtcggtgtatcggaacaagaagctcaggaacgcaggaaacatctttgtggtgagcttagcggtggcagacctggtggtggccatttatccgtacccgttggtgctgatgtcgatatttaacaacgggtggaacctgggctatctgcactgccaagtcagtgggttcctgatgggcctgagcgtcatcggctccatattcaacatcaccggcatcgccatcaaccgctactgctacatctgccacagtctcaagtacgacaaactgtacagcagcaagaactccctctgctacgtgctcctcatatggctcctgacgctggcggccgtcctgcccaacctccgtgcagggactctccagtacgacccgaggatctactcgtgcaccttcgcccagtccgtcagctccgcctacaccatcgccgtggtggttttccacttcctcgtccccatgatcatagtcatcttctgttacctgagaatatggatcctggttctccaggtcagacagagggtgaaacctgaccgcaaacccaaactgaaaccacaggacttcaggaattttgtcaccatgtttgtggtttttgtcctctttgccatttgctgggctcctctgaacttcattggcctggccgtggcctctgaccccgccagcatggtgcctaggatcccagagtggctgtttgtggccagttactacatggcgtatttcaacagctgcctcaatgccattatatacgggctactgaaccaaaatttcaggaaggaatacaggagaattatagtctcgctctgtacagccagggtgttctttgtggacagctctaacgacgtggccgatagggttaaatggaaaccgtctccactgatgaccaacaataatgtagtaaaggtggactccgtttaa

SEQ ID NO: 1098 - DNA, 867 bp, Homo sapiens
atgtttgggctgttcggcctctggagaaccttcgacagtgtggtcttctacctgacgctgatcgtgggcctcgggggaccggtaggtaacgggctggtgctctggaacctcggcttccgcatcaagaagggccccttctccatctacctgctgcacctggccgccgccgacttcctgttcctctcctgccgtgtgggcttctccgtggctcaggctgccctgggcgcccaggacacactctacttcgtgctcaccttcctgtggttcgcggtggggctctggctgctggcggccttcagcgtggagcgctgcctctccgacctcttccccgcctgctaccagggctgccggcccagacacgcctcggccgtcctctgcgccctggtgtggaccccgaccctgccggccgtgccgctgcccgccaacgcctgcggcctgctgcgcaacagcgcgtgccccctggtctgcccgcgctaccacgtggccagcgtcacctggttcctggtgctggcccgcgtcgcctggacggctggcgtggtcctctttgtctgggtgacctgctgctccactcgcccgcggcccaggctctacggcatcgtcctgggcgcgctgctcctgctcttcttctgtggcctgccctcggtcttctactggagcctgcagcccctgctgaacttcctgctgcccgtgttttccccgctggccacgctgctggcctgcgtcaacagcagctccaagcccctcatctactcggggttgggccgacagcccgggaagcgggagccgctgaggtcggtactgcggagggccctgggggagggcgccgagctgggtgccaggggacagtccctgcccatgggtctccta

SEQ ID NO: 1099 - DNA, 1173 bp, Homo sapiens
atgccctctaagtctctttccaacctctcggtgaccaccggcgcgaatgagagcggttccgttcccgaggggtgggaaagggatttcctgccggcctcggacgggaccaccacggagttggtgatccgctgtgtgatcccgtccctctacctgctcatcatcaccgtgggcttgctgggcaacatcatgctggtgaagatcttcatcaccaacagcgccatgaggagcgtccccaacatcttcatctctaacctggcggccggggacttgctgctgctgctcacctgcgtcccggtggacgcctcgcgctacttcttcgacgagtggatgtttggcaaggtgggctgcaaactgatccctgtcatccagctcacttccgtgggggtttccgtgttcactctcactgccctcagcgccgacaggtacagagccatcgttaaccccatggacatgcagacgtcaggggcattgctgcggacctgtgtgaaggccatgggtatctgggtggtctccgtgttgctggcagttcccgaagcggtgttttcagaagtggctcgcatcagtagcttggataatagcagcttcacagcatgtatcccataccctcaaacagatgaattacatccaaagattcattcagtgctcattttcttggtctatttcctcataccacttgctattattagcatttattattatcatattgcaaagaccttaattaaaagcgcacacaatcttcctggagaatacaatgaacataccaaaaaacagatggaaacacggaaacgcctggctaaaattgtgcttgtctttgtgggctgtttcatcttctgttggtttccaaaccacatcctttacatgtatcggtctttcaactataatgagattgatccatctctaggccacatgattgtcaccttagttgcccgggttctcagttttggcaattcttgtgtcaacccatttgctctttacctactcagtgaaagcttcaggaggcatttcaacagccaactctgctgtgggaggaagtcctatcaagagagaggaaccagctacctactcagctcttcagcggtgcgtatgacatctctgaaaagcaatgctaagaacatggtgaccaattctgttttactaaatgggcacagcatgaagcaggaaatggcaatgtga

SEQ ID NO: 1100 - DNA, 1248 bp, Homo sapiens
atgtcagggatggaaaaacttcagaatgcttcctggatctaccagcagaaactagaagatccgttccagaaacacctgaacagcaccgaggagtatctggccttcctctgcggacctcggcgcagccacttcttcctccccgtgtctgtggtgtatgtgccaatttttgtggtgggggtcattggcaatgtcctggtgtgcctggtgattctgcagcaccaggctatgaagacgcccaccaactactacctcttcagcctggcggtctctgacctcctggtcctgctccttggaatgcccctggaggtctatgagatgtggcgcaactaccctttcttgttcgggcccgtgggctgctacttcaagacggccctctttgagaccgtgtgcttcgcctccatcctcagcatcaccaccgtcagcgtggagcgctacgtggccatcctacacccgttccgcgccaaactgcagagcacccggcgccgggccctcaggatcctcggcatcgtctggggcttctccgtgctcttctccctgcccaacaccagcatccatggcatcaagttccactacttccccaatgggtccctggtcccaggttcggccacctgtacggtcatcaagcccatgtggatctacaatttcatcatccaggtcacctccttcctattctacctcctccccatgactgtcatcagtgtcctctactacctcatggcactcagactaaagaaagacaaatctcttgaggcagatgaagggaatgcaaatattcaaagaccctgcagaaaatcagtcaacaagatgctgtttgtcttggtcttagtgtttgctatctgttgggccccgttccacattgaccgactcttcttcagctttgtggaggagtggagtgaatccctggctgctgtgttcaacctcgtccatgtggtgtcaggtgtcttcttctacctgagctcagctgtcaaccccattatctataacctactgtctcgccgcttccaggcagcattccagaatgtgatctcttctttccacaaacagtggcactcccagcatgacccacagttgccacctgcccagcggaacatcttcctgacagaatgccactttgtggagctgaccgaagatataggtccccaattcccatgtcagtcatccatgcacaactctcacctcccaacagccctctctagtgaacagatgtcaagaacaaactatcaaagcttccactttaacaaaacctga

SEQ ID NO: 1101 - DNA, 1155 bp, Homo sapiens
atgaattcaacattattttcccaggttgaaaatcattcagtccactctaatttctcagagaagaatgcccagcttctggcttttgaaaatgatgattgtcatctgcccttggccatgatatttaccttagctcttgcttatggagctgtgatcattcttggtgtctctggaaacctggccttgatcataatcatcttgaaacaaaaggagatgagaaatgttaccaacatcctgattgtgaacctttccttctcagacttgcttgttgccatcatgtgtctccctttgacatttgtctacacattaatggaccactgggtctttggtgaggcgatgtgtaagttgaatccttttgtgcaatgtgtttcaatcactgtgtccattttctctctggttctcattgctgtggaacgacatcagctgataatcaaccctcgaggttggagaccaaataatagacatgcttatgtaggtattgctgtgatttgggtccttgctgtggcttcttctttgcctttcctgatctaccaagtaatgactgatgagccgttccaaaatgtaacacttgatgcgtacaaagacaaatacgtgtgctttgatcaatttccatcggactctcataggttgtcttataccactctcctcttggtgctgcagtattttggtccactttgttttatatttatttgctacttcaagatatatatacgcctaaaaaggagaaacaacatgatggacaagatgagagacaataagtacaggtccagtgaaaccaaaagaatcaatatcatgctgctctccattgtggtagcatttgcagtctgctggctccctcttaccatctttaacactgtgtttgattggaatcatcagatcattgctacctgcaaccacaatctgttattcctgctctgccacctcacagcaatgatatccacttgtgtcaaccccatattttatgggttcctgaacaaaaacttccagagagacttgcagttcttcttcaacttttgtgatttccggtctcgggatgatgattatgaaacaatagccatgtccacgatgcacacagatgtttccaaaacttctttgaagcaagcaagcccagtcgcatttaaaaaaatcaacaacaatgatgataatgaaaaaatctga

SEQ ID NO: 1102 - DNA, 1146 bp, Homo sapiens
atgggtccaataggtgcagaggctgatgagaaccagacagtggaagaaatgaaggtggaacaatacgggccacaaacaactcctagaggtgaactggtccctgaccctgagccagagcttatagatagtaccaagctgattgaggtacaagttgttctcatattggcctactgctccatcatcttgcttggggtaattggcaactccttggtgatccatgtggtgatcaaattcaagagcatgcgcacagtaaccaactttttcattgccaatctggctgtggcagatcttttggtgaacactctgtgtctaccgttcactcttacctataccttaatgggggagtggaaaatgggtcctgtcctgtgccacctggtgccctatgcccagggcctggcagcacaagtatccacaatcaccttgacagtaattgccctggaccggcacaggtgcatcgtctaccacctagagagcaagatctccaagcgaatcagcttcctgattattggcttggcctggggcatcagtgccctgctggcaagtcccctggccatcttccgggagtattcgctgattgagatcattccggactttgagattgtggcctgtactgaaaagtggcctggcgaggagaagagcatctatggcactgtctatagtctttcttccttgttgatcttgtatgttttgcctctgggcattatatcattttcctacactcgcatttggagtaaattgaagaaccatgtcagtcctggagctgcaaatgaccactaccatcagcgaaggcaaaaaaccaccaaaatgctggtgtgtgtggtggtggtgtttgcggtcagctggctgcctctccatgccttccagcttgccgttgacattgacagccaggtcctggacctgaaggagtacaaactcatcttcacagtgttccacattatcgccatgtgctccacttttgccaatccccttctctatggctggatgaacagcaactacagaaaggctttcctctcggccttccgctgtgagcagcggttggatgccattcactctgaggtgtccgtgacattcaaggctaaaaagaacctggaggtcagaaagaacagtggccccaatgactctttcacagaggctaccaatgtctaa

SEQ ID NO: 1103 - DNA, 1368 bp, Homo sapiens
atgtctttttattccaagcaggactataatatggatttagagctcgacgagtattataacaagacacttgccacagagaataatactgctgccactcggaattctgatttcccagtctgggatgactataaaagcagtgtagatgacttacagtattttctgattgggctctatacatttgtaagtcttcttggctttatggggaatctacttattttaatggctctcatgaaaaagcgtaatcagaagactacggtaaacttcctcataggcaatctggccttttctgatatcttggttgtgctgttttgctcacctttcacactgacgtctgtcttgctggatcagtggatgtttggcaaagtcatgtgccatattatgccttttcttcaatgtgtgtcagttttggtttcaactttaattttaatatcaattgccattgtcaggtatcatatgataaaacatcccatatctaataatttaacagcaaaccatggctactttctgatagctactgtctggacactaggttttgccatctgttctccccttccagtgtttcacagtcttgtggaacttcaagaaacatttggttcagcattgctgagcagcaggtatttatgtgttgagtcatggccatctgattcatacagaattgcctttactatctctttattgctagttcagtatattctgcccttagtttgtcttactgtaagtcatacaagtgtctgcagaagtataagctgtggattgtccaacaaagaaaacagacttgaagaaaatgagatgatcaacttaactcttcatccatccaaaaagagtgggcctcaggtgaaactctctggcagccataaatggagttattcattcatcaaaaaacacagaagaagatatagcaagaagacagcatgtgtgttacctgctccagaaagaccttctcaagagaaccactccagaatacttccagaaaactttggctctgtaagaagtcagctctcttcatccagtaagttcataccaggggtccccacttgctttgagataaaacctgaagaaaattcagatgttcatgaattgagagtaaaacgttctgttacaagaataaaaaagagatctcgaagtgttttctacagactgaccatactgatattagtatttgctgttagttggatgccactacaccttttccatgtggtaactgattttaatgacaatcttatttcaaataggcatttcaagttggtgtattgcatttgtcatttgttgggcatgatgtcctgttgtcttaatccaattctatatgggtttcttaataatgggattaaagctgatttagtgtcccttatacactgtcttcatatgtaa

SEQ ID NO: 1104 - DNA, 873 bp, Homo sapiens
atggaagtttccctaaaccacccagcatctaatacaaccagcacaaagaacaacaactcggcatttttttactttgagtcctgtcaacccccttctccagctttactcctattatgcatagcctatactgtggtcttaattgtgggcctttttggaaacctctctctcatcatcatcatctttaagaagcagagaaaagctcagaatttcaccagcatactgattgccaatctctccctctctgataccttggtgtgtgtcatgtgcatccattttactatcatctacactctgatggaccactggatatttggggataccatgtgcagactcacatcctatgtgcagagtgtctcaatctctgtgtccatattctcacttgtattcactgctgtcgaaagatatcagctaattgtgaacccccgtggctggaagcccagtgtgactcatgcctactggagcatcacactgatttggctgttttcccttctgctgtctattcccttcttcctgtcctaccacctcactgatgagcccttccgcaacctctctctccccactgacctctacacccaccaggtggcctgtgtggagaactggccctccaaaaaggaccggctgctcttcaccacctccctttttctgctgcagtattttgttcctctaggcttcatcctcatctgctacttgaagattgttatctgcctccgcaggagaaatgcaaaggtagataagaagaaggaaaatgagggccggctcaatgagaacaagaggatcaacacaatgttgatttccatcgtggtgacctttggagcctgctggctgccccgaatatcttcaatgtcatctttgactggtatcatgaggtgctga

SEQ ID NO: 1105 - DNA, 1257 bp, Homo sapiens
atgcgcctcaacagctccgcgccgggaaccccgggcacgccggccgccgaccccttccagcgggcgcaggccggactggaggaggcgctgctggccccgggcttcggcaacgcttcgggcaacgcgtcggagcgcgtcctggcggcacccagcagcgagctggacgtgaacaccgacatctactccaaagtgctggtgaccgccgtgtacctggcgctcttcgtggtgggcacggtgggcaacacggtgacggcgttcacgctggcgcggaagaagtcgctgcagagcctgcagagcacggtgcattaccacctgggcagcctggcgctgtccgacctgctcaccctgctgctggccatgcccgtggagctgtacaacttcatctgggtgcaccacccctgggccttcggcgacgccggctgccgcggctactacttcctgcgcgacgcctgcacctacgccacggccctcaacgtggccagcctgagtgtggagcgctacctggccatctgccaccccttcaaggccaagaccctcatgtcccgaagccgcaccaagaagttcatcagcgccatctggctcgcctcggccctgctgacggtgcctatgctgttcaccatgggcgagcagaaccgcagcgccgacggccagcacgccggcggcctggtgtgcacccccaccatccacactgccaccgtcaaggtcgtcatacaggtcaacaccttcatgtccttcatattccccatggtggtcatctcggtcctgaacaccatcatcgccaacaagctgaccgtcatggtacgccaggcggccgagcagggccaagtgtgcacggtcgggggcgagcacagcacattcagcatggccatcgagcctggcagggtccaggccctgcggcacggcgtgcgcgtcctacgtgcagtggtcatcgcctttgtggtctgctggctgccctaccacgtgcggcgcctcatgttctgctacatctcggatgagcagtggactccgttcctctatgacttctaccactacttctacatggtgaccaacgcactcttctacgtcagctccaccatcaaccccatcctgtacaacctcgtctctgccaacttccgccacatcttcctggccacactggcctgcctctgcccggtgtggcggcgcaggaggaagaggccagccttctcgaggaaggccgacagcgtgtccagcaaccacaccctctccagcaatgccacccgcgagacgctgtactag

SEQ ID NO: 1106 - DNA, 1233 bp, Homo sapiens
atggaaaccagcagcccgcggcccccgcggcccagctccaacccggggctgagcctggacgcccggctgggcgtggacactcgcctctgggccaaggtgctgttcaccgcgctctacgcactcatctgggcgctgggcgcggcgggcaatgcgctgtccgtgcacgtggtgctgaaggcgcgggccgggcgcgcggggcgcctgcgccaccacgtgctcagcctggcgctcgcgggcctgctgctgctgctggtcggcgtgccggtggagctctacagcttcgtgtggttccactacccctgggtcttcggcgacctgggctgccgcggctactacttcgtgcacgagctgtgcgcctacgccacggtgctgagcgtggcaggcctgagcgccgagcgctgcctagccgtgtgccagcccctgcgtgcccgcagcctgctgacgccacgccggacccggtggctggtggcgctctcgtgggccgcctcgctcggcctcgccctgcccatggccgtcatcatggggcagaagcacgaactcgagacggcggacggggagccggagcccgcctcgcgagtgtgcacggtgctggtgagccgcaccgcgctccaagtctttatccaggtgaatgtgctggtgtccttcgtgctccccttggcactaactgctttcctgaatggggtcacagtgagccacctgctggccctctgctcccaagtgccgtccacttctaccccgggcagctccacccccagccgcctggagctgctgagtgaggagggtctcctcagcttcatcgtatggaagaagacctttatccagggaggccaggtcagcctggtgagacataaagacgtgcgccggatccgcagcctccagcgcagcgtccaggttctcagagccatcgtggtcatgtatgtcatctgctggctgccgtaccatgcccgcaggctcatgtactgctacgtacctgatgacgcgtggactgacccactgtacaatttctaccactacttctacatggtgaccaacacacttttctacgtcagctcagctgtgactcctcttctctacaacgccgtgtcctcctccttcagaaaactcttcctggaagccgtcagctccctgtgtggagagcaccaccccatgaagcggttacccccgaagccccagagtcccaccctaatggatacagcttcaggctttggggatcccccagaaacccggacctga

SEQ ID NO: 1107 - DNA, 1275 bp, Homo sapiens
atgacccaggcaggccggcggggtcctggcacacccgagccgcgtccgcgaacacagcccatggcctccccgcgcctagggaccttctgctgccccacgcgggacgcagccacgcagctcgtgctgagcttccagccgcgggccttccacgcgctctgcctgggcagcggcgggctccgcttggcgctgggccttctgcagctgctgcccggccgccggcccgcgggccccgggtcccccgcgacgtccccgccggcctcggtccgcatcctgcgcgctgccgctgcctgcgaccttctcggctgcctgggtatggtgatccggtccaccgtgtggttaggattcccaaattttgttgacagcgtctcggatatgaaccacacggaaatttggcctgctgctttctgcgtggggagtgcgatgtggatccagctgttgtacagtgcctgcttctggtggctgttttgctatgcagtggatgcttatctggtgatccggagatcggcaggactgagcaccatcctgctgtatcacatcatggcgtggggcctggccaccctgctctgtgtggagggagccgccatgctctactacccttccgtgtccaggtgtgagcggggcctggaccacgccatcccccactatgtcaccatgtacctgcccctgctgctggttctcgtggcgaaccccatcctgttccaaaagacagtgactgcagtggcctctttacttaaaggaagacaaggcatttacacggagaacgagaggaggatgggagccgtgatcaagatccgatttttcaaaatcatgctggttttaattatttgttggttgtcgaatatcatcaatgaaagccttttattctatcttgagatgcaaacagatatcaatggaggttctttgaaacctgtcagaactgcagccaagaccacatggtttattatgggaatcctgaatccagcccagggatttctcttgtctttggccttctacggctggacaggatgcagcctgggttttcagtctcccaggaaggagatccagtgggaatcactgaccacctcggctgctgagggggctcacccatccccactgatgccccatgaaaaccctgcttccgggaaggtgtctcaagtgggtgggcagacttctgacgaagccctgagcatgctgtctgaaggttctgatgccagcacaattgaaattcacactgcaagtgaatcctgcaacaaaaatgagggtgaccctgctctcccaacccatggagacctatga

SEQ ID NO: 1108 - DNA, 1095 bp, Homo sapiens
atggcccagcagtggagcctccaaaggctcgcaggccgccatccgcaggacagctatgaggacagcacccagtccagcatcttcacctacaccaacagcaactccaccagaggccccttcgaaggcccgaattaccacatcgctcccagatgggtgtaccacctcaccagtgtctggatgatctttgtggtcattgcatccgttttcacaaatgggcttgtgctggcggccaccatgaagttcaagaagctgcgccacccgctgaactggatcctggtgaacctggcggtcgctgacctggcagagaccgtcatcgccagcactatcagcgttgtgaaccaggtctatggctacttcgtgctgggccaccctatgtgtgtcctggagggctacaccgtctccctgtgtgggatcacaggtctctggtctctggccatcatttcctgggagagatggatggtggtctgcaagccctttggcaatgtgagatttgatgccaagctggccatcgtgggcattgccttctcctggatctgggctgctgtgtggacagccccgcccatctttggttggagcaggtactggccccacggcctgaagacttcatgcggcccagacgtgttcagcggcagctcgtaccccggggtgcagtcttacatgattgtcctcatggtcacctgctgcatcaccccactcagcatcatcgtgctctgctacctccaagtgtggctggccatccgagcggtggcaaagcagcagaaagagtctgaatccacccagaaggcagagaaggaagtgacgcgcatggtggtggtgatggtcctggcattctgcttctgctggggaccatacgccttcttcgcatgctttgctgctgccaaccctggctaccccttccaccctttgatggctgccctgccggccttctttgccaaaagtgccactatctacaaccccgttatctatgtctttatgaaccggcagtttcgaaactgcatcttgcagcttttcgggaagaaggttgacgatggctctgaactctccagcgcctccaaaacggaggtctcatctgtgtcctcggtatcgcctgcatga

SEQ ID NO: 1109 - DNA, 1101 bp, Homo sapiens
ggcatccatgagaaaaatgtcggaggaagagttttatctgttcaaaaatatctcttcagtggggccgtgggatgggcctcagtaccacattgcccctgtctgggccttctacctccaggcagctttcatgggcactgtcttccttatagggttcccactcaatgccatggtgctggtggccacactgcgctacaaaaagttgcggcagcccctcaactacattctggtcaacgtgtccttcggaggcttcctcctctgcatcttctctgtcttccctgtcttcgtcgccagctgtaacggatacttcgtcttcggtcgccatgtttgtgctttggagggcttcctgggcactgtagcaggtctggttacaggatggtcactggccttcctggcctttgagcgctacattgtcatctgtaagcccttcggcaacttccgcttcagctccaagcatgcactgacggtggtcctggctacctggaccattggtattggcgtctccatcccacccttctttggctggagccggttcatccctgagggcctgcagtgttcctgtggccctgactggtacaccgtgggcaccaaataccgcagcgagtcctatacgtggttcctcttcatcttctgcttcattgtgcctctctccctcatctgcttctcctacactcagctgctgagggccctgaaagctgttgcagctcagcagcaggagtcagctacgacccagaaggctgaacgggaggtgagccgcatggtggttgtgatggtaggatccttctgtgtctgctacgtgccctacgcggccttcgccatgtacatggtcaacaaccgtaaccatgggctggacttacggcttgtcaccattccttcattcttctccaagagtgcttgcatctacaatcccatcatctactgcttcatgaataagcagttccaagcttgcatcatgaagatggtgtgtgggaaggccatgacagatgaatccgacacatgcagctcccagaaaacagaagtttctactgtctcgtctacccaagttggccccaactgaggacccaatattggcctgtttgcaacagctagaattaaattttactt

SEQ ID NO: 1110 - DNA, 2110 bp, Homo sapiens
cgagccccgccgcaagctgagcgcctccgcccgccaggcgcgccggcgccgggccatgtactcggggaaccgcagcggcggccacggctactgggacggcggcggggccgcgggcgctgaggggccggcgccggcggggacactgagccccgcgcccctcttcagccccggcacctacgagcgcctggcgctgctgctgggctccattgggctgctgggcgtcggcaacaacctgctggtgctcgtcctctactacaagttccagcggctccgcactcccactcacctcctcctggtcaacatcagcctcagcgacctgctggtgtccctcttcggggtcacctttaccttcgtgtcctgcctgaggaacggctgggtgtgggacaccgtgggctgcgtgtgggacgggtttagcggcagcctcttcgggattgtttccattgccaccctaaccgtgctggcctatgaacgttacattcgcgtggtccatgccagagtgatcaatttttcctgggcctggagggccattacctacatctggctctactcactggcgtgggcaggagcacctctcctgggatggaacaggtacatcctggacgtacacggactaggctgcactgtggactggaaatccaaggatgccaacgattcctcctttgtgcttttcttatttcttggctgcctggtggtgcccctgggtgtcatagcccattgctatggccatattctatattccattcgaatgcttcgttgtgtggaagatcttcagacaattcaagtgatcaagattttaaaatatgaaaagaaactggccaaaatgtgctttttaatgatattcaccttcctggtctgttggatgccttatatcgtgatctgcttcttggtggttaatggtcatggtcacctggtcactccaacaatatctattgtttcgtacctctttgctaaatcgaacactgtatacaatccagtgatttatgtcttcatgatcagaaagtttcgaagatcccttttgcagcttctgtgcctccgactgctgaggtgccagaggcctgctaaagacctaccagcagctggaagtgaaatgcagatcagacccattgtgatgtcacagaaagatggggacaggccaaagaaaaaagtgactttcaactcttcttccatcatttttatcatcaccagtgatgaatcactgtcagttgacgacagcgacaaaaccattggggtccaaagtttgatgttaatccaagttcgtcctttgtaggaatgaaggatggcaacgaaaggtggggccttaaattggatgccacttttggactttcatcatcctcctgaagaagaagtgtctggaatacccgttctatgtaatatcaacagaaccttgtggtccagcaggaaatccgaattgcccatatgctcttgggcctcaggaagaggttgaacaaaaacaaattcttttaattcaacgggtgctttacataatgaaaaaaccacttgtgcacacgatgggcatctaacatcatcatcttctaatgtgttggagattttcatttcaaatatattttttaaattactctattttccaaaacacgtaatgcatttttctcgaaaataccttactgtaaaaataactgtcgcgtacacatgtgtgaagtagctagaacatactgaattttttttgtactgttggactctattcagtgtcatgtcctatatctgatcaagttatcaaggagataattctagaatgaaaaagaaaatcctcttgttggaaacaaaagacgttttatatgtgcagtatgacaaagaggagtttcagagacaactttgaatccttgtcagcctggagaccagcaccagaggaatctacaaggcaaactcccatatatttgcttcccccaaattgctgcccctacagactcaaagctctttttctttgttttgttgtttctctaaaaatttactgttctttgtcgatgctatataagccagggagttctaagacgccagctctttgagatttgctcattcccctgtatttcccacatatatattacatatacccgctaataaatttatgtttgttttaaaaaaaaaaaaaaaaaaa

SEQ ID NO: 1111 - DNA, 2284 bp, Homo sapiens
cggacacaggagaaagcagcgggtaggctaagcaggggtgctgaggatggaggaaagttgggaggctgagcacagctgaagtcctgagctccctgtgcccttgacttctctgtgggctcgagcaaggaccatcccaactcaggatgaaccctccttcggggccaagagtcccgcccagcccaacccaagagcccagctgcatggccaccccagcaccacccagctggtgggacagctcccagagcagcatctccagcctgggccggcttccatccatcagtcccacagcacctgggacttgggctgctgcctgggtccccctccccacggttgatgttccagaccatgcccactataccctgggcacagtgatcttgctggtgggactcacggggatgctgggcaacctgacggtcatctataccttctgcaggagcagaagcctccggacacctgccaacatgttcattatcaacctcgcggtcagcgacttcctcatgtccttcacccaggcccctgtcttcttcaccagtagcctctataagcagtggctctttggggagacaggctgcgagttctatgccttctgtggagctctctttggcatttcctccatgatcaccctgacggccatcgccctggaccgctacctggtaatcacacgcccgctggccacctttggtgtggcgtccaagaggcgtgcggcatttgtcctgctgggcgtttggctctatgccctggcctggagtctgccacccttcttcggctggagcgcctacgtgcccgaggggttgctgacatcctgctcctgggactacatgagcttcacgccggccgtgcgtgcctacaccatgcttctctgctgcttcgtgttcttcctccctctgcttatcatcatctactgctacatcttcatcttcagggccatccgggagacaggacgggctctccagaccttcggggcctgcaagggcaatggcgagtccctgtggcagcggcagcggctgcagagcgagtgcaagatggccaagatcatgctgctggtcatcctcctcttcgtgctctcctgggctccctattccgctgtggccctggtggcctttgctgggtacgcacacgtcctgacaccctacatgagctcggtgccagccgtcatcgccaaggcctctgcaatccacaaccccatcatttacgccatcacccaccccaagtacagggtggccattgcccagcacctgccctgcctgggggtgctgctgggtgtatcacgccggcacagtcgcccctaccccagctaccgctccacccaccgctccacgctgaccagccacacctccaacctcagctggatctccatacggaggcgccaggagtccctgggctcggagagtgaggtgggctggacacacatggaggcagcagctgtgtggggagctgcccagcaagcaaatgggcggtccctctacggtcagggtctggaggacttggaagccaaggcaccccccagaccccagggacacgaagcagagactccagggaagaccaaggggctgatccccagccaggaccccaggatgtaggacgcccactggctctccctttcttctgagacacatccagcccccccacgtctccctcatatacacagacccaggattatgctgtgagcctgcaggctttggaagtggccctgtcacccgtgctgcacgggattcacagccccagccccatggcccctctccacacctcaaaactcctgccccataacgtcctccgcatccactttccagctcagcagccgcacccgaggctcagcctgaggggtgtgtgcccaggccctcccacttcccgagttgtctgcctctcctcaaatgctgtgtgctgcaattgtccaggcgatgacaatggtgatggctccagagaacacaccagctatttatgagcctctgcccccaggctgggcctgtcactggcataggaaggccagccccgcatctcccactgccaacagctgaagccgagcacagacctccctttgcacgctggaacagttactcacctgtggcttcttcccccagtgtaccgttccactgtggcccacattcttgtgcacgcgggcatttgcaggcacgctctcgcgtagttacctatctgaatgcacaccaagcacatgcgtgcacactctgcgtctgtgattcatttcatgtagtggtctaagctcctcccagggctgtgtggatctgacagggtataggaaaataaaaagcggagaaggtgtcttcag

SEQ ID NO: 1112 - DNA, 1773 bp, Homo sapiens
ccgaggagcctgcgctgctcctggctcacagcgctccgggcgaggagagcgggcggaccggggggctgggccggtgcgggcggcgaggcaggcggacgaggcgcagagacagcggggcggccggggcgcggcacgcggcgggtcggggccggcctctgccttgccgctcccctcgcgtcggatccccgcgcccaggcagccggtggagagggacgcggcggacgccggcagccatggaaccggccccctccgccggcgccgagctgcagcccccgctcttcgccaacgcctcggacgcctaccctagcgccttccccagcgctggcgccaatgcgtcggggccgccaggaccggggagcgcctcgtccctcgccctggcaatcgccatcaccgcgctctactcggccgtgtgcgccgtggggctgctgggcaacgtgcttgtcatgttcggcatcgtccggtacactaagatgaagacggccaccaacatctacatcttcaacctggccttagccgatgcgctggccaccagcacgctgcctttccagagtgccaagtacctgatggagacgtggcccttcggcgagctgctctgcaaggctgtgctctccatcgactactacaatatgttcaccagcatcttcacgctcaccatgatgagtgttgaccgctacatcgctgtctgccaccctgtcaaggccctggacttccgcacgcctgccaaggccaagctgatcaacatctgtatctgggtcctggcctcaggcgttggcgtgcccatcatggtcatggctgtgacccgtccccgggacggtgcagtggtgtgcatgctccagttccccagccccagctggtactgggacacggtgaccaagatctgcgtgttcctcttcgccttcgtggtgcccatcctcatcatcaccgtgtgctatggcctcatgctgctgcgcctgcgcagtgtgcgcctgctgtcgggctccaaggagaaggaccgcagcctgcggcgcatcacgcgcatggtgctggtggttgtgggcgccttcgtggtgtgttgggcgcccatccacatcttcgtcatcgtctggacgctggtggacatcgaccggcgcgacccgctggtggtggctgcgctgcacctgtgcatcgcgctgggctacgccaatagcagcctcaaccccgtgctctacgctttcctcgacgagaacttcaagcgctgcttccgccagctctgccgcaagccctgcggccgcccagaccccagcagcttcagccggccccgcgaagccacggcccgcgagcgtgtcaccgcctgcaccccgtccgatggtcccggcggtggccgtgccgcctgaccaggccatccggcccccagacgcccctccctagttgtacccggaggccacatgagtcccagtgggaggcgcgagccatgatgtggagtggggccagtagataggtcggagggctttgggaccgccagatggggcctctgtttcggagacgggaccgggccgctagatgggcatggggtgggcctctggtttggggcgaggcagaggacagatcaatggcgcagtgcctctggtctgggtgcccccgtccacggctctaggtggggcgggaaagccagtgactccaggagaggagcgggacctgtggctctacaactgagtccttaaacagggcatctccaggaaggcggggcttcaaccttgagacagcttcggtttctaacttggagccggactttcggagttggggggtccggggccc

SEQ ID NO: 1113 - DNA, 1143 bp, Homo sapiens
atggaatccccgattcagatcttccgcggggagcctggccctacctgcgccccgagcgcctgcctgccccccaacagcagcgcctggtttcccggctgggccgagcccgacagcaacggcagcgccggctcggaggacgcgcagctggagcccgcgcacatctccccggccatcccggtcatcatcacggcggtctactccgtagtgttcgtcgtgggcttggtgggcaactcgctggtcatgttcgtgatcatccgatacacaaagatgaagacagcaaccaacatttacatatttaacctggctttggcagatgctttagttactacaaccatgccctttcagagtacggtctacttgatgaattcctggccttttggggatgtgctgtgcaagatagtaatttccattgattactacaacatgttcaccagcatcttcaccttgaccatgatgagcgtggaccgctacattgccgtgtgccaccccgtgaaggctttggacttccgcacacccttgaaggcaaagatcatcaatatctgcatctggctgctgtcgtcatctgttggcatctctgcaatagtccttggaggcaccaaagtcagggaagacgtcgatgtcattgagtgctccttgcagttcccagatgatgactactcctggtgggacctcttcatgaagatctgcgtcttcatctttgccttcgtgatccctgtcctcatcatcatcgtctgctacaccctgatgatcctgcgtctcaagagcgtccggctcctttctggctcccgagagaaagatcgcaacctgcgtaggatcaccagactggtcctggtggtggtggcggttttcgtcgtctgctggactcccattcacatattcatcctggtggaggctctggggagcacctcccacagcacagctgctctctccagctattacttctgcatcgccttaggctataccaacagtagcctgaatcccattctctacgcctttcttgatgaaaacttcaagcggtgtttccgggacttctgctttccactgaagatgaggatggagcggcagagcactagcagagtccgaaatacagttcaggatcctgcttacctgagggacatcgatgggatgaataaaccagtatga

SEQ ID NO: 1114 - DNA, 2534 bp, Homo sapiens
cctgctctgcacctgtcgtcgactgccagccggctgagggcgggggtctccacggtggtcccagctcccaaggaggttgcagaagtaccgtacagagtggatttgcagggcagtggcatggagcccctcttccccgcgccgttctgggaggttatctacggcagccaccttcagggcaacctgtccctcctgagccccaaccacagtctgctgcccccgcatctgctgctcaatgccagccacggcgccttcctgcccctcgggctcaaggtcaccatcgtggggctctacctggccgtgtgtgtcggagggctcctggggaactgccttgtcatgtacgtcatcctcaggcacaccaaaatgaagacagccaccaatatttacatctttaacctggccctggccgacactctggtcctgctgacgctgcccttccagggcacggacatcctcctgggcttctggccgtttgggaatgcgctgtgcaagacagtcattgccattgactactacaacatgttcaccagcaccttcaccctaactgccatgagtgtggatcgctatgtagccatctgccaccccatccgtgccctcgacgtccgcacgtccagcaaagcccaggctgtcaatgtggccatctgggccctggcctctgttgtcggtgttcccgttgccatcatgggctcggcacaggtcgaggatgaagagatcgagtgcctggtggagatccctacccctcaggattactggggcccggtgtttgccatctgcatcttcctcttctccttcatcgtccccgtgctcgtcatctctgtctgctacagcctcatgatccggcggctccgtggagtccgcctgctctcgggctcccgagagaaggaccggaacctgcggcgcatcactcggctggtgctggtggtagtggctgtgttcgtgggctgctggacgcctgtccaggtcttcgtgctggcccaagggctgggggttcagccgagcagcgagactgccgtggccattctgcgcttctgcacggccctgggctacgtcaacagctgcctcaaccccatcctctacgccttcctggatgagaacttcaaggcctgcttccgcaagttctgctgtgcatctgccctgcgccgggacgtgcaggtgtctgaccgcgtgcgcagcattgccaaggacgtggccctggcctgcaagacctctgagacggtaccgcggcccgcatgactaggcgtggacctgcccatggtgcctgtcagcccgcagagcccatctacgcccaacacagagctcacacaggtcactgctctctaggcggacacaccctgggccctgagcatccagagcctgggatgggcttttccctgtgggccagggatgctcggtcccagaggaggacctagtgacatcatgggacaggtcaaagcattagggccacctccatggccccagacagactaaagctgccctcctggtgcagggccgaggggacacaaggacctacctggaagcagctgacatgctggtggacggccgttactggagcccgtgcccctccctccccgtgcttcatgtgactcttggcctctctgctgctgcgttggcagaaccctgggtgggcaggcacccggaggaggagcagcagctgtgtcatcctgtgccccccatgtgctgtgtgctgtttgcatggcagggctccagctgccttcagccctgtgacgtctcctcagggcagctggacaggcttggcacggcccgggaagtgcagcaggcagcttttctttggggtgggacttgccctgagcttggagctgccacctggaggacttgcctgttccgactccacctgtgcagccggggccaccccaggagaaagtgtccaggtgggggctggcagtccctggctgcagaccccgagctggccctcggaccgcacctctgaaggttttctgtgtgctgcacggtgcaggcctcatccctgactgcagcttgactctgggcccaacccccatttcccttcaggagaccagcgagaggccctggccatccctccagcggtgcaatgaactatatgctgtggaccgtcaacccagccctgcttctcagtgtggggcaggtgtctcaggacgaaggcgccgcgtgaccacatgggcagctctgttcacaaagtggaggcctcgttttcctggtcttgactgctctgtttgggtgggagaagattctctgggggtccccacatcctcccaaggctcccctcacagcctctcctttgcttgaagccagaggtcagtggccgtgctgtgttgcggggaagctgtgtggaaggagaagctggtggccacagcagagtcctgctctggggacgcctgcttcatttacaagcctcaagatggctctgtgtagggcctgagcttgctgcccaacgggaggatggcttcacagcagagccagcatgaggggtggggcctggcagggcttgcttgagccaaactgcaaaggctgtggtggctgtgaggacactgcgggggttg

SEQ ID NO: 1115 - DNA, 2162 bp, Homo sapiens
  misc_feature (2063)..(2063): n is a, c, g, or t
  misc_feature (2091)..(2091): n is a, c, g, or t
ggaattccggctataggcagaggagaatgtcagatgctcagctcggtcccctccgcctgacgctcctctctgtctcagccaggactggtttctgtaagaaacagcaggagctgtggcagcggcgaaaggaagcggctgaggcgcttggaacccgaaaagtctcggtgctcctggctacctcgcacagcggtgcccgcccggccgtcagtaccatggacagcagcgctgcccccacgaacgccagcaattgcactgatgccttggcgtactcaagttgctccccagcacccagccccggttcctgggtcaacttgtcccacttagatggcaacctgtccgacccatgcggtccgaaccgcaccaacctgggcgggagagacagcctgtgccctccgaccggcagtccctccatgatcacggccatcacgatcatggccctctactccatcgtgtgcgtggtggggctcttcggaaacttcctggtcatgtatgtgattgtcagatacaccaagatgaagactgccaccaacatctacattttcaaccttgctctggcagatgccttagccaccagtaccctgcccttccagagtgtgaattacctaatgggaacatggccatttggaaccatcctttgcaagatagtgatctccatagattactataacatgttcaccagcatattcaccctctgcaccatgagtgttgatcgatacattgcagtctgccaccctgtcaaggccttagatttccgtactccccgaaatgccaaaattatcaatgtctgcaactggatcctctcttcagccattggtcttcctgtaatgttcatggctacaacaaaatacaggcaaggttccatagattgtacactaacattctctcatccaacctggtactgggaaaacctcgtgaagatctgtgttttcatcttcgccttcattatgccagtgctcatcattaccgtgtgctatggactgatgatcttgcgcctcaagagtgtccgcatgctctctggctccaaagaaaaggacaggaatcttcgaaggatcaccaggatggtgctggtggtggtggctgtgttcatcgtctgctggactcccattcacatttacgtcatcattaaagccttggttacaatcccagaaactacgttccagactgtttcttggcacttctgcattgctctaggttacacaaacagctgcctcaacccagtcctttatgcatttctggatgaaaacttcaaacgatgcttcagagagttctgtatcccaacctcttccaacattgagcaacaaaactccactcgaattcgtcagaacactagagaccacccctccacggccaatacagtggatagaactaatcatcagctagaaaatctggaagcagaaactgctccgttgccctaacagggtctcatgccattccgaccttcaccaagcttagaagccaccatgtatgtggaagcaggttgcttcaagaatgtgtaggaggctctaattctctaggaaagtgcctacttttaggtcatccaacctctttcctctctggccactctgctctgcacattagagggacagccaaaagtaagtggagcatttggaaggaaaggaatataccacaccgaggagtccagtttgtgcaagacacccagtggaaccaaaacccatcgtggtatgtgaattgaagtcatcataaaaggtgacccttctgtctgtaagattttattttcaagcaaatatttatgacctcaacaaagaagaaccatcttttgttaagttcaccgtagtaacacataaagtaaatgctacctctgatcaaagcaccttgaatggaaggtccgagtctttttagtgtttttgcaagggaatgaatccattattctattttagacttttaacttcaacttaaaattagcatctggctaaggcatcattttcacctccatttcttggttttgtattgtttaaaaaaaataacatctctttcatctagctccataattgcaagggaagagattagcatgaaaggtaatctgaaacacagtcatgtgtcanctgtagaaaggttgattctcatgcactncaaatacttccaaagagtcatcatgggggatttttcattcttaggctttcagtggtttgttcctggaattc

SEQ ID NO: 1116 - DNA, 1170 bp, Homo sapiens
atggagggcgcgctcgcagccaactggagcgccgaggcagccaacgccagcgccgcgccgccgggggccgagggcaaccgcaccgccggacccccgcggcgcaacgaggccctggcgcgcgtggaggtggcggtgctgtgtctcatcctgctcctggcgctgagcgggaacgcgtgtgtgctgctggcgctgcgcaccacacgccagaagcactcgcgcctcttcttcttcatgaagcacctaagcatcgccgacctggtggtggcagtgtttcaggtgctgccgcagttgctgtgggacatcaccttccgcttctacgggcccgacctgctgtgccgcctggtcaagtacttgcaggtggtgggcatgttcgcctccacctacctgctgctgctcatgtccctggaccgctgcctggccatctgccagccgctgcgctcgctgcgccgccgcaccgaccgcctggcagtgctcgccacgtggctcggctgcctggtggccagcgcgccgcaggtgcacatcttctctctgcgcgaggtggctgacggcgtcttcgactgctgggccgtcttcatccagccctggggacccaaggcctacatcacatggatcacgctagctgtctacatcgtgccggtcatcgtgctcgctacctgctacggccttatcagcttcaagatctggcagaacttgcggctcaagaccgctgcagcggcggcggccgaggcgccagagggcgcggcggctggcgatggggggcgcgtggccctggcgcgtgtcagcagcgtcaagctcatctccaaggccaagatccgcacggtcaagatgactttcatcatcgtgctggccttcatcgtgtgctggacgcctttcttcttcgtgcagatgtggagcgtctgggatgccaacgcgcccaaggaagcctcggccttcatcatcgtcatgctcctggccagcctcaacagctgctgcaacccctggatctacatgctgttcacgggccacctcttccacgaactcgtgcagcgcttcctgtgctgctccgccagctacctgaagggcagacgcctgggagagacgagtgccagcaaaaagagcaactcgtcctcctttgtcctgagccatcgcagctccagccagaggagctgctcccagccatccacggcgtga

SEQ ID NO: 1117 - DNA, 1122 bp, Homo sapiens
atgaccgaggtgctgtggccggctgtccccaacgggacggacgctgccttcctggccggtccgggttcgtcctgggggaacagcacggtcgcctccactgccgccgtctcctcgtcgttcaaatgcgccttgaccaagacgggcttccagttttactacctgccggctgtctacatcttggtattcatcatcggcttcctgggcaacagcgtggccatctggatgttcgtcttccacatgaagccctggagcggcatctccgtgtacatgttcaatttggctctggccgacttcttgtacgtgctgactctgccagccctgatcttctactacttcaataaaacagactggatcttcggggatgccatgtgtaaactgcagaggttcatctttcatgtgaacctctatggcagcatcttgtttctgacatgcatcagtgcccaccggtacagcggtgtggtgtaccccctcaagtccctgggccggctcaaaaagaagaatgcgatctgtatcagcgtgctggtgtggctcattgtggtggtggcgatctcccccatcctcttctactcaggtaccggggtccgcaaaaacaaaaccatcacctgttacgacaccacctcagacgagtacctgcgaagttatttcatctacagcatgtgcacgaccgtggccatgttctgtgtccccttggtgctgattctgggctgttacggattaattgtgagagctttgatttacaaagatctggacaactctcctctgaggagaaaatcgatttacctggtaatcattgtactgactgtttttgctgtgtcttacatccctttccatgtgatgaaaacgatgaacttgagggcccggcttgattttcagaccccagcaatgtgtgctttcaatgacagggtttatgccacgtatcaggtgacaagaggtctagcaagtctcaacagttgtgtggaccccattctctatttcttggcgggagatactttcagaaggagactctcccgagccacaaggaaagcttctagaagaagtgaggcaaatttgcaatccaagagtgaagacatgaccctcaatattttacctgagttcaagcagaatggagatacaagcctgtga

SEQ ID NO: 1118 - DNA, 1029 bp, Homo sapiens
atgcaagccgtcgacaatctcacctctgcgcctgggaacaccagtctgtgcaccagagactacaaaatcacccaggtcctcttcccactgctctacactgtcctgttttttgttggacttatcacaaatggcctggcgatgaggattttctttcaaatccggagtaaatcaaactttattatttttcttaagaacacagtcatttctgatcttctcatgattctgacttttccattcaaaattcttagtgatgccaaactgggaacaggaccactgagaacttttgtgtgtcaagttacctccgtcatattttatttcacaatgtatatcagtatttcattcctgggactgataactatcgatcgctaccagaagaccaccaggccatttaaaacatccaaccccaaaaatctcttgggggctaagattctctctgttgtcatctgggcattcatgttcttactctctttgcctaacatgattctgaccaacaggcagccgagagacaagaatgtgaagaaatgctctttccttaaatcagagttcggtctagtctggcatgaaatagtaaattacatctgtcaagtcattttctggattaatttcttaattgttattgtatgttatacactcattacaaaagaactgtaccggtcatacgtaagaacgaggggtgtaggtaaagtccccaggaaaaaggtgaacgtcaaagttttcattatcattgctgtattctttatttgttttgttcctttccattttgcccgaattccttacaccctgagccaaacccgggatgtctttgactgcactgctgaaaatactctgttctatgtgaaagagagcactctgtggttaacttccttaaatgcatgcctggatccgttcatctattttttcctttgcaagtccttcagaaattccttgataagtatgctgaagtgccccaattctgcaacatctctgtcccaggacaataggaaaaaagaacaggatggtggtgacccaaatgaagagactccaatgtaa

SEQ ID NO: 1119 - DNA, 1134 bp, Homo sapiens
atggcagcagacctgggcccctggaatgacaccatcaatggcacctgggatggggatgagctgggctacaggtgccgcttcaacgaggacttcaagtacgtgctgctgcctgtgtcctacggcgtggtgtgcgtgcttgggctgtgtctgaacgccgtggcgctctacatcttcttgtgccgcctcaagacctggaatgcgtccaccacatatatgttccacctggctgtgtctgatgcactgtatgcggcctccctgccgctgctggtctattactacgcccgcggcgaccactggcccttcagcacggtgctctgcaagctggtgcgcttcctcttctacaccaacctttactgcagcatcctcttcctcacctgcatcagcgtgcaccggtgtctgggcgtcttacgacctctgcgctccctgcgctggggccgggcccgctacgctcgccgggtggccggggccgtgtgggtgttggtgctggcctgccaggcccccgtgctctactttgtcaccaccagcgcgcgcgggggccgcgtaacctgccacgacacctcggcacccgagctcttcagccgcttcgtggcctacagctcagtcatgctgggcctgctcttcgcggtgccctttgccgtcatccttgtctgttacgtgctcatggctcggcgactgctaaagccagcctacgggacctcgggcggcctccctagggccaagcgcaagtccgtgcgcaccatcgccgtggtgctggctgtcttcgccctctgcttcctgccattccacgtcacccgcaccctctactactccttccgctcgctggacctcagctgccacaccctcaacgccatcaacatggcctacaaggttacccggccgctggccagtgctaacagttgccttgaccccgtgctctacttcctggctgggcagaggctcgtacgctttgcccgagatgccaagccacccactggccccagccctgccaccccggctcgccgcaggctgggcctgcgcagatccgacagaactgacatgcagaggataggagatgtgttgggcagcagtgaggacttcaggcggacagagtccacgccggctggtagcgagaacactaaggacattcggctgtag

SEQ ID NO: 1120 - DNA, 1098 bp, Homo sapiens
atggccagtacagagtcctccctgttgagatccctaggcctcagcccaggtcctggcagcagtgaggtggagctggactgttggtttgatgaggatttcaagttcatcctgctgcctgtgagctatgcagttgtctttgtgctgggcttgggccttaacgccccaaccctatggctcttcatcttccgcctccgaccctgggatgcaacggccacctacatgttccacctggcattgtcagacaccttgtatgtgctgtcgctgcccaccctcatctactattatgcagcccacaaccactggccctttggcactgagatctgcaagttcgtccgctttcttttctattggaacctctactgcagtgtccttttcctcacctgcatcagcgtgcaccgctacctgggcatctgccacccacttcgggcactacgctggggccgccctcgcctcgcaggccttctctgcctggcagtttggttggtcgtagccggctgcctcgtgcccaacctgttctttgtcacaaccagcaacaaagggaccaccgtcctgtgccatgacaccactcggcctgaagagtttgaccactatgtgcacttcagctcggcggtcatggggctgctctttggcgtgccctgcctggtcactcttgtttgctatggactcatggctcgtcgcctgtatcagcccttgccaggctctgcacagtcgtcttctcgcctccgctctctccgcaccatagctgtggtgctgactgtctttgctgtctgcttcgtgcctttccacatcacccgcaccatttactacctggccaggctgttggaagctgactgccgagtactgaacattgtcaacgtggtctataaagtgactcggcccctggccagtgccaacagctgcctggatcctgtgctctacttgctcactggggacaaatatcgacgtcagctccgtcagctctgtggtggtggcaagccccagccccgcacggctgcctcttccctggcactagtgtccctgcctgaggatagcagctgcaggtgggcggccaccccccaggacagtagctgctctactcctagggcagatagattgtaa

SEQ ID NO: 1121 - DNA, 987 bp, Homo sapiens
atggaatgggacaatggcacaggccaggctctgggcttgccacccaccacctgtgtctaccgcgagaacttcaagcaactgctgctgccacctgtgtattcggcggtgctggcggctggcctgccgctgaacatctgtgtcattacccagatctgcacgtcccgccgggccctgacccgcacggccgtgtacaccctaaaccttgctctggctgacctgctatatgcctgctccctgcccctgctcatctacaactatgcccaaggtgatcactggccctttggcgacttcgcctgccgcctggtccgcttcctcttctatgccaacctgcacggcagcatcctcttcctcacctgcatcagcttccagcgctacctgggcatctgccacccgctggccccctggcacaaacgtgggggccgccgggctgcctggctagtgtgtgtagccgtgtggctggccgtgacaacccagtgcctgcccacagccatcttcgctgccacaggcatccagcgtaaccgcactgtctgctatgacctcagcccgcctgccctggccacccactatatgccctatggcatggctctcactgtcatcggcttcctgctgccctttgctgccctgctggcctgctactgtctcctggcctgccgcctgtgccgccaggatggcccggcagagcctgtggcccaggagcggcgtggcaaggcggcccgcatggccgtggtggtggctgctgcctttgccatcagcttcctgccttttcacatcaccaagacagcctacctggcagtgcgctcgacgccgggcgtcccctgcactgtattggaggcctttgcagcggcctacaaaggcacgcggccgtttgccagtgccaacagcgtgctggaccccatcctcttctacttcacccagaagaagttccgccggcgaccacatgagctcctacagaaactcacagccaaatggcagaggcagggtcgctga

SEQ ID NO: 1122 - DNA, 1020 bp, Homo sapiens
atggctaaccttgacaaatacactgaaacattcaagatgggtagcaacagtaccagcactgctgagatttactgtaatgtcactaatgtgaaatttcaatactccctctatgcaaccacctatatcctcatattcattcctggtcttctggctaacagtgcagccttgtgggttctgtgccgcttcatcagcaagaaaaataaagccatcattttcatgatcaacctctctgtggctgaccttgctcatgtattatctttacccctccggatttactattacatcagccaccactggcctttccagagagccctttgcctgctctgcttctacctgaagtatctcaacatgtatgccagcatttgtttcctgacgtgcatcagtcttcaaaggtgcttttttctcctcaagcccttcagggccagagactggaagcgtaggtacgatgtgggcatcagtgctgccatctggatcgttgtggggactgcctgtttgccatttcccatcctgagaagcacagacttaaacaacaacaagtcctgctttgctgatcttggatacaagcaaatgaatgcagttgcgttggtcgggatgattacagttgctgagcttgcaggatttgtgatcccagtgatcatcatcgcatggtgtacctggaaaactactatatccttgagacagccaccaatggctttccaagggatcagtgagaggcagaaagcactgcggatggtgttcatgtgtgctgcagtcttcttcatctgcttcactccctatcatattaactttattttttacaccatggtaaaggaaaccatcattagcagttgtcccgttgtccgaatcgcactgtatttccaccctttttgcctgtgccttgcaagtctctgctgccttttggatccaattctttattactttatggcttcagagtttcgtgaccaactatcccgccatggcagttctgtgacccgctcccgcctcatgagcaaggagagtggttcatcaatgattggctaa

SEQ ID NO: 1123 - DNA, 1035 bp, Homo sapiens
atggtaagcgttaacagctcccactgcttctataatgactcctttaagtacactttgtatgggtgcatgttcagcatggtgtttgtgcttgggttagtatccaattgtgttgccatatacattttcatctgcgtcctcaaagtccgaaatgaaactacaacttacatgattaacttggcaatgtcagacttgctttttgtttttactttacccttcaggattttttacttcacaacacggaattggccatttggagatttactttgtaagatttctgtgatgctgttttataccaacatgtacggaagcattctgttcttaacctgtattagtgtagatcgatttctggcaattgtctacccatttaagtcaaagactctaagaaccaaaagaaatgcaaagattgtttgcactggcgtgtggttaactgtgatcggaggaagtgcacccgccgtttttgttcagtctacccactctcagggtaacaatgcctcagaagcctgctttgaaaattttccagaagccacatggaaaacatatctctcaaggattgtaattttcatcgaaatagtgggattttttattcctctaattttaaatgtaacttgttctagtatggtgctaaaaactttaaccaaaccagttacattaagtagaagcaaaataaacaaaactaaggttttaaaaatgatttttgtacatttgatcatattctgtttctgttttgttccttacaatatcaatcttattttatattctcttgtgagaacacaaacatttgttaattgctcagtagtggcagcagtaaggacaatgtacccaatcactctctgtattgctgtttccaactgttgttttgaccctatagtttactactttacatcggacacaattcagaattcaataaaaatgaaaaactggtctgtcaggagaagtgacttcagattctctgaagttcatggtgcagagaattttattcagcataacctacagaccttaaaaagtaagatatttgacaatgaatctgctgcctga

SEQ ID NO: 1124 - DNA, 1785 bp, Homo sapiens
ggcacgaggcgccggccgccatgtggagctgcagctggttcaacggcacagggctggtggaggagctgcctgcctgccaggacctgcagctggggctgtcactgttgtcgctgctgggcctggtggtgggcgtgccagtgggcctgtgctacaacgccctgctggtgctggccaacctacacagcaaggccagcatgaccatgccggacgtgtactttgtcaacatggcagtggcaggcctggtgctcagcgccctggcccctgtgcacctgctcggccccccgagctcccggtgggcgctgtggagtgtgggcggcgaagtccacgtggcactgcagatccccttcaatgtgtcctcactggtggccatgtactccaccgccctgctgagcctcgaccactacatcgagcgtgcactgccgcggacctacatggccagcgtgtacaacacgcggcacgtgtgcggcttcgtgtggggtggcgcgctgctgaccagcttctcctcgctgctcttctacatctgcagccatgtgtccacccgcgcgctagagtgcgccaagatgcagaacgcagaagctgccgacgccacgctggtgttcatcggctacgtggtgccagcactggccaccctctacgcgctggtgctactctcccgcgtccgcagggaggacacgcccctggaccgggacacgggccggctggagccctcggcacacaggctgctggtggccaccgtgtgcacgcagtttgggctctggacgccacactatctgatcctgctggggcacacggtcatcatctcgcgagggaagcccgtggacgcacactacctggggctactgcactttgtgaaggatttctccaaactcctggccttctccagcagctttgtgacaccacttctctaccgctacatgaaccagagcttccccagcaagctccaacggctgatgaaaaagctgccctgcggggaccggcactgctccccggaccacatgggggtgcagcaggtgctggcgtaggcggcccagccctcctggggagacgtgactctggtggacgcagagcacttagttaccctggacgctccccacatccttccagaaggagacgagctgctggaagagaagcaggaggggtgtttttcttgaagtttcctttttcccacaaatgccactcttgggccaaggctgtggtccccgtggctggcatctggcttgagtctccccgaggcctgtgcgtctcccaaacacgcagctcaaggtccacatctgcaaaagcctcctcgccttcagcctcctcagcattcagtttgtcaatgaagtgatgaaagcttagagccagtatttatactttgtggttaaaatacttgattcccccttgtttgttttacaaaaacagatgtttcctagaaaaatgacaaatagtaaaatgaacaaaaccctacgaaagaatggcaacagccagggtggccgggccctgccagtgggcggcgtgtgctagcaaggcctgccgggtgtgccgcagtcaccacagggttctgagaacatttcacagaagtgcctgagacgcggagacatggctggtgttaaatggagctattcaatagcagtgacgcgctctcctcagccaccaaatgtccctgacaccctccccagcccccacagataacatcagctgaggtttttttcagtatgaacctgtcctaaatcaattcctcaaagtgtgcacaaaactaaagaatataaataaacaaaagaaaggtgaaaaaaaaaaaaaaaaaaa

SEQ ID NO: 1125 - DNA, 1014 bp, Homo sapiens
atgagagctgtcttcatccaaggtgctgaagagcaccctgcggcattctgctaccaggtgaatgggtcttgccccaggacagtacatactctgggcatccagttggtcatctacctgacctgtgcagcaggcatgctgattatcgtgctagggaatgtatttgtggcatttgctgtgtcctacttcaaagcgcttcacacgcccaccaacttcctgctgctctccctggccctggctgacatgtttctgggtctgctggtgctgcccctcagcaccattcgctcagtggagagctgctggttcttcggggacttcctctgccgcctgcacacctacctggacaccctcttctgcctcacctccatcttccatctctgtttcatttccattgaccgccactgtgccatctgtgaccccctgctctatccctccaagttcacagtgagggtggctctcaggtacatcctggcaggatggggggtgcccgcagcatacacttcgttattcctctacacagatgtggtagagacaaggctcagccagtggctggaagagatgccttgtgtgggcagttgccagctgctgctcaataaattttggggctggttaaacttccctttgttctttgtcccctgcctcattatgatcagcttgtatgtgaagatctttgtggttgctaccagacaggctcagcagattaccacattgagcaaaagcctggctggggctgccaagcatgagagaaaagctgccaagaccctgggcattgttgtgggcatatacctcttgtgctggctgcccttcaccatagacacgatggtcgacagcctccttcactttatcacacccccactggtctttgacatctttatctggtttgcttacttcaactcagcctgcaaccccatcatctatgtcttttcctaccagtggtttcggaaggcactgaaactcacactgagccagaaggtcttctcaccgcagacacgcactgttgatttgtaccaagaatga

SEQ ID NO: 1126 - DNA, 1128 bp, Homo sapiens
atgaacacctctcacctcctggccttgctgctcccaaaatctccacaaggtgaaaacagaagcaaacccctgggcaccccatacaacttctctgaacattgccaggattccgtggacgtgatggtcttcatcgtcacttcctacagcattgagactgtcgtgggggtcctgggtaacctctgcctgatgtgtgtgactgtgaggcagaaggagaaagccaacgtgaccaacctgcttatcgccaacctggccttctctgacttcctcatgtgcctcctctgccagccgctgaccgccgtctacaccatcatggactactggatctttggagagaccctctgcaagatgtcggccttcatccagtgcatgtcggtgacggtctccatcctctcgctcgtcctcgtggccctggagaggcatcagctcatcatcaacccaacaggctggaagcccagcatctcacaggcctacctggggattgtgctcatctgggtcattgcctgtgtcctctccctgcccttcctggccaacagcatcctggagaatgtcttccacaagaaccactccaaggctctggagttcctggcagataaggtggtctgtaccgagtcctggccactggctcaccaccgcaccatctacaccaccttcctgctcctcttccagtactgcctcccactgggcttcatcctggtctgttatgcacgcatctaccggcgcctgcagaggcaggggcgcgtgtttcacaagggcacctacagcttgcgagctgggcacatgaagcaggtcaatgtggtgctggtggtgatggtggtggcctttgccgtgctctggctgcctctgcatgtgttcaacagcctggaagactggcaccatgaggccatccccatctgccacgggaacctcatcttcttagtgtgccacttgcttgccatggcctccacctgcgtcaacccattcatctatggctttctcaacaccaacttcaagaaggagatcaaggccctggtgctgacttgccagcagagcgcccccctggaggagtcggagcatctgcccctgtccacagtacatacggaagtctccaaagggtccctgaggctaagtggcaggtccaatcccatttaa

SEQ ID NO: 1127 - DNA, 1029 bp, Homo sapiens
atggagccacatgactcctcccacatggactctgagttccgatacactctcttcccgattgtttacagcatcatctttgtgctcggggtcattgctaatggctacgtgctgtgggtctttgcccgcctgtacccttgcaagaaattcaatgagataaagatcttcatggtgaacctcaccatggcggacatgctcttcttgatcaccctgccactttggattgtctactaccaaaaccagggcaactggatactccccaaattcctgtgcaacgtggctggctgccttttcttcatcaacacctactgctctgtggccttcctgggcgtcatcacttataaccgcttccaggcagtaactcggcccatcaagactgctcaggccaacacccgcaagcgtggcatctctttgtccttggtcatctgggtggccattgtgggagctgcatcctacttcctcatcctggactccaccaacacagtgcccgacagtgctggctcaggcaacgtcactcgctgctttgagcattacgagaagggcagcgtgccagtcctcatcatccacatcttcatcgtgttcagcttcttcctggtcttcctcatcatcctcttctgcaacctggtcatcatccgtaccttgctcatgcagccggtgcagcagcagcgcaacgctgaagtcaagcgccgggcgctgtggatggtgtgcacggtcttggcggtgttcatcatctgcttcgtgccccaccacgtggtgcagctgccctggacccttgctgagctgggcttccaggacagcaaattccaccaggccattaatgatgcacatcaggtcaccctctgcctccttagcaccaactgtgtcttagaccctgttatctactgtttcctcaccaagaagttccgcaagcacctcaccgaaaagttctacagcatgcgcagtagccggaaatgctcccgggccaccacggatacggtcactgaagtggttgtgccattcaaccagatccctggcaattccctcaaaaattag

SEQ ID NO: 1128 - DNA, 1077 bp, Homo sapiens
atgaagtcgccgttctaccgctgccagaacaccacctctgtggaaaaaggcaactcggcggtgatgggcggggtgctcttcagcaccggcctcctgggcaacctgctggccctggggctgctggcgcgctcggggctggggtggtgctcgcggcgtccactgcgcccgctgccctcggtcttctacatgctggtgtgtggcctgacggtcaccgacttgctgggcaagtgcctcctaagcccggtggtgctggctgcctacgctcagaaccggagtctgcgggtgcttgcgcccgcattggacaactcgttgtgccaagccttcgccttcttcatgtccttctttgggctctcctcgacactgcaactcctggccatggcactggagtgctggctctccctagggcaccctttcttctaccgacggcacatcaccctgcgcctgggcgcactggtggccccggtggtgagcgccttctccctggctttctgcgcgctacctttcatgggcttcgggaagttcgtgcagtactgccccggcacctggtgctttatccagatggtccacgaggagggctcgctgtcggtgctggggtactctgtgctctactccagcctcatggcgctgctggtcctcgccaccgtgctgtgcaacctcggcgccatgcgcaacctctatgcgatgcaccggcggctgcagcggcacccgcgctcctgcaccagggactgtgccgagccgcgcgcggacgggagggaagcgtcccctcagcccctggaggagctggatcacctcctgctgctggcgctgatgaccgtgctcttcactatgtgttctctgcccgtaatttatcgcgcttactatggagcatttaaggatgtcaaggagaaaaacaggacctctgaagaagcagaagacctccgagccttgcgatttctatctgtgatttcaattgtggacccttggatttttatcattttcagatctccagtatttcggatattttttcacaagattttcattagacctcttaggtacaggagccggtgcagcaattccactaacatggaatccagtctg

SEQ ID NO: 1129 - DNA, 1209 bp, Homo sapiens
atgagcccttgcgggcccctcaacctgagcctggcgggcgaggcgaccacatgcgcggcgccctgggtccccaacacgtcggccgtgccgccgtcgggcgcttcgcccgcgctgcccatcttctccatgacgctgggcgccgtgtccaacctgctggcgctggcgctgctggcgcaggccgcgggccgcctgcgacgccgccgctcggccaccaccttcctgctgttcgtggccagcctgctggccaccgacctggcgggccacgtgatcccgggcgcgctggtgctgcgtctgtacactgcggggcgcgctccggccggcggggcctgccacttcctgggcggctgcatggtcttcttcggcctgtgcccgctgctgctgggctgtggcatggccgtggagcgctgcgtgggcgtcacgcggccgctgctccacgccgcgcgggtctcggtcgcccgcgcgcgcctggcgctggccgcggtggccgcggtggccttggccgtggcgctgctgccgctggcgcgcgtgggccgctatgagctgcagtacccgggcacgtggtgcttcatcggcctgggtcccccgggcggctggcgccaggcactgcttgctggcctcttcgccagcctcggcctggtcgcgctcctcgccgcgctggtgtgcaacacgctcagcggcctggccctgcatcgcgcccgctggcgacgccgctcccgacggcctcccccggcctcaggccccgacagccggcgtcgctggggggcgcacggaccccgctcggcctccgcctcgtccgcctcgtccatcgcttcggcctccaccttctttggcggctctcggagcagcggctcggcacgcagagctcgcgcccacgacgtggagatggtgggccagcttgtcggtatcatggtggtgtcgtgcatctgctggagcccaatgctggtgttggtggcgctggccgtcggcggctggagctctacctccctgcagcggccactgttcctggccgtgcgccttgcctcctggaaccagatcctggacccttgggtgtacatcctactgcgccaggccgtgctgcgccaactgcttcgcctcttgcccccgagggccggagccaagggcggccccgcggggctgggcctaacaccgagcgcctgggaggccagctcgctgcgcagctcccggcacagcggcctcagccacttctaa

SEQ ID NO: 1130 - DNA, 1077 bp, Homo sapiens
atgggcaatgcctccaatgactcccagtctgaggactgcgagacgcgacagtggcttcccccaggcgaaagcccagccatcagctccgtcatgttctcggccggggtgctggggaacctcatagcactggcgctgctggcgcgccgctggcggggggacgtggggtgcagcgccggccgcaggagctccctctccttgttccacgtgctggtgaccgagctggtgttcaccgacctgctcgggacctgcctcatcagcccagtggtactggcttcgtacgcgcggaaccagaccctggtggcactggcgcccgagagccgcgcgtgcacctacttcgctttcgccatgaccttcttcagcctggccacgatgctcatgctcttcgccatggccctggagcgctacctctcgatcgggcacccctacttctaccagcgccgcgtctcggcctccgggggcctggccgtgctgcctgtcatctatgcagtctccctgctcttctgctcgctgccgctgctggactatgggcagtacgtccagtactgccccgggacctggtgcttcatccggcacgggcggaccgcttacctgcagctgtacgccaccctgctgctgcttctcattgtctcggtgctcgcctgcaacttcagtgtcattctcaacctcatccgcatgcaccgccgaagccggagaagccgctgcggaccttccctgggcagtggccggggcggccccggggcccgcaggagaggggaaagggtgtccatggcggaggagacggaccacctcattctcctggctatcatgaccatcaccttcgccgtctgctccttgcctttcacgatttttgcatatatgaatgaaacctcttcccgaaaggaaaaatgggacctccaagctcttaggtttttatcaattaattcaataattgacccttgggtctttgccatccttaggcctcctgttctgagactaatgcgttcagtcctctgttgtcggatttcattaagaacacaagatgcaacacaaacttcctgttctacacagtcagatgccagtaaacaggctgacctttga

SEQ ID NO: 1131 - DNA, 1922 bp, Homo sapiens
accagaggtttcccagagaggaaggcgtggctccctcccgggccagtgagccctggcgccgccgcggccgcggtcccagcagcggagtagggcggcggctgcgccccgcaccatggggggcagcccagccccagccgcggtaaacgccgacctccgccgccgcccgcgccgcgtctgccccctcccgctgcggctctctggacgccatcccctcctcacctcgaagccaacatgaaggagacccggggctacggaggggatgcccccttctgcacccgcctcaaccactcctacacaggcatgtgggcgcccgagcgttccgccgaggcgcggggcaacctcacgcgccctccagggtctggcgaggattgcggatcggtgtccgtggccttcccgatcaccatgctgctcactggtttcgtgggcaacgcactggccatgctgctcgtgtcgcgcagctaccggcgccgggagagcaagcgcaagaagtccttcctgctgtgcatcggctggctggcgctcaccgacctggtcgggcagcttctcaccaccccggtcgtcatcgtcgtgtacctgtccaagcagcgttgggagcacatcgacccgtcggggcggctctgcacctttttcgggctgaccatgactgttttcgggctctcctcgttgttcatcgccagcgccatggccgtcgagcgggcgctggccatcagggcgccgcactggtatgcgagccacatgaagacgcgtgccacccgcgctgtgctgctcggcgtgtggctggccgtgctcgccttcgccctgctgccggtgctgggcgtgggccagtacaccgtccagtggcccgggacgtggtgcttcatcagcaccgggcgagggggcaacgggactagctcttcgcataactggggcaaccttttcttcgcctctgcctttgccttcctggggctcttggcgctgacagtcaccttttcctgcaacctggccaccattaaggccctggtgtcccgctgccgggccaaggccacggcatctcagtccagtgcccagtggggccgcatcacgaccgagacggccattcagcttatggggatcatgtgcgtgctgtcggtctgctggtctccgctcctgataatgatgttgaaaatgatcttcaatcagacatcagttgagcactgcaagacacacacggagaagcagaaagaatgcaacttcttcttaatagctgttcgcctggcttcactgaaccagatcttggatccttgggtttacctgctgttaagaaagatccttcttcgaaagttttgccagatgagaaaaagaagactcagagagcaagagatggggcctgatggaaggtgtttttgtcatgcatggaggcaggtccccaggacttggtgcagttctcatgatagagaaccctgcagtgtccagctaagctgatgacttgaagataaatctgcctaaccctgggatgaagtatctgtgaactattttgacagcagatgaggaattttggggaaattaaaacctgcctttctgccaggatcacatcactggaagctccatgactctctttttgtaaaagaaaaaaaaatcacagaaacacccacctcccaaactattctcttttacttcttcccccaagcccacccccaaatataactgttatccagaagctgttatgtcctgtttccatacatgtttttgtacttttactatatctacatacatcaattaaacttatgtcctattgttttgtgaatttatatttgcgtatacattatcatatgtaaaatttgcatttttttattgaaaattatgtttcttgagatttatccacattgaaacatggagctctaaatcgttaattttaaccgctatagagtattccataatttgaataaagcataatttgtttgtac

SEQ ID NO: 1132 - DNA, 1467 bp, Homo sapiens
atgtccactcccggggtcaattcgtccgcctccttgagccccgaccggctgaacagcccagtgaccatcccggcggtgatgttcatcttcggggtggtgggcaacctggtggccatcgtggtgctgtgcaagtcgcgcaaggagcagaaggagacgaccttctacacgctggtatgtgggctggctgtcaccgacctgttgggcactttgttggtgagcccggtgaccatcgccacgtacatgaagggccaatggcccgggggccagccgctgtgcgagtacagcaccttcattctgctcttcttcagcctgtccggcctcagcatcatctgcgccatgagtgtcgagcgctacctggccatcaaccatgcctatttctacagccactacgtggacaagcgattggcgggcctcacgctctttgcagtctatgcgtccaacgtgctcttttgcgcgctgcccaacatgggtctcggtagctcgcggctgcagtacccagacacctggtgcttcatcgactggaccaccaacgtgacggcgcacgccgcctactcctacatgtacgcgggcttcagctccttcctcattctcgccaccgtcctctgcaacgtgcttgtgtgcggcgcgctgctccgcatgcaccgccagttcatgcgccgcacctcgctgggcaccgagcagcaccacgcggccgcggccgcctcggttgcctcccggggccaccccgctgcctccccagccttgccgcgcctcagcgactttcggcgccgccggagcttccgccgcatcgcgggcgccgagatccagatggtcatcttactcattgccacctccctggtggtgctcatctgctccatcccgctcgtggtgcgagtattcgtcaaccagttatatcagccaagtttggagcgagaagtcagtaaaaatccagatttgcaggccatccgaattgcttctgtgaaccccatcctagacccctggatatatatcctcctgagaaagacagtgctcagtaaagcaatagagaagatcaaatgcctcttctgccgcattggcgggtcccgcagggagcgctccggacagcactgctcagacagtcaaaggacatcttctgccatgtcaggccactctcgctccttcatctcccgggagctgaaggagatcagcagtacatctcagaccctcctgccagacctctcactgccagacctcagtgaaaatggccttggaggcaggaatttgcttccaggtgtgcctggcatgggcctggcccaggaagacaccacctcactgaggactttgcgaatatcagagacctcagactcttcacagggtcaggactcagagagtgtcttactggtggatgaggctggtgggagcggcagggctgggcctgcccctaaggggagctccctgcaagtcacatttcccagtgaaacactgaacttatcagaaaaatgtatataa

SEQ ID NO: 1133 - DNA, 1080 bp, Homo sapiens
atgtccatgaacaattccaaacagctagtgtctcctgcagctgcgcttctttcaaacacaacctgccagacggaaaaccggctttccgtatttttttcagtaatcttcatgacagtgggaatcttgtcaaacagccttgccatcgccattctcatgaaggcatatcagagatttagacagaagtccaaggcatcgtttctgcttttggccagcggcctggtaatcactgatttctttggccatctcatcaatggagccatagcagtatttgtatatgcttctgataaagaatggatccgctttgaccaatcaaatgtcctttgcagtatttttggtatctgcatggtgttttctggtctgtgcccacttcttctaggcagtgtgatggccattgagcggtgtattggagtcacaaaaccaatatttcattctacgaaaattacatccaaacatgtgaaaatgatgttaagtggtgtgtgcttgtttgctgttttcatagctttgctgcccatccttggacatcgagactataaaattcaggcgtcgaggacctggtgtttctacaacacagaagacatcaaagactgggaagatagattttatcttctacttttttcttttctggggctcttagcccttggtgtttcattgttgtgcaatgcaatcacaggaattacacttttaagagttaaatttaaaagtcagcagcacagacaaggcagatctcatcatttggaaatggtaatccagctcctggcgataatgtgtgtctcctgtatttgttggagcccatttctggttacaatggccaacattggaataaatggaaatcattctctggaaacctgtgaaacaacactttttgctctccgaatggcaacatggaatcaaatcttagatccttgggtatatattcttctacgaaaggctgtccttaagaatctctataagcttgccagtcaatgctgtggagtgcatgtcatcagcttacatatttgggagcttagttccattaaaaattccttaaaggttgctgctatttctgagtcaccagttgcagagaaatcagcaagcacctag

SEQ ID NO: 1134 - DNA, 1161 bp, Homo sapiens
atggcggattcgtgcaggaacctcacctacgtgcggggctcggtggggccggccaccagcaccctgatgttcgtggccggtgtggtgggcaacgggctggccctgggcatcctgagcgcacggcgaccggcgcgcccctcggccttcgcggtgctggtgaccggactggcggccaccgacctgctgggcaccagcttcctgagcccggccgtgttcgtggcctatgcgcgcaacagctccctgctgggcctggcccgaggcggccccgccctgtgcgatgccttcgccttcgccatgaccttcttcggcctggcgtccatgctcatcctctttgccatggccgtggagcgctgcctggcgctgagccacccctacctctacgcgcagctggacgggccccgctgcgcccgcctggcgctgccagccatctacgccttctgcgtcctcttctgcgcgctgcccctgctgggcctgggccaacaccagcagtactgccccggcagctggtgcttcctccgcatgcgctgggcccagccgggcggcgccgccttctcgctggcctacgccggcctggtggccctgctggtggctgccatcttcctctgcaacggctcggtcaccctcagcctctgccgcatgtaccgccagcagaagcgccaccagggctctctgggtccacggccgcgcaccggagaggacgaggtggaccacctgatcctgctggccctcatgacagtggtcatggccgtgtgctccctgcctctcacgatccgctgcttcacccaggctgtcgcccctgacagcagcagtgagatgggggacctccttgccttccgcttctacgccttcaaccccatcctggacccctgggtcttcatccttttccgcaaggctgtcttccagcgactcaagctctgggtctgctgcctgtgcctcgggcctgcccacggagactcgcagacacccctttcccagctcgcctcagggaggagggacccaagggccccctctgctcctgtgggaaaggaggggagctgcgtgcctttgtcggcttggggcgaggggcaggtggagcccttgcctcccacacagcagtccagcggcagcgccgtgggaacgtcgtccaaagcagaagccagcgtcgcctgctccctctgctga

SEQ ID NO: 1135 - DNA, 1782 bp, Homo sapiens
atggggaccgcccggatcgcacccggcctggcgctcctgctctgctgccccgtgctcagctccgcgtacgcgctggtggatgcagatgacgtcatgactaaagaggaacagatcttcctgctgcaccgtgctcaggcccagtgcgaaaaacggctcaaggaggtcctgcagaggccagccagcataatggaatcagacaagggatggacatctgcgtccacatcagggaagcccaggaaagataaggcatctgggaagctctaccctgagtctgaggaggacaaggaggcacccactggcagcaggtaccgagggcgcccctgtctgccggaatgggaccacatcctgtgctggccgctgggggcaccaggtgaggtggtggctgtgccctgtccggactacatttatgacttcaatcacaaaggccatgcctaccgacgctgtgaccgcaatggcagctgggagctggtgcctgggcacaacaggacgtgggccaactacagcgagtgtgtcaaatttctcaccaatgagactcgtgaacgggaggtgtttgaccgcctgggcatgatttacaccgtgggctactccgtgtccctggcgtccctcaccgtagctgtgctcatcctggcctactttaggcggctgcactgcacgcgcaactacatccacatgcacctgttcctgtccttcatgctgcgcgccgtgagcatcttcgtcaaggacgctgtgctctactctggcgccacgcttgatgaggctgagcgcctcaccgaggaggagctgcgcgccatcgcccaggcgcccccgccgcctgccaccgccgctgccggctacgcgggctgcagggtggctgtgaccttcttcctttacttcctggccaccaactactactggattctggtggaggggctgtacctgcacagcctcatcttcatggccttcttctcagagaagaagtacctgtggggcttcacagtcttcggctggggtctgcccgctgtcttcgtggctgtgtgggtcagtgtcagagctaccctggccaacaccgggtgctgggacttgagctccgggaacaaaaagtggatcatccaggtgcccatcctggcctccattgtgctcaacttcatcctcttcatcaatatcgtccgggtgctcgccaccaagctgcgggagaccaacgccggccggtgtgacacacggcagcagtaccggaagctgctcaaatccacgctggtgctcatgcccctctttggcgtccactacattgtcttcatggccacaccatacaccgaggtctcagggacgctctggcaagtccagatgcactatgagatgctcttcaactccttccagggattttttgtcgcaatcatatactgtttctgcaacggcgaggtacaagctgagatcaagaaatcttggagccgctggacactggcactggacttcaagcgaaaggcacgcagcgggagcagcagctatagctacggccccatggtgtcccacacaagtgtgaccaatgtcggcccccgtgtgggactcggcctgcccctcagcccccgcctactgcccactgccaccaccaacggccaccctcagctgcctggccatgccaagccagggaccccagccctggagaccctcgagaccacaccacctgccatggctgctcccaaggacgatgggttcctcaacggctcctgctcaggcctggacgaggaggcctctgggcctgagcggccacctgccctgctacaggaagagtgggagacagtcatgtga

SEQ ID NO: 1136 - DNA, 1653 bp, Homo sapiens
atggccgggctgggggcgtcgctccacgtctggggttggctaatgctcggcagctgcctcctggccagagcccagctggattctgatggcaccattactatagaggagcagattgtccttgtgctgaaagcgaaagtacaatgtgaactcaacatcacagctcaactccaggagggagaaggtaattgtttccctgaatgggatggactcatttgttggcccagaggaacagtggggaaaatatcggctgttccatgccctccttatatttatgacttcaaccataaaggagttgctttccgacactgtaaccccaatggaacatgggattttatgcacagcttaaataaaacatgggccaattattcagactgccttcgctttctgcagccagatatcagcataggaaagcaagaattctttgaacgcctctatgtaatgtataccgttggctactccatctcttttggttccttggctgtggctattctcatcattggttacttcagacgattgcattgcactaggaactatatccacatgcacttatttgtgtctttcatgctgagagctacaagcatctttgtcaaagacagagtagtccatgctcacataggagtaaaggagctggagtccctaataatgcaggatgacccacaaaattccattgaggcaacttctgtggacaaatcacaatatatcgggtgcaagattgctgttgtgatgtttatttacttcctggctacaaattattattggatcctggtggaaggtctctacctgcataatctcatctttgtggctttcttttcggacaccaaatacctgtggggcttcatcttgataggctgggggtttccagcagcatttgttgcagcatgggctgtggcacgagcaactctggctgatgcgaggtgctgggaacttagtgctggagacatcaagtggatttatcaagcaccgatcttagcagctattgggctgaattttattctgtttctgaatacggttagagttctagctaccaaaatctgggagaccaatgcagttgggcatgacacaaggaagcaatacaggaaactggccaaatcgacactggtcctggtcctagtctttggagtgcattacatcgtgttcgtatgcctgcctcactccttcactgggctcgggtgggagatccgcatgcactgtgagctcttcttcaactcctttcagggtttctttgtgtctatcatctactgctactgcaatggagaggttcaggcagaggtgaagaagatgtggagtcggtggaatctctccgtggactggaaaaggacaccgccatgtggcagccgcagatgcggctcagtgctcaccaccgtgacgcacagcaccagcagccagtcacaggtggcggccagcacacgcatggtgcttatctctggcaaagctgccaagatcgccagcagacagcctgacagccacatcactttacctggctatgtctggagtaactcagagcaggactgcctgccacactctttccacgaggagaccaaggaagatagtgggaggcagggagatgatattctaatggagaagccttccaggcctatggaatctaacccagacactgaaggatgccaaggagaaactgaggatgttctctga

SEQ ID NO: 1137 - DNA, 1074 bp, Homo sapiens
atggctacaacagtccctgatggttgccgcaatggcctgaaatccaagtactacagactttgtgataaggctgaagcttggggcatcgtcctagaaacggtggccacagccggggttgtgacctcggtggccttcatgctcactctcccgatcctcgtctgcaaggtgcaggactccaacaggcgaaaaatgctgcctactcagtttctcttcctcctgggtgtgttgggcatctttggcctcaccttcgccttcatcatcggactggacgggagcacagggcccacacgcttcttcctctttgggatcctcttttccatctgcttctcctgcctgctggctcatgctgtcagtctgaccaagctcgtccgggggaggaagcccctttccctgttggtgattctgggtctggccgtgggcttcagcctagtccaggatgttatcgctattgaatatattgtcctgaccatgaataggaccaacgtcaatgtcttttctgagctttccgctcctcgtcgcaatgaagactttgtcctcctgctcacctacgtcctcttcttgatggcgctgaccttcctcatgtcctccttcaccttctgtggttccttcacgggctggaagagacatggggcccacatctacctcacgatgctcctctccattgccatctgggtggcctggatcaccctgctcatgcttcctgactttgaccgcaggtgggatgacaccatcctcagctccgccttggctgccaatggctgggtgttcctgttggcttatgttagtcccgagttttggctgctcacaaagcaacgaaaccccatggattatcctgttgaggatgctttctgtaaacctcaactcgtgaagaagagctatggtgtggagaacagagcctactctcaagaggaaatcactcaaggttttgaagagacaggggacacgctctatgccccctattccacacattttcagctgcagaaccagcctccccaaaaggaattctccatcccacgggcccacgcttggccgagcccttacaaagactatgaagtaaagaaagagggcagctaa

SEQ ID NO: 1138 - DNA, 1077 bp, Homo sapiens
atggatctgcatctcttcgactactcagagccagggaacttctcggacatcagctggccatgcaacagcagcgactgcatcgtggtggacacggtgatgtgtcccaacatgcccaacaaaagcgtcctgctctacacgctctccttcatttacattttcatcttcgtcatcggcatgattgccaactccgtggtggtctgggtgaatatccaggccaagaccacaggctatgacacgcactgctacatcttgaacctggccattgccgacctgtgggttgtcctcaccatcccagtctgggtggtcagtctcgtgcagcacaaccagtggcccatgggcgagctcacgtgcaaagtcacacacctcatcttctccatcaacctcttcggcagcattttcttcctcacgtgcatgagcgtggaccgctacctctccatcacctacttcaccaacacccccagcagcaggaagaagatggtacgccgtgtcgtctgcatcctggtgtggctgctggccttctgcgtgtctctgcctgacacctactacctgaagaccgtcacgtctgcgtccaacaatgagacctactgccggtccttctaccccgagcacagcatcaaggagtggctgatcggcatggagctggtctccgttgtcttgggctttgccgttcccttctccattatcgctgtcttctacttcctgctggccagagccatctcggcgtccagtgaccaggagaagcacagcagccggaagatcatcttctcctacgtggtggtcttccttgtctgctggctgccctaccacgtggcggtgctgctggacatcttctccatcctgcactacatccctttcacctgccggctggagcacgccctcttcacggccctgcatgtcacacagtgcctgtcgctggtgcactgctgcgtcaaccctgtcctctacagcttcatcaatcgcaactacaggtacgagctgatgaaggccttcatcttcaagtactcggccaaaacagggctcaccaagctcatcgatgcctccagagtctcagagacggagtactctgccttggagcag

SEQ ID NO: 1139 - DNA, 876 bp, Homo sapiens
atggcagagaccagtgccctgcccactggcttcggggagctcgaggtgctggctgtggggatggtgctactggtggaagctctctccggtctcagcctcaataccctgaccatcttctctttctgcaagaccccggagctgcggactccctgccacctactggtgctgagcttggctcttgcggacagtgggatcagcctgaatgccctcgttgcagccacatccagccttctccggcgctggccctacggctcggacggctgccaggctcacggcttccagggctttgtgacagcgttggccagcatctgcagcagtgcagccatcgcatgggggcgttatcaccactactgcacccgtagccagctggcctggaactcagccgtctctctggtgctcttcgtgtggctgtcttctgccttctgggcagctctgccccttctgggttggggtcactatgactatgagccactggggacatgctgcaccctggactactccaagggggacagaaacttcaccagcttcctcttcaccatgtccttcttcaacttcgccatgcccctcttcatcacgatcacttcctacagtctcatggagcagaaactggggaagagtggccatctccaggtaaacaccactctgccagcaaggacgctgctgctcggctggggcccctatgccatcctgtatctatacgcagtcatcgcagacgtgacttccatctcccccaaactgcagatggtgcccgccctcattgccaaaatggtgcccacgatcaatgccatcaactatgccctgggcaatgagatggtctgcaggggaatctggcagtgcctctcaccgcagaagagggagaaggaccgaaccaagtga

SEQ ID NO: 1140 - DNA, 1044 bp, Homo sapiens
atgaatggcacagaaggccctaacttctacgtgcccttctccaatgcgacgggtgtggtacgcagccccttcgagtacccacagtactacctggctgagccatggcagttctccatgctggccgcctacatgtttctgctgatcgtgctgggcttccccatcaacttcctcacgctctacgtcaccgtccagcacaagaagctgcgcacgcctctcaactacatcctgctcaacctagccgtggctgacctcttcatggtcctaggtggcttcaccagcaccctctacacctctctgcatggatacttcgtcttcgggcccacaggatgcaatttggagggcttctttgccaccctgggcggtgaaattgccctgtggtccttggtggtcctggccatcgagcggtacgtggtggtgtgtaagcccatgagcaacttccgcttcggggagaaccatgccatcatgggcgttgccttcacctgggtcatggcgctggcctgcgccgcacccccactcgccggctggtccaggtacatccccgagggcctgcagtgctcgtgtggaatcgactactacacgctcaagccggaggtcaacaacgagtcttttgtcatctacatgttcgtggtccacttcaccatccccatgattatcatctttttctgctatgggcagctcgtcttcaccgtcaaggaggccgctgcccagcagcaggagtcagccaccacacagaaggcagagaaggaggtcacccgcatggtcatcatcatggtcatcgctttcctgatctgctgggtgccctacgccagcgtggcattctacatcttcacccaccagggctccaacttcggtcccatcttcatgaccatcccagcgttctttgccaagagcgccgccatctacaaccctgtcatctatatcatgatgaacaagcagttccggaactgcatgctcaccaccatctgctgcggcaagaacccactgggtgacgatgaggcctctgctaccgtgtccaagacggagacgagccaggtggccccggcc

SEQ ID NO: 1141 - DNA, 1374 bp, Homo sapiens
gaataagccttcgataattatgaagggtgtttcggtatcttccctccaaaatgctaagaaataatttaggcaacagttcagactctaaaaatgaagatggctcggtcttttcacagactgaacacaatattgttgcaacttacttgattatggcaggtatgataagtattatcagcaacataatagttctgggcatcttcattaagtacaaggaacttcggacacccacaaatgcaattattattaacctggctgttactgatataggggtcagtagcattggctatcccatgtctgctgcctcagatctgtatggaagttggaaatttggatacgcaggctgtcaggtttatgctggattgaatattttttttggaatggcaagcattggattactcacggtcgtggctgtggaccgatacctgaccatctgccttcctgacgtagggagaagaatgaccaccaacacttacatcggcttgattctgggagcctggatcaatggcctgttttgggctttgatgcctatcatagggtgggctagttatgccccagatcctactggtgctacgtgtaccataaactggaggaaaaatgatagatcttttgtgtcttacaccatgacagttattgcgataaattttattgtgcccttgacagtgatgttttactgctattaccatgtcacgctatccattaaacatcacactaccagtgactgcactgagtccctcaacagagactggtcagatcagatagatgtaacaaagatgtctgtgatcatgatctgcatgtttctggtggcatggtccccttattccatcgtgtgcttatgggcttcttttggtgacccaaagaagattcctccccccatggccatcatagctccactgtttgcaaaatcttctacattctataacccctgcatttatgtggttgctaataaaaagtttcggagggcaatgcttgccatgttcaaatgtcagactcaccaaacaatgcctgtgacaagtattttacccatggatgtatctcaaaacccattggcttctggaagaatctgaaataagagaaaaggacacgctatcaaaacactttagttttttgacaatgcttttcttttaaatatgagcccatttagatcaagtgcagacatggatcattgtcctatgagagtgtaagctcctcaagcacagctcgtgcttccgtttgtgcactctggctgctgtagtgtatgcttctctgtgtcctgatatatcaacttattgctcatctcctttgatgaattaggcatcagaggttaaggtcccctttctttctccctattatggcatgcattacactgtactgatgacctttaacttgcctggctcc

SEQ ID NO: 1142 - DNA, 1410 bp, Homo sapiens
atgcagatggccgatgcagccacgatagccaccatgaataaggcagcaggcggggacaagctagcagaactcttcagtctggtcccggaccttctggaggcggccaacacgagtggtaacgcgtcgctgcagcttccggacttgtggtgggagctggggctggagttgccggacggcgcgccgccaggacatcccccgggcagcggcggggcagagagcgcggacacagaggcccgggtgcggattctcatcagcgtggtgtactgggtggtgtgcgccctggggttggcgggcaacctgctggttctctacctgatgaagagcatgcagggctggcgcaagtcctctatcaacctcttcgtcaccaacctggcgctgacggactttcagtttgtgctcaccctgcccttctgggcggtggagaacgctcttgacttcaaatggcccttcggcaaggccatgtgtaagatcgtgtccatggtgacgtccatgaacatgtacgccagcgtgttcttcctcactgccatgagtgtgacgcgctaccattcggtggcctcggctctgaagagccaccggacccgaggacacggccggggcgactgctgcggccggagcctgggggacagctgctgcttctcggccaaggcgctgtgtgtgtggatctgggctttggccgcgctggcctcgctgcccagtgccattttctccaccacggtcaaggtgatgggcgaggagctgtgcctggtgcgtttcccggacaagttgctgggccgcgacaggcagttctggctgggcctctaccactcgcagaaggtgctgttgggcttcgtgctgccgctgggcatcattatcttgtgctacctgctgctggtgcgcttcatcgccgaccgccgcgcggcggggaccaaaggaggggccgcggtagccggaggacgcccgaccggagccagcgcccggagactgtcgaaggtcaccaaatcagtgaccatcgttgtcctgtccttcttcctgtgttggctgcccaaccaggcgctcaccacctggagcatcctcatcaagttcaacgcggtgcccttcagccaggagtatttcctgtgccaggtatacgcgttccctgtgagcgtgtgcctagcgcactccaacagctgcctcaaccccgtcctctactgcctcgtgcgccgcgagttccgcaaggcgctcaagagcctgctgtggcgcatcgcgtctccttcgatcaccagcatgcgccccttcaccgccactaccaagccggagcacgaggatcaggggctgcaggccccggcgccgccccacgcggccgcggagccggacctgctctactacccacctggcgtcgtggtctacagcggggggcgctacgacctgctgcccagcagctctgcctactga

SEQ ID NO: 1143 - DNA, 2364 bp, Homo sapiens
atggccgctgcccgcccagcgcgggggccggagctcccgctcctggggctgctgctgctgctgctgctgggggacccgggccggggggcggcctcgagcgggaacgcgaccgggcctgggcctcggagcgcgggcgggagcgcgaggaggagcgcggcggtgactggccctccgccgccgctgagccactgcggccgggctgccccctgcgagccgctgcgctacaacgtgtgcctgggctcggtgctgccctacggggccacctccacactgctggccggagactcggactcccaggaggaagcgcacggcaagctcgtgctctggtcgggcctccggaatgccccccgctgctgggcagtgatccagcccctgctgtgtgccgtatacatgcccaagtgtgagaatgaccgggtggagctgcccagccgtaccctctgccaggccacccgaggcccctgtgccatcgtggagagggagcggggctggcctgacttcctgcgctgcactcctgaccgcttccctgaaggctgcacgaatgaggtgcagaacatcaagttcaacagttcaggccagtgcgaagtgcccttggttcggacagacaaccccaagagctggtacgaggacgtggagggctgcggcatccagtgccagaacccgctcttcacagaggctgagcaccaggacatgcacagctacatcgcggccttcggggccgtcacgggcctctgcacgctcttcaccctggccacattcgtggctgactggcggaactcgaatcgctaccctgctgttattctcttctacgtcaatgcgtgcttctttgtgggcagcattggctggctggcccagttcatggatggtgcccgccgagagatcgtctgccgtgcagatggcaccatgaggcttggggagcccacctccaatgagactctgtcctgcgtcatcatctttgtcatcgtgtactacgccctgatggctggtgtggtttggtttgtggtcctcacctatgcctggcacacttccttcaaagccctgggcaccacctaccagcctctctcgggcaagacctcctacttccacctgctcacctggtcactcccctttgtcctcactgtggcaatccttgctgtggcgcaggtggatggggactctgtgagtggcatttgttttgtgggctacaagaactaccgataccgtgcgggcttcgtgctggccccaatcggcctggtgctcatcgtgggaggctacttcctcatccgaggagtcatgactctgttctccatcaagagcaaccaccccgggctgctgagtgagaaggctgccagcaagatcaacgagaccatgctgcgcctgggcatttttggcttcctggcctttggctttgtgctcattaccttcagctgccacttctacgacttcttcaaccaggctgagtgggagcgcagcttccgggactatgtgctatgtcaggccaatgtgaccatcgggctgcccaccaagcagcccatccctgactgtgagatcaagaatcgcccgagccttctggtggagaagatcaacctgtttgccatgtttggaactggcatcgccatgagcacctgggtctggaccaaggccacgctgctcatctggaggcgtacctggtgcaggttgactgggcagagtgacgatgagccaaagcggatcaagaagagcaagatgattgccaaggccttctctaagcggcacgagctcctgcagaacccaggccaggagctgtccttcagcatgcacactgtgtcccacgacgggcccgtggcgggcttggcctttgacctcaatgagccctcagctgatgtctcctctgcctgggcccagcatgtcaccaagatggtggctcggagaggagccatactgccccaggatatttctgtcacccctgtggcaactccagtgcccccagaggaacaagccaacctgtggctggttgaggcagagatctccccagagctgcagaagcgcctgggccggaagaagaagaggaggaagaggaagaaggaggtgtgcccgctggcgccgccccctgagcttcacccccctgcccctgcccccagtaccattcctcgactgcctcagctgccccggcagaaatgcctggtggctgcaggtgcctggggagctggggactcttgccgacagggagcgtggaccctggtctccaacccattctgcccagagcccagtccccctcaggatccatttctgcccagtgcaccggcccccgtggcatgggctcatggccgccgacagggcctggggcctattcactcccgcaccaacctgatggacacagaactcatggatgcagactcggacttctga

SEQ ID NO: 1144 - DNA, 1176 bp, Homo sapiens
atgttccccaatggcaccgcctcctctccttcctcctctcctagccccagcccgggcagctgcggcgaaggcggcggcagcaggggccccggggccggcgctgcggacggcatggaggagccagggcgaaatgcgtcccagaacgggaccttgagcgagggccagggcagcgccatcctgatctctttcatctactccgtggtgtgcctggtggggctgtgtgggaactctatggtcatctacgtgatcctgcgctatgccaagatgaagacggccaccaacatctacatcctaaatctggccattgctgatgagctgctcatgctcagcgtgcccttcctagtcacctccacgttgttgcgccactggcccttcggtgcgctgctctgccgcctcgtgctcagcgtggacgcggtcaacatgttcaccagcatctactgtctgactgtgctcagcgtggaccgctacgtggccgtggtgcatcccatcaaggcggcccgctaccgccggcccaccgtggccaaggtagtaaacctgggcgtgtgggtgctatcgctgctcgtcatcctgcccatcgtggtcttctctcgcaccgcggccaacagcgacggcacggtggcttgcaacatgctcatgccagagcccgctcaacgctggctggtgggcttcgtgttgtacacatttctcatgggcttcctgctgcccgtgggggctatctgcctgtgctacgtgctcatcattgctaagatgcgcatggtggccctcaaggccggctggcagcagcgcaagcgctcggagcgcaagatcaccttaatggtgatgatggtggtgatggtgtttgtcatctgctggatgcctttctacgtggtgcagctggttaacgtgtttgctgagcaggacgacgccacggtgagtcagctgtcggtcatcctcggctatgccaacagctgcgccaaccccatcctctatggctttctctcagacaacttcaagcgctctttccaacgcatcctatgcctcagctggatggacaacgccgcggaggagccggttgactattacgccaccgcgctcaagagccgtgcctacagtgtggaagacttccaacctgagaacctggagtccggcggcgtcttccgtaatggcacctgcacgtcccggatcacgacgctctga

SEQ ID NO: 1145 - DNA, 1110 bp, Homo sapiens
atggacatggcggatgagccactcaatggaagccacacatggctatccattccatttgacctcaatggctctgtggtgtcaaccaacacctcaaaccagacagagccgtactatgacctgacaagcaatgcagtcctcacattcatctattttgtggtctgcatcattgggttgtgtggcaacacacttgtcatttatgtcatcctccgctatgccaagatgaagaccatcaccaacatttacatcctcaacctggccatcgcagatgagctcttcatgctgggtctgcctttcttggctatgcaggtggctctggtccactggccctttggcaaggccatttgccgggtggtcatgactgtggatggcatcaatcagttcaccagcatcttctgcctgacagtcatgagcatcgaccgatacctggctgtggtccaccccatcaagtcggccaagtggaggagaccccggacggccaagatgatcaccatggctgtgtggggagtctctctgctggtcatcttgcccatcatgatatatgctgggctccggagcaaccagtgggggagaagcagctgcaccatcaactggccaggtgaatctggggcttggtacacagggttcatcatctacactttcattctggggttcctggtacccctcaccatcatctgtctttgctacctgttcattatcatcaaggtgaagtcctctggaatccgagtgggctcctctaagaggaagaagtctgagaagaaggtcacccgaatggtgtccatcgtggtggctgtcttcatcttctgctggcttcccttctacatattcaacgtttcttccgtctccatggccatcagccccaccccagcccttaaaggcatgtttgactttgtggtggtcctcacctatgctaacagctgtgccaaccctatcctatatgccttcttgtctgacaacttcaagaagagcttccagaatgtcctctgcttggtcaaggtgagcggcacagatgatggggagcggagtgacagtaagcaggacaaatcccggctgaatgagaccacggagacccagaggaccctcctcaatggagacctccaaaccagtatctga

SEQ ID NO: 1146 - DNA, 1257 bp, Homo sapiens
atggacatgcttcatccatcatcggtgtccacgacctcagaacctgagaatgcctcctcggcctggcccccagatgccaccctgggcaacgtgtcggcgggcccaagcccggcagggctggccgtcagtggcgttctgatccccctggtctacctggtggtgtgcgtggtgggcctgctgggtaactcgctggtcatctatgtggtcctgcggcacacggccagcccttcagtcaccaacgtctacatcctcaacctggcgctggccgacgagctcttcatgctggggctgcccttcctggccgcccagaacgccctgtcctactggcccttcggctccctcatgtgccgcctggtcatggcggtggatggcatcaaccagttcaccagcatattctgcctgactgtcatgagcgtggaccgctacctggccgtggtacatcccacccgctcggcccgctggcgcacagctccggtggcccgcacggtcagcgcggctgtgtgggtggcctcagccgtggtggtgctgcccgtggtggtcttctcgggagtgccccgcggcatgagcacctgccacatgcagtggcccgagccggcggcggcctggcgagccggcttcatcatctacacggccgcactgggcttcttcgggccgctgctggtcatctgcctctgctacctgctcatcgtggtgaaggtgcgctcagctgggcgccgggtgtgggcaccctcgtgccagcggcggcggcgctccgaacgcagggtcacgcgcatggtggtggccgtggtggcgctcttcgtgctctgctggatgcccttctacgtgctcaacatcgtcaacgtggtgtgcccactgcccgaggagcctgccttctttgggctctacttcctggtggtggcgctgccctatgccaacagctgtgccaaccccatcctttatggcttcctctcctaccgcttcaagcagggcttccgcagggtcctgctgcggccctcccgccgtgtgcgcagccaggagcccactgtggggcccccggagaagactgaggaggaggatgaggaggaggaggatggggaggagagcagggaggggggcaaggggaaggagatgaacggccgggtcagccagatcacgcagcctggcaccagcgggcaggagcggccgcccagcagagtggccagcaaggagcagcagctcctaccccaagaggcttccactggggagaagtccagcacgatgcgcatcagctacctgtag

SEQ ID NO: 1147 - DNA, 1167 bp, Homo sapiens
atgagcgccccctcgacgctgccccccgggggcgaggaagggctggggacggcctggccctctgcagccaatgccagtagcgctccggcggaggcggaggaggcggtggcggggcccggggacgcgcgggcggcgggcatggtcgctatccagtgcatctacgcgctggtgtgcctggtggggctggtgggcaacgccctggtcatcttcgtgatccttcgctacgccaagatgaagacggctaccaacatctacctgctcaacctggccgtagccgacgagctcttcatgctgagcgtgcccttcgtggcctcgtcggccgccctgcgccactggcccttcggctccgtgctgtgccgcgcggtgctcagcgtcgacggcctcaacatgttcaccagcgtcttctgtctcaccgtgctcagcgtggaccgctacgtggccgtggtgcaccctctgcgcgcggcgacctaccggcggcccagcgtggccaagctcatcaacctgggcgtgtggctggcatccctgttggtcactctccccatcgccatcttcgcagacaccagaccggctcgcggcggccaggccgtggcctgcaacctgcagtggccacacccggcctggtcggcagtcttcgtggtctacactttcctgctgggcttcctgctgcccgtgctggccattggcctgtgctacctgctcatcgtgggcaagatgcgcgccgtggccctgcgcgctggctggcagcagcgcaggcgctcggagaagaaaatcaccaggctggtgctgatggtcgtggtcgtctttgtgctctgctggatgcctttctacgtggtgcagctgctgaacctcttcgtgaccagccttgatgccaccgtcaaccacgtgtcccttatccttagctatgccaacagctgcgccaaccccattctctatggcttcctctccgacaacttccgccgattcttccagcgggttctctgcctgcgctgctgcctcctggaaggtgctggaggtgctgaggaggagcccctggactactatgccactgctctcaagagcaaaggtggggcagggtgcatgtgccccccactcccctgccagcaggaagccctgcaaccagaacccggccgcaagcgcatccccctcaccaggaccaccaccttctga

SEQ ID NO: 1148 - DNA, 1095 bp, Homo sapiens
atggagcccctgttcccagcctccacgcccagctggaacgcctcctccccgggggctgcctctggaggcggtgacaacaggacgctggtggggccggcgccctcggcaggggcccgggcggtgctggtgcccgtgctgtacctgctggtgtgtgcggccgggctgggcgggaacacgctggtcatctacgtggtgctgcgcttcgccaagatgaagaccgtcaccaacatctacattctcaacctggcagtggccgacgtcctgtacatgctggggctgcctttcctggccacgcagaacgccgcgtccttctggcccttcggccccgtcctgtgccgcctggtcatgacgctggacggcgtcaaccagttcaccagtgtcttctgcctgacagtcatgagcgtggaccgctacctggcagtggtgcacccgctgagctcggcccgctggcgccgcccgcgtgtggccaagctggcgagcgccgcggcctgggtcctgtctctgtgcatgtcgctgccgctcctggtgttcgcggacgtgcaggagggcggtacctgcaacgccagctggccggagcccgtggggctgtggggcgccgtcttcatcatctacacggccgtgctgggcttcttcgcgccgctgctggtcatctgcctgtgctacctgctcatcgtggtgaaggtgagggcggcgggcgtgcgcgtgggctgcgtgcggcggcgctcggagcggaaggtgacgcgcatggtgttggtggtggtgctggtgtttgcgggatgttggctgcccttcttcaccgtcaacatcgtcaacctggccgtggcgctgccccaggagcccgcctccgccggcctctacttcttcgtggtcatcctctcctacgccaacagctgtgccaaccccgtcctctacggcttcctctctgacaacttccgccagagcttccagaaggttctgtgcctccgcaagggctctggtgccaaggacgctgacgccacggagccgcgtccagacaggatccggcagcagcaggaggccacgccgcccgcgcaccgcgccgcagccaacgggcttatgcagaccagcaagctgtga

SEQ ID NO: 1149 - DNA, 1224 bp, Homo sapiens
atggataacgtcctcccggtggactcagacctctccccaaacatctccactaacacctcggaacccaatcagttcgtgcaaccagcctggcaaattgtcctttgggcagctgcctacacggtcattgtggtgacctctgtggtgggcaacgtggtagtgatgtggatcatcttagcccacaaaagaatgaggacagtgacgaactattttctggtgaacctggccttcgcggaggcctccatggctgcattcaatacagtggtgaacttcacctatgctgtccacaacgaatggtactacggcctgttctactgcaagttccacaacttcttccccatcgccgctgtcttcgccagtatctactccatgacggctgtggcctttgataggtacatggccatcatacatcccctccagccccggctgtcagccacagccaccaaagtggtcatctgtgtcatctgggtcctggctctcctgctggccttcccccagggctactactcaaccacagagaccatgcccagcagagtcgtgtgcatgatcgaatggccagagcatccgaacaagatttatgagaaagtgtaccacatctgtgtgactgtgctgatctacttcctccccctgctggtgattggctatgcatacaccgtagtgggaatcacactatgggccagtgagatccccggggactcctctgaccgctaccacgagcaagtctctgccaagcgcaaggtggtcaaaatgatgattgtcgtggtgtgcaccttcgccatctgctggctgcccttccacatcttcttcctcctgccctacatcaacccagatctctacctgaagaagtttatccagcaggtctacctggccatcatgtggctggccatgagctccaccatgtacaaccccatcatctactgctgcctcaatgacaggttccgtctgggcttcaagcatgccttccggtgctgccccttcatcagcgccggcgactatgaggggctggaaatgaaatccacccggtatctccagacccagggcagtgtgtacaaagtcagccgcctggagaccaccatctccacagtggtgggggcccacgaggaggagccagaggacggccccaaggccacaccctcgtccctggacctgacctccaactgctcttcacgaagtgactccaagaccatgacagagagcttcagcttctcctccaatgtgctctcctag

SEQ ID NO: 1150 - DNA, 1197 bp, Homo sapiens
atggggacctgtgacattgtgactgaagccaatatctcatctggccctgagagcaacaccacgggcatcacagccttctccatgcccagctggcagctggcactgtgggcaccagcctacctggccctggtgctggtggccgtgacgggtaatgccatcgtcatctggatcatcctggcccatcggaggatgcgcacagtcaccaactacttcatcgtcaatctggcgctggctgacctctgcatggctgccttcaatgccgccttcaactttgtctatgccagccacaacatctggtactttggccgtgccttctgctacttccagaacctcttccccatcacagccatgtttgtcagcatctactccatgaccgccattgctgccgacaggtacatggccatcgtccaccccttccagcctcggctttcagctcccagcaccaaggcggttattgctggcatctggctggtggctctcgccctggcctcccctcagtgcttctactccaccgtcaccatggaccagggtgccaccaagtgcgtggtggcctggcccgaagacagcgggggcaagacgctcctcctgtaccacctcgtggtgatcgccctcatctacttcctgccgctcgcggtgatgtttgtagcctacagcgtcatcggcctcacgctctggaggcgcgcagtgcccggacatcaggcgcacggtgccaacctccgccatctgcaggccaagaagaagtttgtgaagaccatggtgctggtggtgctgacgtttgccatctgctggctgccctaccacctctacttcatcctgggcagcttccaggaggacatctactgccacaagttcatccagcaagtctacctggcactcttctggttggccatgagctctaccatgtacaatcccatcatctactgctgtctcaaccacaggtttcgctctgggttccggcttgccttccgctgctgcccatgggtcacacccaccaaggaagataagctcgagctgactcccacgacctccctctccacgagagtcaacaggtgtcacactaaggagactttgttcatggctggggacacagccccctccgaggctaccagtggggaggcggggcgtccccaggatggatcagggctatggtttgggtatggtttgcttgcccccaccaaaactcatgttgaaatttga

SEQ ID NO: 1151 - DNA, 1398 bp, Homo sapiens
atggccactctcccagcagcagaaacctggatagacgggggtggaggcgtgggtgcagacgccgtgaacctgaccgcctcgctagctgccggggcggccacgggggcagttgagactgggtggctgcaactgctggaccaagctggcaacctctcctcctccccttccgcgctgggactgcctgtggcttcccccgcgccctcccagccctgggccaacctcaccaaccagttcgtgcagccgtcctggcgcatcgcgctctggtccctggcgtatggtgtggtggtggcagtggcagttttgggaaatctcatcgtcatctggatcatcctggcccacaagcgcatgaggactgtcaccaactacttccttgtgaacctggctttctccgacgcctccatggccgccttcaacacgttggtcaatttcatctacgcgcttcatagcgagtggtactttggcgccaactactgccgcttccagaacttctttcctatcacagctgtgttcgccagcatctactccatgacggccattgcggtggacaggtatatggctattattgatcccttgaaacccagactgtctgctacagcaaccaagattgtcattggaagtatttggattctagcatttctacttgccttccctcagtgtctttattccaaaaccaaagtcatgccaggccgtactctctgctttgtgcaatggccagaaggtcccaaacaacatttcacttaccatattatcgtcattatactggtgtactgtttcccattgctcatcatgggtattacatacaccattgttggaattactctctggggaggagaaatcccaggagatacctgtgacaagtatcatgagcagctaaaggccaaaagaaaggttgtcaaaatgatgattattgttgtcatgacatttgctatctgctggctgccctatcatatttacttcattctcactgcaatctatcaacaactaaatagatggaaatacatccagcaggtctacctggctagcttttggctggcaatgagctcaaccatgtacaatcccatcatctactgctgtctgaataaaagatttcgagctggcttcaagagagcatttcgctggtgtcctttcatcaaagtttccagctatgatgagctagagctcaagaccaccaggtttcatccaaaccggcaaagcagtatgtacaccgtgaccagaatggagtccatgacagtcgtgtttgaccccaacgatgcagacaccaccaggtccagtcggaagaaaagagcaacgccaagagacccaagtttcaatggctgctctcgcaggaattccaaatctgcctccgccacttcaagtttcataagctcaccctatacctctgtggatgaatattcttaa

SEQ ID NO: 1152 - DNA, 1020 bp, Homo sapiens
atgatgcccttttgccacaatataattaatatttcctgtgtgaaaaacaactggtcaaatgatgtccgtgcttccctgtacagtttaatggtgctcataattctgaccacactcgttggcaatctgatagttattgtttctatatcacacttcaaacaacttcataccccaacaaattggctcattcattccatggccactgtggactttcttctggggtgtctggtcatgccttacagtatggtgagatctgctgagcactgttggtattttggagaagtcttctgtaaaattcacacaagcaccgacattatgctgagctcagcctccattttccatttgtctttcatctccattgaccgctactatgctgtgtgtgatccactgagatataaagccaagatgaatatcttggttatttgtgtgatgatcttcattagttggagtgtccctgctgtttttgcatttggaatgatctttctggagctaaacttcaaaggcgctgaagagatatattacaaacatgttcactgcagaggaggttgctctgtcttctttagcaaaatatctggggtactgacctttatgacttctttttatatacctggatctattatgttatgtgtctattacagaatatatcttatcgctaaagaacaggcaagattaattagtgatgccaatcagaagctccaaattggattggaaatgaaaaatggaatttcacaaagcaaagaaaggaaagctgtgaagacattggggattgtgatgggagttttcctaatatgctggtgccctttctttatctgtacagtcatggacccttttcttcactacattattccacctactttgaatgatgtattgatttggtttggctacttgaactctacatttaatccaatggtttatgcatttttctatccttggtttagaaaagcactgaagatgatgctgtttggtaaaattttccaaaaagattcatccaggtgtaaattatttttggaattgagttcatag

SEQ ID NO: 1153 - DNA, 1035 bp, Homo sapiens
atgagcagcaattcatccctgctggtggctgtgcagctgtgctacgcgaacgtgaatgggtcctgtgtgaaaatccccttctcgccgggatcccgggtgattctgtacatagtgtttggctttggggctgtgctggctgtgtttggaaacctcctggtgatgatttcaatcctccatttcaagcagctgcactctccgaccaattttctcgttgcctctctggcctgcgctgatttcttggtgggtgtgactgtgatgcccttcagcatggtcaggacggtggagagctgctggtattttgggaggagtttttgtactttccacacctgctgtgatgtggcattttgttactcttctctctttcacttgtgcttcatctccatcgacaggtacattgcggttactgaccccctggtctatcctaccaagttcaccgtatctgtgtcaggaatttgcatcagcgtgtcctggatcctgcccctcatgtacagcggtgctgtgttctacacaggtgtctatgacgatgggctggaggaattatctgatgccctaaactgtataggaggttgtcagaccgttgtaaatcaaaactgggtgttgacagattttctatccttctttatacctacctttattatgataattctgtatggtaacatatttcttgtggctagacgacaggcgaaaaagatagaaaatactggtagcaagacagaatcatcctcagagagttacaaagccagagtggccaggagagagagaaaagcagctaaaaccctgggggtcacagtggtagcatttatgatttcatggttaccatatagcattgattcattaattgatgcctttatgggctttataacccctgcctgtatttatgagatttgctgttggtgtgcttattataactcagccatgaatcctttgatttatgctttattttacccatggtttaggaaagcaataaaagttattgtaactggtcaggttttaaagaacagttcagcaaccatgaatttgttttctgaacatata

SEQ ID NO: 1154 - DNA, 2932 bp, Homo sapiens
gtaatgcagagataataaaacttcttaggtccataggtcttataataatttaataacctaaacatggtatacaaattcctccaaacccaataacataattatagtttcaaaaagttccccaaactttcaagttagattttattgctttgatgagtggctttaaatatgaaaagtcttgcctgtgaagggcaatccttttcccgtggactgggatctatagaaatacagaaatgtgcccaggggttcatctccctaataaccatcattcacatttctcaacctccctaataaccagccaccatgtgagaaggatccacagttactgtttatgactataattaactagtacctgggactggtcagtggagttggttgcaacctgatgctaaggatgtcaaagttgtctcggcctctgttcccagccagtaagtaattccctggcctcgggccataccccctaatcttggtcagctgattatgacaggcagacagcacagtaaataacactatatattaagaaaacccaaagcatatgtatcaatggtatatacccaacagcatcctaggaatggagagtctgtagcaagggcctccaatgtgaaggtcaacacagtcactgtgatgcgtgtatttccattttgtaaagcatgatctctggtggtcatttttatcttcctaacttattggaaaagtctcctgttttgggggcccgcccctggtcacagccagactgactcagtttccctgggaggtcccgctcgagcccgtccttcccctccctctgcccgcccccagccctcgccccaccctcggcgcccgcacatctgcctgctcagctccagacggcgcccggacccccgggcgcgggatccagccaggtgggagccccgcagatgaggtctctgaaggtgtgcctgaaccagtgccagcctgccctgtctgcagcatcggcctgatggggtggtgactgatccctcagggctccggagccatgtggcccaacggcagttccctggggccctgtttccggcccacaaacattaccctggaggagagacggctgatcgcctcgccctggttcgccgcctccttctgcgtggtgggcctggcctccaacctgctggccctgagcgtgctggcgggcgcgcggcaggggggttcgcacacgcgctcctccttcctcaccttcctctgcggcctcgtcctcaccgacttcctggggctgctggtgaccggtaccatcgtggtgtcccagcacgccgcgctcttcgagtggcacgccgtggaccctggctgccgtctctgtcgcttcatgggcgtcgtcatgatcttcttcggcctgtccccgctgctgctgggggccgccatggcctcagagcgctacctgggtatcacccggcccttctcgcgcccggcggtcgcctcgcagcgccgcgcctgggccaccgtggggctggtgtgggcggccgcgctggcgctgggcctgctgcccctgctgggcgtgggtcgctacaccgtgcaatacccggggtcctggtgcttcctgacgctgggcgccgagtccggggacgtggccttcgggctgctcttctccatgctgggcggcctctcggtcgggctgtccttcctgctgaacacggtcagcgtggccaccctgtgccacgtctaccacgggcaggaggcggcccagcagcgtccccgggactccgaggtggagatgatggctcagctcctggggatcatggtggtggccagcgtgtgttggctgccccttctggtcttcattgcccagacagtgctgcgaaacccgcctgccatgagccccgccgggcagctgtcccgcaccacggagaaggagctgctcatctacttgcgcgtggccacctggaaccagatcctggacccctgggtgtatatcctgttccgccgcgccgtgctccggcgtctccagcctcgcctcagcacccggcccaggtcgctgtccctccagccccagctcacgcagcgctccgggctgcagtaggaagtggacagagcgcccctcccgcgcctttccgcggagcccttggcccctcggacagcccatctgcctgttctgaggattcaggggctgggggtgctggatggacagtgggcatcagcagcagggttttgggttgaccccaatccaacccggggacccccaactcctccctgatccttttaccaagcactctcccttcctcggcccctttttcccatccagagctcccaccccttctctgcgtccctcccaaccccaggaagggcatgcagacattggaagagggtcttgcattgctatttttttttttagacggagtcttgctctgtcccccaggctggagtgcagtggcgcaatctcagctcactgcaacctccacctcccgggttcaagcgattctcctgcctcagcctcctgagtagctgggactataggcgcgcgccaccacgcccggctaatttttgtatttttagtagagacggggtttcaccgtgttggccaggctggtcttgaactcctgacctcaggtgattcaccagcctcagcctcccaaagtgctgggatcacaggcatgaaccaccacacctggccattttttttttttttttagacggagtctcactctgtggcccagcctggagtacagtggcacgatctcggctcactgcaacctccgcctcccgggttcaagcgattctcgtgcctcagcctcccgagcagctgggattacaggcgtaagccactgcgcccggccttgcatgctctttgaccctgaatttgacctacttgctggggtacagttgcttccttttgaacctccaacagggaaggctctgtccagaaaggattgaatgtgaaacgggggcacccccttttcttgccaaaatatatctctgcctttggttttat

SEQ ID NO: 1155 - DNA, 5680 bp, Homo sapiens
gggcgatgggttgatgggcgccgggggacgcaggatgcggggggcgcccgcgcgcctgctgctgccgctgctgccgtggctcctgctgctcctggcgcccgaggctcggggcgcgcccggctgcccgctatccatccgcagctgcaagtgctcgggggagcggcccaaggggctgagcggcggcgtccctggcccggctcggcggagggtggtgtgcagcggcggggacctcccggagcctcccgagcccggccttctgcctaacggcaccgttaccctgctcttgagcaataacaagatcacggggctccgcaatggctccttcctgggactgtcactgctggagaagctggacctgaggaacaacatcatcagcacagtgcagccgggcgccttcctgggcctgggggagctgaagcgtttagatctctccaacaaccggattggctgtctcacctccgagaccttccagggcctccccaggcttctccgactaaacatatctggaaacatcttctccagtctgcaacctggggtctttgatgagctgccagcccttaaggttgtggacttgggcaccgagttcctgacctgtgactgccacctgcgctggctgctgccctgggcccagaatcgctccctgcagctgtcggaacacacgctctgtgcttaccccagtgccctgcatgctcaggccctgggcagcctccaggaggcccagctctgctgcgagggggccctggagctgcacacacaccacctcatcccgtccctacgccaagtggtgttccagggggatcggctgcccttccagtgctctgccagctacctgggcaacgacacccgcatccgctggtaccacaaccgagcccctgtggagggtgatgagcaggcgggcatcctcctggccgagagcctcatccacgactgcaccttcatcaccagtgagctgacgctgtctcacatcggcgtgtgggcctcaggcgagtgggagtgcaccgtgtccatggcccaaggcaacgccagcaagaaggtggagatcgtggtgctggagacctctgcctcctactgccccgccgagcgtgttgccaacaaccgcggggacttcaggtggccccgaactctggctggcatcacagcctaccagtcctgcctgcagtatcccttcacctcagtgcccctgggcgggggtgccccgggcacccgagcctcccgccggtgtgaccgtgccggccgctgggagccaggggactactcccactgtctctacaccaacgacatcaccagggtgctgtacaccttcgtgctgatgcccatcaatgcctccaatgcgctgaccctggctcaccagctgcgcgtgtacacagccgaggccgctagcttttcagacatgatggatgtagtctatgtggctcagatgatccagaaatttttgggttatgtcgaccagatcaaagagctggtagaggtgatggtggacatggccagcaacctgatgctggtggacgagcacctgctgtggctggcccagcgcgaggacaaggcctgcagccgcatcgtgggtgccctggagcgcattgggggggccgccctcagcccccatgcccagcacatctcagtgaatgcgaggaacgtggcattggaggcctacctcatcaagccgcacagctacgtgggcctgacctgcacagccttccagaggagggagggaggggtgccgggcacacggccaggaagccctggccagaaccccccacctgagcccgagcccccagctgaccagcagctccgcttccgctgcaccaccgggaggcccaatgtttctctgtcgtccttccacatcaagaacagcgtggccctggcctccatccagctgcccccgagtctattctcatcccttccggctgccctggctcccccggtgcccccagactgcaccctgcaactgctcgtcttccgaaatggccgcctcttccacagccacagcaacacctcccgccctggagctgctgggcctggcaagaggcgtggcgtggccacccccgtcatcttcgcaggaaccagtggctgtggcgtgggaaacctgacagagccagtggccgtttcgctgcggcactgggctgagggagccgaacctgtggccgcttggtggagccaggaggggcccggggaggctgggggctggacctcggagggctgccagctccgctccagccagcccaatgtcagcgccctgcactgccagcacttgggcaatgtggccgtgctcatggagctgagcgcctttcccagggaggtggggggcgccggggcagggctgcaccccgtggtatacccctgcacggccttgctgctgctctgcctcttcgccaccatcatcacctacatcctcaaccacagctccatccgtgtgtcccggaaaggctggcacatgctgctgaacttgtgcttccacatagccatgacctctgctgtctttgcggggggcatcacactcaccaactaccagatggtctgccaggcggtgggcatcaccctgcactactcctccctatccacgctgctctggatgggcgtgaaggcgcgagtgctccataaggagctcacctggagggcaccccctccgcaagaaggggaccccgctctgcctactcccagtcctatgctccggttctatttgatcgctggagggattccactcattatctgtggcatcacagctgcagtcaacatccacaactaccgggaccacagcccctactgctggctggtgtggcgtccaagccttggcgccttctacatccctgtggctttgattctgctcatcacctggatctatttcctgtgcgccgggctacgcttacggggtcctctggcacagaaccccaaggcgggcaacagcagggcctccctggaggcaggggaggagctgaggggttccaccaggctcaggggcagcggccccctcctgagtgactcaggttcccttcttgctactgggagcgcgcgagtggggacgcccgggcccccggaggatggtgacagcctctattctccgggagtccagctaggggcgctggtgaccacgcacttcctgtacttggccatgtgggcctgcggggctctggcagtgtcccagcgctggctgccccgggtggtgtgcagctgcttgtacggggtggcagcctccgccctgggcctcttcgtcttcactcaccactgtgccaggcggagggacgtgagagcctcgtggcgcgcctgctgcccccctgcctctcccgcggccccccatgccccgccccgggccctgcccgccgccgcagaggacggttccccggtgttcggggaggggcccccctccctcaagtcctccccaagcggcagcagcggccatccgctggctctgggcccctgcaagctcaccaacctgcagctggcccagagtcaggtgtgcgaggcgggggcggcggccggcggggaaggagagccggagccggcgggcacccggggaaacctcgcccaccgccaccccaacaacgtgcaccacgggcgtcgggcgcacaagagccgggccaagggacaccgcgcgggggaggcctgcggcaagaaccggctcaaggccctgcgcgggggcgcggcgggggcgctggagctgctgtccagcgagagcggtagtctgcacaacagccccaccgacagctacctgggcagcagccgcaacagcccgggcgccggcctgcagctggaaggcgagcccatgctcacgccgtccgagggcagcgacaccagcgccgcgccgctttctgaggcgggccgggcaggccagcgccgcagcgccagccgcgacagtctcaagggcggcggcgcgctggagaaggagagccatcgccgctcgtacccgctcaacgccgccagcctaaacggcgcccccaaggggggcaagtacgacgacgtcaccctgatgggcgcggaggtagccagcggcggctgcatgaagaccggactctggaagagcgaaactaccgtctaaggtggggcgggcgacgcggtagacgggctggccacgcggctcgttcccccgctcctcggggccctccaaggtgtctccgtagtcagcaggttggaggcagaggagccgatggctggaggaagcccacaggcggatgttccccacttgcctagagggcatccctctggggtagcgacagacaatcccagaaacacgcataatacatttccgtccagcccggggcagtctgactgtcggtgccctcccaggaacggggaaggcctccgtctgtgtgaaagggcacagcacatcccaggtgcaccctccccaagtactcccaccccgcctactgtccatgcggcctcactgggggccatcagcctcaccagcaaagcagagatgagagcgtgggaactgtgttctttcctccctgccctctactgatttcagcccagcccctgcctagatcctaggtcccttttcctcccgagtttggctggcacgagagctagcccagcacatgaagcaggtgatgttaagtcacaaggtgctgcttttcagatccactatgcaagaggggagggtggggccacgtgaaaggcagctctagacatcaaccagtcctgggggaggggagtgggaaccgggcacaactaggaacaatgccaccattcccacaggagtggtacttaaaccagacagcagggttcagaggtggcacaccgggacaaagctgaggccctgcacctcaacagctgactgccaggtgcctgtgggtgaactgaggggagtagagggagagggcaggtggaactggggcagaatctagtcatgccctaaagctagtcctgtaaacaatggtgccccagaaagctgcaggtggtgtttggagaagcagttacttttcagttacaagacccatctccctagtctcagccttacaacaccacgggactaaggaagagcacttccttgcctccgtaaggccagaggaagaaccatcccaatcatttgatctccagctccacagtagagagaaacctacaaaatgtcaaaccagcttcccgactcccaggagctcaagccaagcccagaggcagtggctggggtccctgcaggtcatgaggggcctatgcctttactccttttaaacaccagcacccgtcttttccccaacctaaaaccaaccaccagcatttcactacaggaccaaatggaaaccgagggaaccctgggtcttgggaagaacaacaggaaaccaaggtctgacctagggttccctcccagtcttcacatcactctggcctcatcaccaaggtgacagaggacacaggggagggggaaaacccacacacactccttggaatgggtcctgttatttatgcttgctgcacagacatattagaagaaaaaaaaaagctttgtattattcttccacatatgctggctgctgtttacacaccctgccaatgccttagcactggagagctttttgcaatatgctggggaaaggggagggagggaatgaaagtgccaaagaaaacatgtttttaagaactcgggttttatacaatagaatgttttctagcagatgcctcttgttttaatatattaaaattttgcaaagccctttgagctacaaaaaaaaaaaaaaaaaaaaaaaaaaaaaaa

SEQ ID NO: 1156 - DNA, 1998 bp, Homo sapiens
cggcgcgatgcgcggagacccccgcgggggcggcggcggccgtgagccccgatgaggcccgagcgtccccggccgcgcggcagcgcccccggcccgatggagaccccgccgtgggacccagcccgcaacgactcgctgccgcccacgctgaccccggccgtgcccccctacgtgaagcttggcctcaccgtcgtctacaccgtgttctacgcgctgctcttcgtgttcatctacgtgcagctctggctggtgctgcgttaccgccacaagcggctcagctaccagagcgtcttcctctttctctgcctcttctgggcctccctgcggaccgtcctcttctccttctacttcaaagacttcgtggcggccaattcgctcagccccttcgtcttctggctgctctactgcttccctgtgtgcctgcagtttttcaccctcacgctgatgaacttgtacttcacgcaggtgattttcaaagccaagtcaaaatattctccagaattactcaaataccggttgcccctctacctggcctccctcttcatcagccttgttttcctgttggtgaatttaacctgtgctgtgctggtaaagacgggaaattgggagaggaaggttatcgtctctgtgcgagtggccattaatgacacgctcttcgtgctgtgtgccgtctctctctccatctgtctctacaaaatctctaagatgtccttagccaacatttacttggagtccaagggctcctccgtgtgtcaagtgactgccatcggtgtcaccgtgatactgctttacacctctcgggcctgctacaacctgttcatcctgtcattttctcagaacaagagcgtccattcctttgattatgactggtacaatgtatcagaccaggcagatttgaagaatcagctgggagatgctggatacgtattatttggagtggtgttatttgtttgggaactcttacctaccaccttagtcgtttatttcttccgagttagaaatcctacaaaggaccttaccaaccctggaatggtccccagccatggattcagtcccagatcttatttctttgacaaccctcgaagatatgacagtgatgatgaccttgcctggaacattgcccctcagggacttcagggaggttttgctccagattactatgattggggacaacaaactaacagcttcctggcacaagcaggaactttgcaagactcaactttggatcctgacaaaccaagccttgggtagcatcagttaacagttttatggacgattcctcagatgaaaagcttcagaaaagcatagtgacagctgaatttttagggcacttttccttaagaaatagaacttgatttttatttgttacaggtttccaatggccccataggaataagcaataatgtagactgataaacccttattttagtactaaagagggagccttgctatttcagtgggtataatttaaactttttaaagaaaatctgtacttttataaagatgtattttgtataacttaaataataatgctaaagtatactagggtttttttttcttgagaatgttactgcaatcatgttgtagtttgcacagacttttatgcataattcactttaaaaatatagaatatatggtctaatagttttttaaagcttttggactaaagtattccacaaatcttacctctttaggtcactgatggtcactccgattctgagtgccacattggtagactcctaaaatacagttgacaacttagccaattgcaactccagtgttgataattaaaatgaaatggtaaagcagcagactgtaaggtctttagagatttttttttaaggttcaggccgtaggttcctcaaggaatctcttaagttttgcccaaagactggtacttcctttcagtagggcgctaatgtatacacattaatgataagttgataacattaaaaatgtagctgacttatcctattaaacctcctctgctatgttcac

SEQ ID NO: 1157 - DNA, 1251 bp, Homo sapiens
atggagagtaacctgtctggcctggtgcctgctgccgggctggtgcctgcgctgccacctgctgtgaccctggggctgacagctgcctacaccaccctgtatgccctgctcttcttctccgtctatgcccagctctggctggtgcttctgtatgggcacaagcgtctcagctatcagacggtgttcctggccctctgtctgctctgggccgccttgcgtaccaccctcttctccttctacttccgagatactccccgcgccaaccgcctggggcccttgcccttctggcttctctactgctgccccgtctgcctgcagttcttcaccttgacgcttatgaacctctactttgcccaggtggtgttcaaggccaaggtgaagcgtcggccggagatgagccgaggcttgctcgctgtccgaggggcctttgtgggggcctcgctgctctttctgctggtgaacgtgctgtgtgctgtgctctcccatcggcgccgggcacagccctgggccctgctgcttgtccgcgtcctggtgagcgactccctgttcgtcatctgcgcgctgtctcttgctgcctgcctctgcctcgtcgccaggcgggcgccctccactagcatctacctggaggccaaggggaccagtgtgtgccaggcggccgcgatgggtggcgccatggtcctgctctatgccagccgggcctgctacaacctgacagcactggccttggccccccagagccggctggacaccttcgattacgactggtacaatgtgtctgaccaggcggacctggtgaatgacctggggaacaaaggctacctggtatttggcctcatcctcttcgtgtgggagctactgcccaccaccctgctggtgggcttcttccgggtgcaccggcccccacaggacctgagcaccagccacatcctcaatgggcaggtctttgcctctcggtcctacttctttgaccgggctgggcactgtgaagatgagggctgctcctgggagcacagccggggtgagagcaccaggtgccaggaccaggcggccaccaccacagtctctactccaccccacagacgtgatccccctccctcccccacagaatacccaggccccagtccccctcaccctaggcccctgtgccaagtttgtctgccgcttcttgcccaggatcctgggggtcgtggctaccccctcctctggccggctccttgctgctcctgtcatagtgagcttgtgccgtccccc

SEQ ID NO: 1158 - DNA, 2527 bp, Homo sapiens
ccagccctggcgtgggcccagcccggcccaggcagcaatggggttcctgcagctgctggtcgtagcggtgctggcatccgaacaccgggtggctggtgcagccgaggtcttcgggaattccagcgagggtcttattgaattttctgtggggaaatttagatacttcgagctcaataggccctttccagaggaagctattttgcatgatatttcaagcaatgtgacttttcttattttccaaatacactcacagtatcagaatacaactgtttccttttctccgactctcctttccaattcctcggaaacaggcactgccagtggactggttttcatccttagaccagagcagagtacatgcacttggtacttggggacttcaggcatacagcctgtccagaatatggctatcctactctcctactcagaaagagatcctgtccctggaggctgtaatttggagttcgatttagatattgatcccaacatttacttggagtataatttctttgaaacgactatcaagtttgccccagcaaacctaggctatgcgagaggcgtagatcccccaccatgtgacgctgggacagaccaggactccaggtggaggttgcagtatgatgtctatcagtattttctgcctgagaatgacctcactgaggagatgttgctgaagcatctgcagaggatggtcagtgtgccccaggtgaaggccagtgctctcaaggtggttaccctaacagctaatgataagacaagtgtttccttctcctccctcccgggacaaggtgtcatatacaatgtcattgtttgggacccgtttctaaatacatctgctgcctacattcctgctcacacatacgcttgcagctttgaggcaggagagggtagttgtgcttccctaggaagagtgtcttccaaagtgttcttcactctttttgccctgcttggtttcttcatttgtttctttggacacagattctggaaaacagaattattcttcataggctttatcatcatgggattcttcttttatatactgattacaagactgacacctatcaagtatgatgtgaatctgattctgacagctgtcactggaagcgtcggtggaatgttcttggtagctgtgtggtggcgatttggaatcctctcgatctgcatgctctgtgttggactagtgctggggttcctcatctcgtcagtgactttctttactccactgggaaacctaaagatttttcatgatgatggtgtattctgggtcactttctcttgcatagctatcctcattccagtagttttcatgggctgcctaagaatactgaacatactgacttgtggagtcattggctcctattcggtggttttagccattgacagttactggtccacaagcctttcctacatcactttgaacgtactcaagagagcgctcaacaaggatttccacagagctttcacaaatgtgccttttcaaactaatgacttcattatcctggcagtatggggcatgctggctgtaagtggaattacgttacagattcgaagagagagaggacgaccgttcttccctccccacccatacaagttatggaagcaagagagagagcgccgagtgacaaacattctggaccctagctaccacattcctccattgagagagaggctctatggccgattaacccagattaaagggctcttccagaaggagcagccagctggagagagaacgcctttgcttctgtagatgcccaggggcttggtcagtgtgcctcagctttggagttcatgcctggagtggttcaacagtctctggtgcaagtctaataagagatcaggcatatatatctgttctttgcataatattatggtgcccttattgatatatggtaagggtgtactaggggattaggatgattgtaagagaatgagaaagatgaccaaaaggttggtggtagggaggctttttcttatttccaaatacttgagaaattaccttttggtttacaaatctatgatcaacttattccattaaatagatacattaaaaaaattaaaaactgcaaaaaaaaaaaaaaaactggtgtttctttttataaccccttgaaacaagtctctcacctgagcctgtctaaactttcggagggagtttattattgagtctttatctgtgacagtatttggagatttagggatttgatacttaggcctttgaattttagaatacaaaaagagaagcaagccagacatggtggctcacacctgtaatcccaatactgggaagccaaggtgggagtatcgcttgagcccaggagtttgagaccgacatgggcaacatgacaagaccccatctctacaaaaaaaattaaaaaattagccaggcatggtggcacatgcctactcccagctcccaaggagactgagatgggaggatccctggagccctgaagattgaggctacagtgagccttgattgtgtcactgcactccagcttgggtgacagagaccctgtctcgagaaatt

SEQ ID NO: 1159 - DNA, 1884 bp, Homo sapiens
gccttgcacatggagatgcttagctgagggggtggctttgttagactatttgcaggtcgtgagatagagcctgagatgggggactgggcccctgcctgggggattgggtcgtgacctgtgtggagccccacactgagctgcagtgggtggggagggtggtttacaggggtgctctgtgcagcccctctgattttcccctgggagtcccaggtccaggggaaggaggacagtggcccaggccacacagctcactgggcggctctcactcccccagggctggctgctggcgggatggacaccctggaggaggtgacttgggccaatgggagcacagcgctacccccacccctggcaccaaacatcagtgtgcctcatcgctgcctgctgctgctctacgaagacattggcacctccagggtccggtactgggacctcttgctgctcatccccaatgtgctcttcctcatcttcctgctctggaagcttccatctgctcgggcgaagatccgcatcacctccagccccatttttatcaccttctacatcctggtgtttgtggtggcgctggtgggcattgcccgggccgtggtatccatgacggtgagcacctcgaacgctgcaactgttgctgataagatcctgtgggagatcacccgcttcttcctgctggccatcgagctgagtgtgatcatcctgggcctggcctttggcacctgggagagtaagtccagcatcaagcgggtgctggccatcaccacagtgctgtccctggcctactctgtcacccaggggaccctggagatcctgtaccctgatgcccatctctcagctgaggactttaatatctatggccatgggggccgccagttctggctggtcagctcctgcttcttcttcctggtctactctctggtggtcatccttcccaagaccccgctgaaggagcgcatctccctgccttctcggaggagcttctacgtgtatgcgggcatcctggcactgctcaacctactgcaggggctggggagtgtgctgctgtgcttcgacatcatcgaggggctctgctgtgtagatgccacaaccttcctgtacttcagcttcttcgctccgctcatctacgtggctttcctccggggcttcttcggctcggagcccaagatcctcttctcctacaaatgccaagtggacgagacagaggagccagatgtacacctaccccagccctacgctgtggcccggcgggagggcctggaggctgcaggggctgctggggcctcagctgccagctactcgagcacgcagttcgactctgccggcggggtggcctacctggatgacatcgcttccatgccctgccacactggcagcatcaacagcacagacagcgagcgctggaaggccatcaatgcctgagggcagctgccagggcctgtggaggacaggccagagaggaggccagcaggcccagagtccccaggggaggaggaccaggtcaagggacgttctgtgggcagtagccctgtgtggccctgttcccaccatgagtctggaggccccacctccctggggctcccaatcccctttgccatctctgctctcactggggaccctcctccccttcccacctgctctcatactgctcagtgacatggcccaggctttccttccagggccatgcttggcaaggttggctgagggcaccctccttctctgcacccttggcacgagggcagggctggctctcccaatgcctccatcccatccccatggtgctttggcctcctcaaagcatccaccatggtggatggactgaagtgtgtatattttcttgatctattttttaataaaaaggaaaaggagcaaaaaaaaaaaaaaaaagttttg

SEQ ID NO: 1160 - DNA, 1348 bp, Homo sapiens
tagcttcaagccactgaagatggaaaacgagacagtcagtgaactgaaccaaacacagcttcagccacgagcagtggtggccttagaataccaggtggtcaccatcttacttgtactcattatttgtggcctgggcattgtaggcaacatcatggtagtcctggttgtcatgagaaccaagcacatgaggacccccacaaactgctacctggtgagcctggcagtagctgatctcatggtcttggtggccgcaggcctccccaacataacagacagtatctacggttcctgggtctatggctatgttggatgcctctgcattacttacctccagtatttgggaattaatgcatcctcttgttcaataacagcctttaccattgagaggtacatagcaatctgtcaccccatcaaagcccagtttctctgcacattttccagagccaaaaagattatcatctttgtctgggctttcacatctctttactgtatgctctggttcttcttgctggatctcaatattagcacctacaaagatgctattgtgatatcctgtggctacaagatctccaggaattactactcacctatttacctaatggactttggtgtcttttatgttgtgccaatgatcctggctaccgtcctctatggattcatagctagaatccttttcttaaatcccattccttcagatcctaaagaaaactctaagacatggaaaaatgattcaacccatcagaacacaaatctgaatgtaaatacctctaatagatgtttcaacagcacagtatcttcaaggaagcaggtcaccaagatgctggcagtggttgtaattctgtttgcccttttatggatgccctacaggactctagtggttgtcaactcatttctctccagtcctttccaagaaaattggtttttgctcttttgcagaatttgcatttatctcaacagtgccatcaacccggtgatttacaatctcatgtcccagaaattccgtgcagccttcagaaagctctgcaactgcaagcagaagccaacagagaaacctgctaactacagtgtggccctaaattacagcgtcatcaaggagtcagaccatttcagcacagagcttgatgatatcactgtcactgacacttacctgtctgccacaaaagtgtcttttgatgacacctgcttggcttctgaggtatcctttagccaaagttgattcatgaattagaagaaaatggatgacaaagaaattgagaatctgtgcagtcatcaacaaaagggagaacatggccaatagtcatatgtgaagacagagcagatcagtctttgtcaatgctctaacaaaccg

SEQ ID NO: 1161 - DNA, 2470 bp, Homo sapiens
ccgctcccgggtctccttttggcctggggtaacccgaggtgcagagctgagaatgaggcgatttcggaggatggagaaatagccccgagtcccgtggaaaatgaggccggcggacttgctgcagctggtgctgctgctcgacctgcccagggacctgggcggaatggggtgttcgtctccaccctgcgagtgccatcaggaggaggacttcagagtcacctgcaaggatattcaacgcatccccagcttaccgcccagtacgcagactctgaagcttattgagactcacctgagaactattccaagtcatgcattttctaatctgcccaatatttccagaatctacgtatctatagatgtgactctgcagcagctggaatcacactccttctacaatttgagtaaagtgactcacatagaaattcggaataccaggaacttaacttacatagaccctgatgccctcaaagagctccccctcctaaagttccttggcattttcaacactggacttaaaatgttccctgacctgaccaaagtttattccactgatatattctttatacttgaaattacagacaacccttacatgacgtcaatccctgtgaatgcttttcagggactatgcaatgaaaccttgacactgaagctgtacaacaatggctttacttcagtccaaggatatgctttcaatgggacaaagctggatgctgtttacctaaacaagaataaatacctgacagttattgacaaagatgcatttggaggagtatacagtggaccaagcttgctggacgtgtctcaaaccagtgtcactgcccttccatccaaaggcctggagcacctgaaggaactgatagcaagaaacacctggactcttaagaaacttccactttccttgagtttccttcacctcacacgggctgacctttcttacccaagccactgctgtgcttttaagaatcagaagaaaatcagaggaatccttgagtccttgatgtgtaatgagagcagtatgcagagcttgcgccagagaaaatctgtgaatgccttgaatagccccctccaccaggaatatgaagagaatctgggtgacagcattgttgggtacaaggaaaagtccaagttccaggatactcataacaacgctcattattacgtcttctttgaagaacaagaggatgagatcattggttttggccaggagctcaaaaacccccaggaagagactctacaagcttttgacagccattatgactacaccatatgtggggacagtgaagacatggtgtgtacccccaagtccgatgagttcaacccgtgtgaagacataatgggctacaagttcctgagaattgtggtgtggttcgttagtctgctggctctcctgggcaatgtctttgtcctgcttattctcctcaccagccactacaaactgaacgtcccccgctttctcatgtgcaacctggcctttgcggatttctgcatggggatgtacctgctcctcatcgcctctgtagacctctacactcactctgagtactacaaccatgccatcgactggcagacaggccctgggtgcaacacggctggtttcttcactgtctttgcaagcgagttatcggtgtatacgctgacggtcatcaccctggagcgctggtatgccatcaccttcgccatgcgcctggaccggaagatccgcctcaggcacgcatgtgccatcatggttgggggctgggtttgctgcttccttctcgccctgcttcctttggtgggaataagtagctatgccaaagtcagtatctgcctgcccatggacaccgagacccctcttgctctggcatatattgtttttgttctgacgctcaacatagttgccttcgtcatcgtctgctgctgtcatgtgaagatctacatcacagtccgaaatccgcagtacaacccaggggacaaagataccaaaattgccaagaggatggctgtgttgatcttcaccgacttcatatgcatggccccaatctcattctatgctctgtcagcaattctgaacaagcctctcatcactgttagcaactccaaaatcttgctggtactcttctatccacttaactcctgtgccaatccattcctctatgctattttcaccaaggccttccagagggatgtgttcatcctactcagcaagtttggcatctgtaaacgccaggctcaggcataccgggggcagagggttcctccaaagaacagcactgatattcaggttcaaaaggttacccacgacatgaggcagggtctccacaacatggaagatgtctatgaactgattgaaaactcccatctaaccccaaagaagcaaggccaaatctcagaagagtatatgcaaacggttttgtaagttaacactacactactcacaatggtaggggaacttacaaaataatagtttcttgaatatgcattccaatcccat

SEQ ID NO: 1162 - DNA, 2771 bp, Homo sapiens
ggccacaggccagcgccactctgccaggctcccggccatcgcccgcctggtgcgccgcccgccagctctttgcccgcgcggggccgcccgccgcgggctcagggcagaccatgcgcccgccaagtccgctgcccgcccgctggctatgcgtgctggcaggcgccctcgcctgggcccttgggccggcgggcggccaggcggccaggctgcaggaggagtgtgactatgtgcagatgatcgaggtgcagcacaagcagtgcctggaggaggcccagctggagaatgagacaataggctgcagcaagatgtgggacaacctcacctgctggccagccacccctcggggccaggtagttgtcttggcctgtcccctcatcttcaagctcttctcctccattcaaggccgcaatgtaagccgcagctgcaccgacgaaggctggacgcacctggagcctggcccgtaccccattgcctgtggtttggatgacaaggcagcgagtttggatgagcagcagaccatgttctacggttctgtgaagaccggctacaccattggctacggcctgtccctcgccacccttctggtcgccacagctatcctgagcctgttcaggaagctccactgcacgcggaactacatccacatgcacctcttcatatccttcatcctgagggctgccgctgtcttcatcaaagacttggccctcttcgacagcggggagtcggaccagtgctccgagggctcggtgggctgtaaggcagccatggtctttttccaatattgtgtcatggctaacttcttctggctgctggtggagggcctctacctgtacaccctgcttgccgtctccttcttctctgagcggaagtacttctgggggtacatactcatcggctggggggtacccagcacattcaccatggtgtggaccatcgccaggatccattttgaggattatgggtgctgggacaccatcaactcctcactgtggtggatcataaagggccccatcctcacctccatcttggtaaacttcatcctgtttatttgcatcatccgaatcctgcttcagaaactgcggcccccagatatcaggaagagtgacagcagtccatactcaaggctagccaggtccacactcctgctgatccccctgtttggagtacactacatcatgttcgccttctttccggacaattttaagcctgaagtgaagatggtctttgagctcgtcgtggggtctttccagggttttgtggtggctatcctctactgcttcctcaatggtgaggtgcaggcggagctgaggcggaagtggcggcgctggcacctgcagggcgtcctgggctggaaccccaaataccggcacccgtcgggaggcagcaacggcgccacgtgcagcacgcaggtttccatgctgacccgcgtcagcccaggtgcccgccgctcctccagcttccaagccgaagtctccctggtctgaccaccaggatcccaggggcccaaggcggcccctcccgccccttcccactcaccccggcagacgccggggacagaggcctgcccgggcgcggccagccccggccctgggctcggaggctgcccccggccccctggtctctggtccggacactcctagagaacgcagccctagagcctgcctggagcgtttctagcaagtgagagagatgggagctcctctcctggaggattgcaggtggaactcagtcattagactcctcctccaaaggccccctacgccaatcaagggcaaaaagtctacatactttcatcctgactctgccccctgctggctcttctgcccaattggaggaaagcaaccggtggatcctcaaacaacactggtgtgacctgagggcagaaaggttctgcccggggaaggtcaccagcaccaacaccacggtagtgcctgaaatttcaccattgctgtcaagttcctttgggttaagcattaccactcaggcatttgactgaagatgcagctcactaccctattctctctttacgcttagttatcagctttttaaagtgggttattctggagtttttgtttggagagcacacctatcttagtggttccccaccgaagtggactggcccctgggtcagtctggtgggaggacggtgcaacccaaggactgagggactctgaagcctctgggaaatgagaaggcagccaccagcgaatgctaggtctcggactaagcctacctgctctccaagtctcagtggcttcatctgtcaagtgggatctgtcacaccagccatacttatctctctgtgctgtggaagcaacaggaatcaagagctgccctccttgtccacccacctatgtgccaactgttgtaactaggctcagagatgtgcacccatgggctctgacagaaagcagatacctcaccctgctacacatacaggatttgaactcagatctgtctgataggaatgtgaaagcacggactcttactgctaacttttgtgtatcgtaaccagccagatcctcttggttatttgtttaccacttgtattattaatgccattatcctgaattccccttgccaccccaccctccctggcgtgtggctgaggaggcctccatctcatgtatcatctggataggagcctgctggtcacagcctcctctgtctgcccttcaccccagtggccactcagcttcctacccacacctctgccagaagatcccctcaggactgcaacaggcttgtgcaacaataaatgttggcttgga

SEQ ID NO: 1163 - DNA, 3974 bp, Homo sapiens
gtgcattgagcgcgctccagctgccgggacggagggggcggcccccgcgctcggggcgctcggctacagctgcggggcccgaggtctccgcgcactcgctcccggcccatgctggaggcggcggaaccgcggggacctaggacggaggcggcgggcgctgggcggcccccggcacgctgagctcgggatgcggacgctgctgcctcccgcgctgctgacctgctggctgctcgcccccgtgaacagcattcacccagaatgccgatttcatctggaaatacaggaggaagaaacaaaatgtgcagagcttctgaggtctcaaacagaaaaacacaaagcctgcagtggcgtctgggacaacatcacgtgctggcggcctgccaatgtgggagagaccgtcacggtgccctgcccaaaagtcttcagcaatttttacagcaaagcaggaaacataagcaaaaactgtacgagtgacggatggtcagagacgttcccagatttcgtcgatgcctgtggctacagcgacccggaggatgagagcaagatcacgttttatattctggtgaaggccatttataccctgggctacagtgtctctctgatgtctcttgcaacaggaagcataattctgtgcctcttcaggaagctgcactgcaccaggaattacatccacctgaacctgttcctgtccttcatcctgagagccatctcagtgctggtcaaggacgacgttctctactccagctctggcacgttgcactgccctgaccagccatcctcctgggtgggctgcaagctgagcctggtcttcctgcagtactgcatcatggccaacttcttctggctgctggtggaggggctctacctccacaccctcctggtggccatgctcccccctagaaggtgcttcctggcctacctcctgatcggatggggcctccccaccgtctgcatcggtgcatggactgcggccaggctctacttagaagacaccggttgctgggatacaaacgaccacagtgtgccctggtgggtcatacgaataccgattttaatttccatcatcgtcaattttgtccttttcattagtattatacgaattttgctgcagaagttaacatccccagatgtcggcggcaacgaccagtctcagtacaagaggctggccaagtccacgctcctgcttatcccgctgttcggcgtccactacatggtgtttgccgtgtttcccatcagcatctcctccaaataccagatactgtttgagctgtgcctcgggtcgttccagggcctggtggtggccgtcctctactgtttcctgaacagtgaggtgcagtgcgagctgaagcgaaaatggcgaagccggtgcccgaccccgtccgcgagccgggattacagggtctgcggttcctccttctcccgcaacggctcggagggcgccctgcagttccaccgcggctcccgcgcccagtccttcctgcaaacggagacctcggtcatctagccccacccctgcctgtcggacgcggcgggaggcccacggttcggggcttctgcggggctgagacgccggcttcctccttccagatgcccgagcaccgtgtcgggcaggtcagcgcggtcctgactccgtcaagctggttgtccactaaaccccatacctggaattggagtcgtgttgtcattgactcgatttaaactccagcatttagataatcttgtgcaaaatgtgtttcagccgtatagtggatccacttttttttttttttttttttgagacggagtcttgctctgtcgcccaggctggagtgcagtggcctgatctctgctccctgcaagctccgcctcccgggttcacgccattctcctgcctcagcctcccatagctgggactacaggcgcccgccaacacgcctggctaattttttgtatttttagtagagacagggtttcaccatgttagccaggatggtctcgatctcctgacctcgtgatgggcccgcctcggcctcccaaagtgctgggattaaggcgtgagccactgcgcccggcccaagagaataggggagccaaggaggaaatgtggaaacgcagttgtgtggcccagcacgagcctgggcgaccaccgggtgacatccgtcccacatcagggcggcctcccaggtcccataagggtagccccctcatctgcaggacagagggaagccagtcagggcccccccggacgttaggaccaggagaaatcaacaggagggcagcccgtcctctctcttggggcgcccacccggcccggctgagccctgccccacccaactccacagggctgttttgcctccccacggaaggcgggctgaggagacaaccagatcaggagagcaaggtcatgaaggaggggacctctccacacaggtgttccgtgggaccctcagcagctctggctctgcctcaggaggtcacctgccgccctgtgggagccgcagagcctgacgctcagccccaggccagctgcggccaggcctgcgggcccctggtgatggggttacgtggggtgcgggatacagctgagtgggaaccggaaacctattctctttttaacaaaaataatcttaggataagaattattttaacaacatataaaactgtttcaagccctcctccccagagctggcgctcagcagccctagcggctgctccttcaggcgaagggtggtttgcagatgtggggagggtgtctggggacgttgctgagctggctgcagaagggtggggatatcagggcacagtctccatgtgtgtgccaagccctggcccccacagcgctcgatggacctcagcaagctgcccagccctggcccaggtgccccgactgtgggactcagttgttctgagcacatttgactccacttttcctttaaaaatgaatgtcttgttcctgtgcattggtggcatcacagaccccagctggggcgcgatgtcaaaggtcgggacagctgtgccgggaggcagccacagggaagctcacacatcctgtcagtgtcaccttggtttgcaaaacccatatccccggtaaaatgaggccggacagaggggctgttaggacagcaaagcagcagtgtccagagacccctcaatccccaaaggtccgcaccctgtcctgcacaccctgggccacgccggccacacccctctgctgcaacaagctcatccctggacttctgggagaatgaacccgaggttggtttggggagacaggtgaggcggttggatctacagaacaacccaccatttctgggggccgcagaggatccatcacagacggatactggggagtaaacggcccaggccaggtgcccaggaaaggacggctgagcatgtggagcgagagggaggcaggtggacgctgcagaccccaggttcagtgcggcccctcggctgttcctcccctgtagggtttggacagacccacccccagccttgcccagctttcaaaggacaaaagggagcatcccccacctactctcaggtttttgaggaaacaaagatttgtggtaactgaaggtgttgggtcagtggccaggtgccgacactgagctgtgacccagaggggacgctgaggaagtgggcgtgagtggacatgtcaggtggttaccaggcactggttgttgatggtcggtggttgggtgtgggcagtcatcagtcatcaggtgtgctcaggggacaatctcccctcaaccgcacatgtgccactgttcagcggagctgactggtttctcctggtagagggccggctgtatcctgacagatgcctggtgagcaggggaagcaggacccagtggtcaacaggtgtctttaactgtcattgtgtgtggaatgtcgcagactcctccacgtggcgggaatgagctgtgtaaatacttcaataaagcctgatctcacatctgcaaaaaaaaaaaaaaaaaaaaaaaaaaaaaaaa

SEQ ID NO: 1164 - DNA, 19341 bp, Homo sapiens
agtaagaatcagcagcgcgggcaaggagtacggacgggagtcagaggcagagcgagggtgtgtggagggccggcggggaccgccgggagcgcgcggatgtcggtgttcctggggccagggatgccctctgcatctttattagtaaatcttctttcagctttactcatcctatttgtgtttggagaaacagaaataagatttactggacaaactgaatttgttgttaatgaaacaagtacaacagttattcgtcttatcattgaaaggataggagagccagcaaatgttactgcaattgtatcgctgtatggagaggacgctggtgacttttttgacacatatgctgcagcttttatacctgccggagaaacaaacagaacagtgtacatagcagtatgtgatgatgacttaccagggcctgacgaaacttttatttttcacttaacattacagaaaccttcagcaaatgtgaagcttggatggccaaggactgttactgtgacaatattatcaaatgacaatgcatttggaattatttcatttaatatgcttccctcaatcgcagtgagtgagcccaagggcagaaatgagtctatgcctcttactctcatcagggaaaagggaacctatggaatggtcatggtgacttttgaggtagagggtggcccaaatccccctgatgaagatttgagtccagttaaaggaaatatcacctttccccctggcagagcaacagtaatttataacttggcagtactcgatgacgaggtaccagaaaatgatgaaatatttttaattcaactgaaaagtgtagaaggaggagctgagattaacacctctaggaattccattgagatcatcattgagaaaaatgatagtcccgtgagattccttcagagtatttatttggttcctgaggaagaccacatactcataattccagtagttcgtggaaaggacaacaatggaaatctgattggatctgatgaatatgaggtttcaatcagttatgctgtcacaactgggaattccacagcacatgcccagcaaaatctggacttcattgatcttcagccaaacacaactgttgtttttccaccttttattcatgaatctcacttgaaatttcaaatagttgatgacaccataccggagattgctgaatcgtttcacattatgttactaaaagataccttacagggagatgctgtgctaataagcccttctgttgtacaagtcaccattaagccaaatgataaaccttatggagtcctttcattcaacagtgttttgtttgaaaggacagttataattgatgaagatagaatatcaagatatgaagaaatcacagtggttagaaatggaggaacccatgggaatgtctctgcgaattgggtggtgacaccgaacagcactgatccctcaccagtaacagcagatatcagaccgagctctggagttcttcattttgcacaagggcagatgttggcaacaattcctcttactgggggtgatgatgatcttccagaagaggcagaagcttatctacttcaaattctgcctcatacaatacgaggaggtgcagaagtgagcgagccagcggagcttttgttctacattcaggatagtgatgatgtctatggcctaataacattttttcctatggaaaaccagaagattgaaagcagcccaggtggacgatacttatccttgagttttacaagactaggagggactaaaggagatgtgaggttgctttattctgtactttacattcctgctggagctgtggaccccttgcaagcaaaagaaggcatcttaaatatatcaaggagaaatgacctcatttttccagagcaaaaaactcaagtcactacaaaattaccaataagaaatgatgcattccttcaaaatggagctcactttctagtacagttggaaactgtggagttgttaaacataattcctctaatcccacccataagccctagatttggggaaatctgcaatatttctttactggttactccagccattgcaaatggagaaattggctttctcagcaatcttccaattattttgcatgaaccagaagattttgctgctgaagtggtatacattcccttacatcgggatggaactgatggccaggctactgtctactggagtttgaagccctctggctttaattcaaaagcagtgaccccggatgatataggcccctttaatggctctgttttgtttttatctgggcaaagtgacacaacaatcaacattactatcaaaggtgatgacataccggaaatgaatgaaactgtaacactttctctagactgggttaacgtggaaaaccaagtgctgaaatctggatatactagccgtgacctaattattttggaaaatgatgaccctgggggagtttttgaattttctcctgcttccagaggaccctatgttataaaagaaggagaatctgtagagctccacatcatccgatcaagggggtcccttgttaagcagtttctacactaccgagtagagccaagagatagcaatgaattctatggaaacacgggagtactagaatttaaacctggagaaagggagatagtgatcaccttgctagcaagattggatgggataccagagttggatgaacactactgggtggtcctcagcagccacggagaacgggaaagcaagttgggaagtgccaccattgtcaatataacgattctgaaaaatgatgatcctcatggcattatagaatttgtttctgatggtctaattgtgatgataaatgaaagcaaaggagatgctatctatagtgctgtttatgatgtagtaagaaatcgaggcaactttggtgatgttagtgtatcatgggtggttagtccagactttacacaagatgtatttcctgtacaagggactgttgtctttggagatcaggaattttcaaaaaatatcaccatttactcccttccagatgagattccagaagaaatggaagaatttaccgttatcctactgaatggcactggaggagctaaagtgggaaatagaacaactgcaactctgaggattagaagaaatgatgaccccatttattttgcagaacctcgtgtagtgagggttcaagaaggggagactgccaactttacagttctcagaaatggatctgttgatgtgacttgcatggtccagtatgctaccaaggatgggaaggctactgcaagagagagagatttcattcctgttgaaaaaggagaaacgctcatttttgaggttggaagtagacagcagagcatatccatatttgttaatgaagatggtatcccggaaacagatgagcccttttatataatcctcttgaattcaccaggtgatccagtagtatatcaatatggagtagctacagtaataattgaagctaatgatgacccaaatggcattttttctctggagcccatagacaaagcagtggaagaaggaaagactaatgcattttggattttgaggcaccgaggatactttggtagtgtttctgtatcttggcagctctttcagaatgattctgctttgcagcctgggcaggagttctatgaaacttcaggaactgttaacttcatggatggagaagaagcaaaaccaatcattctccatgcttttccagataaaattcctgaattcaatgaattttatttcctaaaacttgtaaacatttcaggtggatccccaggtcctgggggccagctagcagaaaccaacctccaggtgacagtaatggctccattcaatgatgatccctttggagtttttatcttggatccagagtgtttagagagagaagtggcagaagatgtcctgtctgaagatgatatgtcttatattaccaacttcaccattttgaggcagcagggtgtgtttggtgatgtacaactgggctgggaaatactgtccagtgagttccctgctggtctgccaccaatgatagattttttactggttggaattttccccaccaccgtgcatttacaacagcacatgcggggtcaccacagtggaacggatgctttgtactttaccggactagaaggtgcatttgggactggtaattcaaaataccatcccttcaggaataatacaattgccaactttacattttcagcttgggtaatgcccaatgccaatacgaatggattcattatagcgaaggatgacggtaatggaagcatctactacggggtaaaaatacaaacaaacgaatcccatgtgacactttcccttcattataaaaccttgggttccaatgctacatacattgccaagacaacagtcatgaaatatttagaagaaagtgtttggcttcatctactaattatcctggaggatggtataatcgaattctacctggatggaaatgcaatgcccaggggaatcaagagtctgaaaggagaagccattactgacggtcctgggatactgagaattggagcagggataaatggcaatgacagatttacaggtctgatgcaggatgtgaggtcctatgagcggaaactgacgcttgaagaaatttatgaacttcatgccatgcccgcaaaaagtgatttacacccaatttctggatatctggagttcagacagggagaaactaacaaatcattcattatttctgcaagagatgacaatgacgaggaaggagaagaattattcattcttaaactagtttctgtatatggaggagctcgtatttcggaagaaaatactactgcaagattaacaatacaaaaaagtgacaatgcaaatggcttgtttggtttcacaggagcttgtataccagagattgcagaggagggatcaaccatttcttgtgtggttgagagaaccagaggagctctggattatgtgcatgttttttacaccatttcacagattgaaactgatggcattaattaccttgttgatgactttgctaatgccagtggaactattacattccttccttggcagagatcagaggttctgaatatatatgttcttgatgatgatattcctgaacttaatgagtatttccgtgtgacattggtttctgcaattcctggagatgggaagctaggctcaactcctaccagtggtgcaagcatagatcctgaaaaggaaacgactgatatcaccatcaaagctagtgatcatccatatggcttgctgcagttctccacagggctgcctcctcagcctaaggacgcaatgaccctgcctgcaagcagcgttccacatatcactgtggaggaggaagatggagaaatcaggttattggtcatccgtgcacagggacttctgggaagggtgactgcggaatttagaacagtgtccttgacagcattcagtcctgaggattaccagaatgttgctggcacattagaatttcaaccaggagaaagatataaatacattttcataaacatcactgataattctattcctgaactggaaaaatcttttaaagttgagttgttaaacttggaaggaggagtagctgaactctttagggttgatggaagtggtagtggtgatggggacatggaattcttccttccaactattcacaaacgtgccagtctaggagtggcttcccaaattctagtgacaattgcagcctctgaccacgctcatggcgtatttgaatttagccctgagtcactctttgtcagtggaactgaaccagaagatgggtatagcactgttacattaaatgttataagacatcatggaactctgtctccagtgactttgcattggaacatagactctgatcctgatggtgatctcgccttcacctctggcaacatcacatttgagattgggcagacgagcgccaatatcactgtggagatattgcctgacgaagacccagaactggataaggcattctctgtgtcagtcctcagtgtttccagtggttctttgggagctcatattaatgccacgttaacagttttggctagtgatgatccatatgggatattcattttttctgagaaaaacagacctgttaaagttgaggaagcaacccagaacatcacactatcaataataaggttgaaaggcctcatgggaaaagtccttgtctcatatgcaacactagatgatatggaaaaaccaccttattttccacctaatttagcgagagcaactcaaggaagagactatataccagcttctggatttgctctttttggagctaatcagagtgaggcaacaatagctatttcaattttggatgatgatgagccagaaaggtccgaatctgtctttatcgaactactcaactctactttagtagcgaaagtacagagtcgttcaattccaaattctccacgtcttgggcctaaggtagaaactattgcgcaactaattatcattgccaatgatgatgcatttggaactcttcagctctcagcaccaattgtccgagtggcagaaaatcatgttggacccattatcaatgtgactagaacaggaggagcatttgcagatgtctctgtgaagtttaaagctgtgccaataacagcaatagctggtgaagattatagtatagcttcatcagatgtggtcttgctagaaggggaaaccagtaaagccgtgccaatatatgtcattaatgatatctatcctgaactggaagaatcttttcttgtgcaactgatgaatgaaacaacaggaggagccagactaggggctttaacagaggcagtcattattattgaggcctctgatgacccctatggattatttggttttcagattactaaacttattgtagaggaacctgagtttaactcagtgaaggtaaacctgccaataattcgaaattctgggacactcggcaatgttaccgttcagtgggttgccaccattaatggacagcttgctactggcgacctgcgagttgtctcaggtaatgtgacctttgcccctggggaaaccattcaaaccttgttgttagaggtcctggctgacgacgttccggagattgaagaggttatccaagtgcaactaactgatgcctctggtggaggtactattgggttagatcgaattgcaaatattattattcctgccaatgatgatccttatggtacagtagcctttgctcagatggtttatcgtgttcaagagcctctggaaagaagttcctgtgctaatataactgtcaggcgaagcggagggcactttggtcggctgttgttgttctacagtacttccgacattgatgtagtggctctggcaatggaggaaggtcaagatttactgtcctactatgaatctccaattcaaggggtgcctgacccactttggagaacttggatgaatgtctctgccgtgggggagcccctgtatacctgtgccactttgtgccttaaggaacaagcttgctcagcgttttcatttttcagtgcttctgagggtccccagtgtttctggatgacatcatggatcagcccagctgtcaacaattcagacttttggacctacaggaaaaacatgaccagggtagcatctctttttagtggtcaggctgtggctgggagtgactatgagcctgtgacaaggcaatgggccataatgcaggaaggtgatgaattcgcaaatctcacagtgtctattcttcctgatgatttcccagagatggatgagagttttctaatttctctccttgaagttcacctcatgaacatttcagccagtttgaaaaatcagccaaccataggacagccaaatatttctacagttgtcatagcactaaatggtgatgcctttggagtgtttgtgatctacaatattagtcccaatacttccgaagatggcttatttgttgaagttcaggagcagccccaaaccttggtggagctgatgatacacaggacagggggcagcttaggtcaagtggcagtcgaatggcgtgttgttggtggaacagctactgaaggtttagattttataggtgctggagagattttgacctttgctgaaggtgaaaccaaaaagacagtcattttaaccatcttggatgactctgaaccagaggatgacgaaagtatcatagttagtttggtgtacactgaaggtggaagtagaattttgccaagctccgacactgttagagtgaacattttggccaatgacaatgtggcaggaattgttagctttcagacagcttccagatctgtcataggtcatgaaggagaaattttacaattccatgtgataagaactttccctggtcgaggaaatgttactgttaactggaaaattattgggcaaaatctagaactcaattttgctaactttagcggacaacttttctttcctgaggggtcgttgaatacaacattgtttgtgcatttgttggatgacaacattcctgaggagaaagaagtataccaagtcattctgtatgatgtcaggacacaaggagttccaccagccggaatcgccctgcttgatgctcaaggatatgcagctgtcctcacagtagaagccagtgatgaaccacatggagttttaaattttgctctttcatcaagatttgtgttactacaagaggctaacataacaattcagcttttcatcaacagagaatttggatctctaggagctatcaatgtcacatataccacggttcctggaatgctgagtctgaagaaccaaacagtaggaaacctagcagagccagaagttgattttgtccctatcattggctttctgattttagaagaaggggaaacagcagcagccatcaacattaccattcttgaggatgatgtaccagagctagaagaatatttcctggtgaatttaacttacgtgggacttaccatggctgcttcaacttcatttcctcccagactagattcagaaggtttgactgcacaagttattattgatgccaatgatggggcccgaggtgtaattgaatggcaacaaagcaggtttgaagtaaatgaaacccatggaagtttaacattggtagcccagaggagcagagaacctcttggccatgtttccttatttgtgtatgctcagaatttggaagcacaagtggggctggattatatcttcaccccaatgattcttcattttgctgatggagaaaggtataaaaatgtcaatatcatgattcttgatgatgacattccagaaggagatgaaaaatttcagctgattttaacaaatccttctcctggactagagctagggaaaaatacaatagccttaattattgtccttgctaatgatgacggccctggagttctatcatttaacaacagtgagcactttttcctaagagagccaacagctctctacgtccaggagagtgttgcagtattgtacattgttcgggaacctgcacaaggattgtttggaacagtgacagttcagttcattgtgacagaagtgaattcctcaaatgaatctaaagatctgactccttccaaaggctatattgttttagaagaaggtgttcgattcaaggccctacaaatatctgccatattagacacggaaccagaaatggatgagtattttgtttgcaccttgtttaatccaactggaggtgctagactaggggtgcatgttcaaaccctgataacagttttgcaaaaccaggcccctttggggctattcagtatctctgcagttgaaaatagagccacctccatagacatcgaagaagccaataggaccgtgtatttaaatgtatctcgaactaatgacattgatttggctgtgagtgtgcagtgggagacagtatctgaaacagcctttggcatgaggggaatggatgttgtgttttccgtatttcaaagttttttggatgaatcagcttctggctggtgtttctttactttggaaaatttaatatatggtataatgttaagaaaatcatctgttactgtttaccgatggcaggggatttttattccagttgaggatttaaatatagaaaatcctaaaacttgtgaggcctttaatattggtttttctccctactttgtgattactcatgaagaaagaaatgaagaaaagccttctcttaacagtgtgtttacattcacatctggatttaaattattcctggtacaaacaatcattattctggaaagttctcaagtaagatattttacttcagacagccaagattatttaatcattgcaagtcaaagagatgattccgaattaactcaggtcttcaggtggaatggaggaagcttcgtgttgcatcaaaaactccctgtccgaggtgtgctgaccgtggccttgttcaacaagggaggctctgtgttcttagccatttcccaggctaatgccaggctaaactcccttttattcagatggtctggcagtgggtttattaactttcaagaggtgcctgtcagtgggacaacagaagttgaggctttgtcttcagccaatgatatttacctaatatttgccgaaaatgtctttctaggagatcagaattcaattgatattttcatctgggagatgggacagtcttccttcaggtattttcagtctgtagattttgctgctgttaacagaatccactccttcacaccagcctcaggaatagcccacatacttcttattgggccaagatatgtctactcttttactgctggaaattcggagcgtaatcaattctcttttgttctggaagtaccttctgcttatgatgtggtttctgttacagtaaagtcccttaattcaagcaagaatttaatagctctagtgggagctcattcacatatatatgagctagcctacatttccagccattctgactttattcctagttcaggtgaactgatatttgaacctggtgagagagaagctacaatagcagtaaatatccttgatgatacagttccagaaaaagaagaatccttcaaagttcaacttaaaaatcccaaaggaggagcagagattggcattaatgattctgtaacaataaccattctgtctaatgatgatgcctatggaattgttgcatttgctcagaattcattatataagcaagtggaagaaatggagcaagatagcctagtaaccttgaacgttgaacgcttaaaaggaacatatggccgtataaccatagcatgggaagctgatggaagtattagtgatatatttcctacctcaggagtgattttatttactgaaggccaggtactgtcaacaatcactctaactattcttgctgataatataccagagttatcagaggttgtgattgtaaccctcacccgtatcaccacagaaggggttgaggactcatacaaaggtgctactattgatcaggacagaagcaagtctgttataacaactttgcccaatgactcaccttttggcttggtgggctggcgtgctgcgtctgtcttcattagagtagcagagcctaaagaaaacaccaccactcttcagttacaaatagctcgagataaaggactacttggggatattgccattcacttgagagctcaacccaatttcttactgcatgtcgataatcaagctactgagaatgaagattatgtattgcaagaaacaataataataatgaaagaaaacataaaagaagctcatgccgaagtttccattttgccggatgaccttcctgaattggaggaaggatttattgtcactatcactgaggtgaacctggtgaactctgacttctctacaggacagccaagtgtgcggaggcccggaatggaaatagctgagataatgatagaagaaaatgacgatcccagaggaatttttatgtttcatgttactagaggcgctggggaagttattactgcctatgaggtgcctccacccttgaacgttcttcaagttcctgtagtccggctggctggaagctttggggcagtaaatgtttattggaaagcatcaccagacagtgctggcctggaagactttaaaccatctcatgggattcttgaatttgcagataaacaggttactgcaatgatagaaatcaccataattgatgatgctgaatttgaattgacagagacgttcaatatttccttgatcagtgttgctggaggtggcagacttggtgatgatgttgtggtaactgttgttattccacaaaatgattctccatttggagtatttggatttgaagaaaagactgtaatgattgatgaatccctttcatccgatgaccctgattcatatgtgacattgacggttgtccggtccccaggaggaaaaggaaccgtccgacttgagtggaccatagatgagaaggctaaacataaccttagtcctttgaatgggacccttcattttgatgagactgagtcccagaagaccattgtgttgcacacacttcaagacacagtgttggaggaggacaggcgtttcaccattcagctgatatcaattgatgaggtagaaatatctccagtaaaaggtagtgcatcaataattattcggggtgataagcgagcatcaggagaagttgggatagctccgtcatctaggcacatcctcattggggaaccctcagcaaaatataatggtaccgctattatcagccttgttcgaggcccagggattttgggggaggtcacagtgttctggaggatattccctccttccgtgggggaatttgctgaaacatcaggaaaactgacaatgcgagacgaacagtctgcagtcattgtagtaatacaggctttgaacgatgacattcccgaggaaaaaagcttctatgagtttcagctcactgcagtcagtgggggaggagttctgagtgaatccagcagcactgccaacatcacggtggtggccagcgactctccctatggccgatttgccttttcacatgagcaacttcgagtgtcagaagcacagagggttaacatcacaatcatccgttccagtggagattttggccatgtgcgactctggtacaagacgatgagcgggacagcggaagcaggcttggattttgttcctgcagcaggggagctcctctttgaagcaggggagatgaggaaaagtctgcatgttgaaatccttgatgatgactatcctgaaggcccagaggaattttctctaacaattacaaaggtggaactccagggaagagggtatgattttaccattcaagaaaatggacttcagatagatcaacctcctgaaataggaaacatctccattgttcgcatcataataatgaaaaatgataacgcagaaggcatcattgaatttgacccaaagtatactgccttcgaagtggaggaagatgttgggctgatcatgatcccagtggtgaggctacatggaacttatggctatgtgacagctgatttcatctctcagagctcctctgccagtcccggaggtgttgattacattttgcatggcagtacagtcacctttcagcatgggcaaaacttaagttttataaatatctccatcattgatgacaatgaaagtgaatttgaggagcccattgaaattctactcactggagctactggaggagcggtccttgggcgccacctagtgagcagaatcataatagctaagagtgactctccctttggagttataaggtttctcaatcaaagcaaaatttctattgctaatcccaattccacaatgattttatcactggtgctggagcggactggaggactcttgggagagattcaggtgaactgggagacagtaggacccaactctcaagaagccttactgccacagaatagagacattgcagacccagtgagcgggttgttctattttggagaaggagaaggaggagtgagaaccataattctgacaatctatcctcatgaagaaattgaagttgaagagacattcattattaaacttcatcttgtgaaaggagaagctaaattagactccagagctaaagatgttacattaaccatacaagagtttggtgacccaaatggagttgttcagtttgctcctgaaactttgtctaagaagacttattcagagcctctggctctggaagggcccctgctcattaccttctttgtcagaagagtcaagggcacctttggagagattatggtttactgggaattaagtagtgagtttgacattactgaagactttctttccaccagtggatttttcaccattgctgatggagagagtgaagctagctttgatgttcatttgctaccagatgaggtacctgagatagaggaagattatgtgatccagcttgtttctgtagagggaggagccgaactggatctggagaagagtatcacatggttctctgtttatgcaaatgatgacccacatggagtatttgccctgtattcggatcgccagtcaatacttattgggcagaaccttattagatccatccaaattaacataacccggcttgctggaacatttggagatgtggctgttgggcttcgaatatcatcggatcataaagaacagccgattgttaccgaaaatgcagagaggcagctggtggtcaaagatggtgccacatataaagtggacgtggtgccaataaagaatcaggtcttcctatcactgggctctaatttcactttgcaactggtgactgtgatgcttgtcggtggacgtttctatggaatgccaacaattcttcaggaagcaaaatctgctgtccttccagtctctgagaaagctgccaattctcaggtcggatttgaatccactgcttttcaactcatgaacatcactgctggcacaagccacgttatgatttctaggagaggcacatatggagctctctcggttgcctggaccactggatatgctcctgggttagaaattcctgaattcattgttgttggcaacatgaccccaacactggggagcctttcattttcccacggtgaacaaaggaaaggagttttcctgtggacgtttcctagccctggttggccagaggcctttgttcttcacctatcaggagtgcagagcagtgctcctggcggagctcaactccgatcaggtttcattgttgctgaaattgaaccaatgggcgtcttccaattttccactagctcaagaaatatcatagtgtcagaagatacacagatgatcagattacatgtacaaagactatttgggttccacagcgatcttattaaagtttcttatcagaccactgcaggaagcgccaagccactggaagattttgagcctgttcagaatggggaactgttttttcaaaaattccaaactgaggttgattttgaaataaccattattaatgatcagctttctgagatagaagaatttttttacattaaccttacttcagtagaaattaggggattacaaaagtttgatgttaattggagcccacgcctgaatctagatttcagtgttgcagtgattacaatattggataatgatgacctggcaggaatggatatttccttccccgagacaactgtggctgtagcagttgacacaactctcattcctgtagaaactgaatccaccacatacctcagcacaagcaagacgactaccattctgcagccaaccaacgtggttgccattgttactgaggcaactggtgtatctgccatccctgagaaacttgtcacccttcatggcacacctgctgtgtctgaaaagcctgatgtggccactgtaactgccaatgtttccattcatggaacattcagccttgggccatccattgtttatattgaagaggagatgaagaatggcacattcaacactgcagaagttcttatccgaagaactggtgggtttactggcaatgtcagcataacagttaaaactttcggtgaaagatgtgctcagatggaaccaaatgcattgccctttcgtggtatctatgggatttccaacctaacatgggcagttgaagaagaagactttgaagaacaaactcttacccttatattcctagatggagaaagagaacgtaaagtatcagttcaaattttggatgatgatgagcctgaggggcaggaattcttctacgtgtttctcacaaaccctcaagggggagcacagattgtggaggggaaggatgatactggatttgcagcttttgccatggttattattacagggagtgaccttcacaatggcatcataggattcagtgaggagtcccagagtggactagaactcagggaaggagctgttatgagaagattgcaccttattgtcacaagacagccaaacagggcctttgaagatgtcaaggtcttttggcgagtcacacttaacaaaacagtcgtcgtgctccagaaggatggggtaaacctgatggaggaacttcagtctgtgtcagggaccacaacctgtacaatgggtcaaacaaaatgctttatcagcattgaactcaaaccagaaaaggtaccacaggttgaagtgtatttttttgtggaactatatgaagctactgctggagcagcaataaacaacagtgccagattcgcacagattaaaatcttagaaagtgatgaatctcaaagccttgtgtatttttctgtgggttctcggctggcagtggctcacaagaaggccactttaatcagtctgcaggtggccagagattctgggacaggactaatgatgtctgttaactttagtacccaggagttgaggagtgctgaaacaattggtcgtaccatcatatctccagctatttctggaaaggattttgtgataactgaaggcacattggtctttgaacctggccagagaagcactgtattggatgtcatcctaacgccagagacaggatctttaaattcatttcctaaacgcttccagattgtcctttttgacccaaaaggtggtgccagaattgataaagtgtatgggactgccaacatcactcttgtctcagatgcagattcgcaggccatttgggggcttgcagatcagctacatcagcctgtgaatgatgatattctcaacagagtgctccataccatcagcatgaaagtggccacagaaaacacagatgaacaactcagtgccatgatgcatctaatagaaaagataactactgaaggaaaaattcaagctttcagtgttgccagccgaactcttttctatgagattctttgttctcttattaacccaaagcgcaaggacactaggggattcagtcactttgctgaagtgactgagaattttgccttttctctgctgactaatgttacttgcggctctcctggtgaaaaaagcaaaaccatccttgatagttgcccatatttgtcaatattggctcttcactggtatcctcagcaaatcaatggacacaagtttgaaggaaaggaaggagattacattcgaattccagagaggctactggatgtccaggatgcagaaataatggctgggaaaagtacatgtaaattagtccagtttacagagtatagcagccaacagtggtttataagtggaaacaatcttcctaccctaaaaaataaggtattatctttgagtgtgaaaggtcagagttcacaactcctgactaatgacaatgaggttctctacaggatttatgctgctgagcctagaattattcctcagacatctctgtgtctcctttggaatcaggctgctgcaagctggttgtctgacagtcagttttgcaaagtgattgaggaaactgcagactatgtggaatgtgcctgttcacacatgtctgtgtatgctgtctatgctcggactgacaacttgtcttcatacaatgaagccttcttcacttctggatttatatgtatctcaggtctttgcttggctgttctttcccatatcttctgtgccaggtactccatgtttgcagctaaacttctgactcacatgatggcagccagcttaggtacacagattctgtttctggcgtctgcatacgcaagtccccaactcgctgaggagagctgttcagctatggctgctgtcacacattacctgtatctttgccagtttagctggatgctcattcagtctgtgaatttctggtacgtgctggtgatgaatgatgagcacacagagaggcgatatctgctgtttttccttctgagttggggactaccagcttttgtggtgattctcctcatagttattttgaaaggaatctatcatcagagcatgtcacagatctatggactcattcatggtgacctgtgttttattccaaacgtctatgctgctttgttcactgcagctcttgttcctttgacgtgcctcgtggtggtgttcgtggtgttcatccatgcctaccaggtgaagccacagtggaaagcatatgatgatgtcttcagaggaaggacaaatgctgcagaaattccactgattttatatctctttgctctgatttccgtgacatggctttggggaggactacacatggcctacagacacttctggatgttggttctctttgtcattttcaacagtctgcagggactttatgttttcatggtttatttcattttacacaaccaaatgtgttgccctatgaaggccagttacactgtggaaatgaatgggcatcctggacccagcacagcctttttcacgcccgggagtggaatgcctcctgctggaggggaaatcagcaagtccacccagaatctcatcggtgctatggaggaggtgccacctgactgggagagagcatccttccaacagggcagtcaggccagccctgatttaaagccaagtccacaaaatggagccacgttcccgtcctctggaggatatggccaggggtcactgatagccgatgaggagtcccaggagtttgatgatttaatatttgcattaaaaactggtgctggtctcagtgtcagtgataatgaatctggtcaaggcagccaggaggggggcaccttgactgactcccagatcgtggagctcaggaggatacccatcgccgacactcacctgtagcacctcactaaccattcgactgagcacactttcatatttgtatcagcttttgtgctaaaactctctaagtacatccacctgtgtaataggaacctgtgaattgtactggatgattaatacaaacgtgattgttgtatttggagtataaattactgattgtatgtgacctgaaaattcactgctataagaaaggtggagtcagtttgtatcagttaataggatgttcatattccaaggatattagttgtttttttaatcatcctatatggctaacattgtttaatgaaagtaataatcaataaagcaatagaatctaaaaaa

SEQ ID NO: 1165 - DNA, 1035 bp, Homo sapiens
atggccaattacacgctggcaccagaggatgaatatgatgtcctcatagaaggtgaactggagagcgatgaggcagagcaatgtgacaagtatgacgcccaggcactctcagcccagctggtgccatcactctgctctgctgtgtttgtgatcggagtcctggacaatctcctggttgtgcttatcctggtaaaatataaaggactcaaacgcgtggaaaatatctatcttctaaacttggcagtttctaacttgtgtttcttgcttaccctgcccttctgggctcatgctgggggcgatcccatgtgtaaaattctcattggactgtacttcgtgggcctgtacagtgagacatttttcaattgccttctgactgtgcaaaggtacctagtgtttttgcacaagggcaactttttctcagccaggaggagggtgccctgtggcatcattacaagtgtcctggcatgggtaacagccattctggccactttgcctgaatacgtggtttataaacctcagatggaagaccagaaatacaagtgtgcatttagcagaactcccttcctgccagctgatgagacattctggaagcattttctgactttaaaaatgaacatttcggttcttgtcctccccctatttatttttacatttctctatgtgcaaatgagaaaaacactaaggttcagggagcagaggtatagccttttcaagcttgtttttgccataatggtagtcttccttctgatgtgggcgccctacaatattgcatttttcctgtccactttcaaagaacacttctccctgagtgactgcaagagcagctacaatctggacaaaagtgttcacatcactaaactcatcgccaccacccactgctgcatcaaccctctcctgtatgcgtttcttgatgggacatttagcaaatacctctgccgctgtttccatctgcgtagtaacaccccacttcaacccagggggcagtctgcacaaggcacatcgagggaagaacctgaccattccaccgaagtgtaa

SEQ ID NO: 1166 - DNA, 2472 bp, Homo sapiens
atgggaggccgcgtctttctcgtctttctcgcattctgtgtctggctgactctgccgggagctgaaacccaggactccaggggctgtgcccggtggtgccctcaggactcctcgtgtgtcaatgccaccgcctgtcgctgcaatccagggttcagctctttttctgagatcatcaccacccccatggagacttgtgacgacatcaacgagtgtgcaacactgtcgaaagtgtcatgcggaaaattctcggactgctggaacacagaggggagctacgactgcgtgtgcagcccaggatatgagcctgtttctggggcaaaaacattcaagaatgagagcgagaacacgtgtcaagatgtggacgaatgtcagcagaacccaaggctctgtaaaagctacggcacctgcgtcaacaccctcggcagctacacgtgccagtgcctgcctggcttcaagctcaaacctgaggacccgaagctctgcacagatgtgaatgaatgcacctccggacaaaacccatgccacagctccacccactgcctcaacaacgtgggcagctatcagtgccgctgccgcccgggctggcaaccgattccggggtcccccaatggcccaaacaataccgtctgtgaagatgtggacgagtgcagctccgggcagcatcagtgtgacagctccaccgtctgcttcaacaccgtgggttcatacagctgccgctgccgcccaggctggaagcccagacacggaatcccgaataaccaaaaggacactgtctgtgaagatatgactttctccacctggaccccgccccctggagtccacagccagacgctttcccgattcttcgacaaagtccaggacctgggcagagactacaagccaggcttggccaataacaccatccagagcatcttacaggcgctggatgagctgctggaggcccctggggacctggagaccctgccccgcttacagcagcactgtgtggccagtcacctgctggatggcctagaggatgtcctcagaggcctgagcaagaacctttccaatgggctgttgaacttcagttatcctgcaggcacagaattgtccctggaggtgcagaagcaagtagacaggagtgtcaccttgagacagaatcaggcagtgatgcagctcgactggaatcaggcacagaaatctggtgacccaggcccttctgtggtgggccttgtctccattccagggatgggcaagttgctggctgaggcccctctggtcctggaacctgagaagcagatgcttctgcatgagacacaccagggcttgctgcaggacggctcccccatcctgctctcagatgtgatctctgcctttctgagcaacaacgacacccaaaacctcagctccccagttaccttcaccttctcccaccgttcagtgatcccgagacagaaggtgctctgtgtcttctgggagcatggccagaatggatgtggtcactgggccaccacaggctgcagcacaataggcaccagagacaccagcaccatctgccgttgcacccacctgagcagctttgccgtcctcatggcccactacgatgtgcaggaggaggatcccgtgctgactgtcatcacctacatggggctgagcgtctctctgctgtgcctcctcctggcggccctcacttttctcctgtgtaaagccatccagaacaccagcacctcactgcatctgcagctctcgctctgcctcttcctggcccacctcctcttcctcgtggcaattgatcaaaccggacacaaggtgctgtgctccatcatcgccggtaccttgcactatctctacctggccaccttcacctggatgctgctggaggccctgtacctcttcctcactgcacggaacctgacggtggtcaactactcaagcatcaacagattcatgaagaagctcatgttccctgtgggctacggagtcccagctgtgacagtggccatttctgcagcctccaggcctcacctttatggaacaccttcccgctgctggctccaaccagaaaagggatttatatggggcttccttggacctgtctgcgccatcttctctgtgaatttagttctctttctggtgactctctggattttgaaaaacagactctcctccctcaatagtgaagtgtccaccctccggaacacaaggatgctggcatttaaagcgacagctcagctgttcatcctgggctgcacgtggtgtctgggcatcttgcaggtgggtccggctgcccgggtcatggcctacctcttcaccatcatcaacagcctgcagggtgtcttcatcttcctggtgtactgcctcctcagccagcaggtccgggagcaatatgggaaatggtccaaagggatcaggaaattgaaaactgagtctgagatgcacacactctccagcagtgctaaggctgacacctccaaacccagcacggttaactag

SEQ ID NO: 1167 - DNA, 1959 bp, Homo sapiens
atgcagggaccattgcttcttccaggcctctgctttctgctgagcctctttggagctgtgactcagaaaaccaaaacttcctgtgctaagtgccccccaaatgcttcctgtgtcaataacactcactgcacctgcaaccatggatatacttctggatctgggcagaaactattcacattccccttggagacatgtaacgacattaatgaatgtacaccaccctatagtgtatattgtggatttaacgctgtgtgttacaatgtcgaaggaagtttctactgtcaatgtgtcccaggatatagactgcattctgggaatgaacaattcagtaattccaatgagaacacctgtcaggacaccacctcctcaaagacaaccgagggcaggaaagagctgcaaaagattgtggacaaatttgagtcacttctcaccaatcagactttatggagaacagaagggagacaagaaatctcatccacagctaccactattctccgggatgtggaatcgaaagttctagaaactgccttgaaagatccagaacaaaaagtcctgaaaatccaaaacgatagtgtagctattgaaactcaagcgattacagacaattgctctgaagaaagaaagacattcaacttgaacgtccaaatgaactcaatggacatccgttgcagtgacatcatccagggagacacacaaggtcccagtgccattgcctttatctcatattcttctcttggaaacatcataaatgcaactttttttgaagagatggataagaaagatcaagtgtatctgaactctcaggttgtgagtgctgctattggacccaaaaggaacgtgtctctctccaagtctgtgacgctgactttccagcacgtgaagatgacccccagtaccaaaaaggtcttctgtgtctactggaagagcacagggcagggcagccagtggtccagggatggctgcttcctgatacacgtgaacaagagtcacaccatgtgtaattgcagtcacctgtccagcttcgctgtcctgatggccctgaccagccaggaggaggatcccgtgctgactgtcatcacctacgtggggctgagcgtctctctgctgtgcctcctcctggcggccctcacttttctcctgtgtaaagccatccagaacaccagcacctcactgcatctgcagctctcgctctgcctcttcctggcccacctcctcttcctcgtggggattgatcgaactgaacccaaggtgctgtgctccatcatcgccggtgctttgcactatctctacctggccgccttcacctggatgctgctggagggtgtgcacctcttcctcactgcacggaacctgacagtggtcaactactcaagcatcaatagactcatgaagtggatcatgttcccagtcggctatggcgttcccgctgtgactgtggccatttctgcagcctcctggcctcacctttatggaactgctgatcgatgctggctccacctggaccagggattcatgtggagtttccttggcccagtctgtgccattttctctgcgaatttagtattgtttatcttggtcttttggattttgaaaagaaaactttcctccctcaatagtgaagtgtcaaccatccagaacacaaggatgctggctttcaaagcaacagctcagctcttcatcctgggctgcacatggtgtctgggcttgctacaggtgggtccagctgcccaggtcatggcctacctcttcaccatcatcaacagcctccaaggcttcttcatcttcttggtctactgcctcctcagccagcaggtccagaaacaatatcaaaagtggtttagagagatcgtaaaatcaaaatctgagtctgagacatacacactttccagcaagatgggtcctgactcaaaacccagtgagggggatgtttttccaggacaagtgaagagaaaatattaa

SEQ ID NO: 1168 - DNA, 1056 bp, Homo sapiens
atggaaaccaacttctccactcctctgaatgaatatgaagaagtgtcctatgagtctgctggctacactgttctgcggatcctcccattggtggtgcttggggtcacctttgtcctcggggtcctgggcaatgggcttgtgatctgggtggctggattccggatgacacgcacagtcaccaccatctgttacctgaacctggccctggctgacttttctttcacggccacattaccattcctcattgtctccatggccatgggagaaaaatggccttttggctggttcctgtgtaagttaattcacatcgtggtggacatcaacctctttggaagtgtcttcttgattggtttcattgcactggaccgctgcatttgtgtcctgcatccagtctgggcccagaaccaccgcactgtgagtctggccatgaaggtgatcgtcggaccttggattcttgctctagtccttaccttgccagttttcctctttttgactacagtaactattccaaatggggacacatactgtactttcaactttgcatcctggggtggcacccctgaggagaggctgaaggtggccattaccatgctgacagccagagggattatccggtttgtcattggctttagcttgccgatgtccattgttgccatctgctatgggctcattgcagccaagatccacaaaaagggcatgattaaatccagccgtcccttacgggtcctcactgctgtggtggcttctttcttcatctgttggtttccctttcaactggttgcccttctgggcaccgtctggctcaaagagatgttgttctatggcaagtacaaaatcattgacatcctggttaacccaacgagctccctggccttcttcaacagctgcctcaaccccatgctttacgtctttgtgggccaagacttccgagagagactgatccactccctgcccaccagtctggagagggccctgtctgaggactcagccccaactaatgacacggctgccaattctgcttcacctcctgcagagactgagttacaggcaatgtga

SEQ ID NO: 1169 - DNA, 1062 bp, Homo sapiens
atggaaaccaacttctccattcctctgaatgaaactgaggaggtgctccctgagcctgctggccacaccgttctgtggatcttctcattgctagtccacggagtcacctttgtcttcggggtcctgggcaatgggcttgtgatctgggtggctggattccggatgacacgcacagtcaacaccatctgttacctgaacctggccctagctgacttctctttcagtgccatcctaccattccgaatggtctcagtcgccatgagagaaaaatggccttttgcgtcattcctatgtaagttagttcatgttatgatagacatcaacctgtttgtcagtgtctacctgatcaccatcattgctctggaccgctgtatttgtgtcctgcatccagcctgggcccagaaccatcgcaccatgagtctggccaagagggtgatgacgggactctggattttcaccatagtccttaccttaccaaatttcatcttctggactacaataagtactacgaatggggacacatactgtattttcaactttgcattctggggtgacactgctgtagagaggttgaacgtgttcattaccatggccaaggtctttctgatcctccacttcattattggcttcacggtgcctatgtccatcatcacagtctgctatgggatcatcgctgccaaaattcacagaaaccacatgattaaatccagccgtcccttacgtgtcttcgctgctgtggtggcttctttcttcatctgttggttcccttatgaactaattggcattctaatggcagtctggctcaaagagatgttgttaaatggcaaatacaaaatcattcttgtcctgattaacccaacaagctccttggccttttttaacagctgcctcaacccaattctctacgtctttatgggtcgtaacttccaagaaagactgattcgctctttgcccactagtttggagagggccctgactgaggtccctgactcagcccagaccagcaacacacacaccacttctgcttcacctcctgaggagacggagttacaagcaatgtga

SEQ ID NO: 1170 - DNA, 1947 bp, Homo sapiens
atggctgaggaggaggcgcctaagaagtcccgggccgccggcggtggcgcgagctgggaactttgtgccggggcgctctcggcccggctggcggaggagggcagcggggacgccggtggccgccgccgcccgccagttgacccccggcgattggcgcgccagctgctgctgctgctttggctgctggaggctccgctgctgctgggggtccgggcccaggcggcgggccaggggccaggccaggggcccgggccggggcagcaaccgccgccgccgccgcctcagcagcaacagagcgggcagcagtacaacggcgagcggggcatctccgtcccggaccacggctattgccagcccatctccatcccgctgtgcacggacatcgcgtacaaccagaccatcatgcccaacctgctgggccacacgaaccaggaggacgcgggcctggaggtgcaccagttctaccctctagtgaaagtgcagtgttccgctgagctcaagttcttcctgtgctccatgtacgcgcccgtgtgcaccgtgctagagcaggcgctgccgccctgccgctccctgtgcgagcgcgcgcgccagggctgcgaggcgctcatgaacaagttcggcttccagtggccagacacgctcaagtgtgagaagttcccggtgcacggcgccggcgagctgtgcgtgggccagaacacgtccgacaagggcaccccgacgccctcgctgcttccagagttctggaccagcaaccctcagcacggcggcggagggcaccgtggcggcttcccggggggcgccggcgcgtcggagcgaggcaagttctcctgcccgcgcgccctcaaggtgccctcctacctcaactaccacttcctgggggagaaggactgcggcgcaccttgtgagccgaccaaggtgtatgggctcatgtacttcgggcccgaggagctgcgcttctcgcgcacctggattggcatttggtcagtgctgtgctgcgcctccacgctcttcacggtgcttacgtacctggtggacatgcggcgcttcagctacccggagcggcccatcatcttcttgtccggctgttacacggccgtggccgtggcctacatcgccggcttcctcctggaagaccgagtggtgtgtaatgacaagttcgccgaggacggggcacgcactgtggcgcagggcaccaagaaggagggctgcaccatcctcttcatgatgctctacttcttcagcatggccagctccatctggtgggtgatcctgtcgctcacctggttcctggcggctggcatgaagtggggccacgaagccatcgaagccaactcacagtattttcacctggccgcctgggctgtgccggccatcaagaccatcaccatcctggcgctgggccaggtggacggcgatgtgctgagcggagtgtgcttcgtggggcttaacaacgtggacgcgctgcgtggcttcgtgctggcgcccctcttcgtgtacctgtttatcggcacgtcctttctgctggccggctttgtgtcgctcttccgcatccgcaccatcatgaagcacgatggcaccaagaccgagaagctggagaagctcatggtgcgcattggcgtcttcagcgtgctgtacactgtgccagccaccatcgtcatcgcctgctacttctacgagcaggccttccgggaccagtgggaacgcagctgggtggcccagagctgcaagagctacgctatcccctgccctcacctccaggcgggcggaggcgccccgccgcacccgcccatgagcccggacttcacggtcttcatgattaagtaccttatgacgctgatcgtgggcatcacgtcgggcttctggatctggtccggcaagaccctcaactcctggaggaagttctacacgaggctcaccaacagcaaacaaggggagactacagtctga

SEQ ID NO: 1171 - DNA, 1035 bp, Homo sapiens
ccgcttcatacccacacttcatcctcctcagtttctctccaggccaccatgtctgcaggcaacggcaccccttgggatgccacctggaatatcactgttcaatggctggctgtggacatcgcatgtcggacactgatgttcctgaaactaatggccacgtattctgcagctttcctgcctgtggtcattggattggaccgccaggcagcagtactcaacccgcttggatcccgttcaggtgtaaggaaacttctgggggcagcctggggacttagtttcctgcttgccttcccccagctgttcctgttccacacggtccactgagctggcccagaccctttcactcagtgtgtcaccaaaggcagcttcaaggctcaatggcaagagaccacctataacctcttcaccttctgctgcctctttctgctgccactgactgccatggccatctgctatagccgcattgtcctcagtgtgtccaggccccagacaaggaaggggagccatgcccctgctggtgaatttgccctcccccgctcctttgacaattgtccccgtgttcgtctccgggccctgagactggccctgcttatcttgctgaccttcatcctctgctggacaccttattacctactgggtatgtggtactggttctcccccaccatgctaactgaagtccctcccagcctgagccacatccttttcctcttgggcctcctcaatgctcctttggatcctctcctctatggggccttcacccttggctgccgaagagggcaccaagaacttagtatagactcttctaaagaagggtctgggagaatgctccaagaggagattcatgcctttagacagctggaagtacaaaaaactgtgacatcaagaagggcaggagaaacaaaaggcatttctataacatctatctgatcctaacagagtatgtaggaacagaatagtaagtctttagtgccataagatcttaacatctcacttctactcctgctctcctagttccccccaaaaaagaaatactga

SEQ ID NO: 1172 - DNA, 960 bp, Homo sapiens
atgccattcccaaactgctcagcccccagcactgtggtggccacagctgtgggtgtcttgctggggctggagtgtgggctgggtctgctgggcaacgcggtggcgctgtggaccttcctgttccgggtcagggtgtggaagccgtacgctgtctacctgctcaacctggccctggctgacctgctgttggctgcgtgcctgcctttcctggccgccttctacctgagcctccaggcttggcatctgggccgtgtgggctgctgggccctgcgcttcctgctggacctcagccgcagcgtggggatggccttcctggccgccgtggctttggaccggtacctccgtgtggtccaccctcggcttaaggtcaacctgctgtctcctcaggcggccctgggggtctcgggcctcgtctggctcctgatggtcgccctcacctgcccgggcttgctcatctctgaggccgcccagaactccaccaggtgccacagtttctactccagggcagacggctccttcagcatcatctggcaggaagcactctcctgccttcagtttgtcctcccctttggcctcatcgtgttctgcaatgcaggcatcatcagggctctccagaaaagactccgggagcctgagaaacagcccaagcttcagcgggcccaggcactggtcaccttggtggtggtgctgtttgctctgtgctttctgccctgcttcctggccagagtcctgatgcacatcttccagaatctggggagctgcagggccctttgtgcagtggctcatacctcggatgtcacgggcagcctcacctacctgcacagtgtcgtcaaccccgtggtatactgcttctccagccccaccttcaggagctcctatcggagggtcttccacaccctccgaggcaaagggcaggcagcagagcccccagatttcaaccccagagactcctattcctga

SEQ ID NO: 1173 - DNA, 1071 bp, Homo sapiens
atgaatggggtctcggaggggaccagaggctgcagtgacaggcaacctggggtcctgacacgtgatcgctcttgttccaggaagatgaactcttccggatgcctgtctgaggaggtggggtccctccgcccactgactgtggttatcctgtctgcgtccattgtcgtcggagtgctgggcaatgggctggtgctgtggatgactgtcttccgtatggcacgcacggtctccaccgtctgcttcttccacctggcccttgccgatttcatgctctcactgtctctgcccattgccatgtactatattgtctccaggcagtggctcctcggagagtgggcctgcaaactctacatcacctttgtgttcctcagctactttgccagtaactgcctccttgtcttcatctctgtggaccgttgcatctctgtcctctaccccgtctgggccctgaaccaccgcactgtgcagcgggcgagctggctggcctttggggtgtggctcctggccgccgccttgtgctctgcgcacctgaaattccggacaaccagaaaatggaatggctgtacgcactgctacttggcgttcaactctgacaatgagactgcccagatttggattgaaggggtcgtggagggacacattatagggaccattggccacttcctgctgggcttcctggggcccttagcaatcataggcacctgcgcccacctcatccgggccaagctcttgcgggagggctgggtccatgccaaccggcccaagaggctgctgctggtgctggtgagcgctttctttatcttctggtccccgtttaacgtggtgctgttggtccatctgtggcgacgggtgatgctcaaggaaatctaccacccccggatgctgctcatcctccaggctagctttgccttgggctgtgtcaacagcagcctcaaccccttcctctacgtcttcgttggcagagatttccaagaaaagtttttccagtctttgacttctgccctggcgagggcgtttggagaggaggagtttctgtcatcctgtccccgtggcaacgccccccgggaatga

SEQ ID NO: 1174 - DNA, 1239 bp, Homo sapiens
atgggcagcccctggaacggcagcgacggccccgagggggcgcgggagccgccgtggcccgcgctgccgccttgcgacgagcgccgctgctcgccctttcccctgggggcgctggtgccggtgaccgctgtgtgcctgtgcctgttcgtcgtcggggtgagcggcaacgtggtgaccgtgatgctgatcgggcgctaccgggacatgcggaccaccaccaacttgtacctgggcagcatggccgtgtccgacctactcatcctgctcgggctgccgttcgacctgtaccgcctctggcgctcgcggccctgggtgttcgggccgctgctctgccgcctgtccctctacgtgggcgagggctgcacctacgccacgctgctgcacatgaccgcgctcagcgtcgagcgctacctggccatctgccgcccgctccgcgcccgcgtcttggtcacccggcgccgcgtccgcgcgctcatcgctgtgctctgggccgtggcgctgctctctgccggtcccttcttgttcctggtgggcgtcgagcaggaccccggcatctccgtagtcccgggcctcaatggcaccgcgcggatcgcctcctcgcctctcgcctcgtcgccgcctctctggctctcgcgggcgccaccgccgtccccgccgtcggggcccgagaccgcggaggccgcggcgctgttcagccgcgaatgccggccgagccccgcgcagctgggcgcgctgcgtgtcatgctgtgggtcaccaccgcctacttcttcctgccctttctgtgcctcagcatcctctacgggctcatcgggcgggagctgtggagcagccggcggccgctgcgaggcccggccgcctcggggcgggagagaggccaccggcagaccgtccgcgtcctgctggtggtggttctggcatttataatttgctggttgcccttccacgttggcagaatcatttacataaacacggaagattcgcggatgatgtacttctctcagtactttaacatcgtcgctctgcaacttttctatctgagcgcatctatcaacccaatcctctacaacctcatttcaaagaagtacagagcggcggcctttaaactgctgctcgcaaggaagtccaggccgagaggcttccacagaagcagggacactgcgggggaagttgcaggggacactggaggagacacggtgggctacaccgagacaagcgctaacgtgaagacgatgggataa

SEQ ID NO: 1175 - DNA, 1086 bp, Homo sapiens
atgaatgaatccaggtggactgaatggaggatcctgaacatgagcagtggcattgtgaatgcgtccgagcgtcactcctgcccacttggatttggccactacagtgtggtggatgtctgcatcttcgagacagtggttattgtgttgctgacatttctgattattgctgggaatctaacagttatctttgcctttcattgtgctccactgttacatcattatactaccagctatttcattcagacgatggcatatgctgatcttttcgttggagttagctgcttggttcctactctgtcacttctccactactccacaggtgtccacgagtcattaacttgccgggtttttggatatatcatctcagttctaaaaagtgtttctatggcatgtcttgcttgcatcagtgtggatcgttatcttgcaataaccaagcctctttcctacaatcaactggtcaccccttgtcgcttgagaatttgcattattttgatctggatctactcctgcctaattttcttgccttccttttttggctgggggaaacctggttaccatggtgacatttttgaatggtgtgccacgtcttggctcaccagtgcctattttactggctttattgtttgcttactttatgctcctgctgcctttgttgtctgcttcacctacttccacattttcaaaatttgccgtcagcacaccaaagagataaatgaccgaagagcccgattccctagtcatgaggtagattcttccagagagactggacacagccctgaccgtcgctacgccatggttttgtttaggataaccagtgtattttatatgctgtggctcccctatataatttactttcttctagaaagctcccgggtcttggacaatccaactctgtccttcttaacaacctggcttgcagtaagtaatagtttttgtaactgtgtaatatacagcctctccaacggcgttttccggctaggcctccgaagactgtttgagacaatgtgcacatcctgtatgtgtgtgaaggatcaggaagcacaagaacccaaacctaggaaacgggctaattcttgctccatttga

SEQ ID NO: 1176 - DNA, 1092 bp, Homo sapiens
atgggccccggcgaggcgctgctggcgggtcttctggtgatggtactggccgtggcgctgctatccaacgcactggtgctgctttgttgcgcctacagcgctgagctccgcactcgagcctcaggcgtcctcctggtgaatctgtctctgggccacctgctgctggcggcgctggacatgcccttcacgctgctcggtgtgatgcgcgggcggacaccgtcggcgcccggcgcatgccaagtcattggcttcctggacaccttcctggcgtccaacgcggcgctgagcgtggcggcgctgagcgcagaccagtggctggcagtgggcttcccactgcgctacgccggacgcctgcgaccgcgctatgccggcctgctgctgggctgtgcctggggacagtcgctggccttctcaggcgctgcacttggctgctcgtggcttggctacagcagcgccttcgcgtcctgttcgctgcgcctgccgcccgagcctgagcgtccgcgcttcgcagccttcaccgccacgctccatgccgtgggcttcgtgctgccgctggcggtgctctgcctcacctcgctccaggtgcaccgggtggcacgcagacactgccagcgcatggacaccgtcaccatgaaggcgctcgccgtgctcgccgacctgcaccccagtgtgcggcacggctgcctcatccagcagaagcggcgccgccaccgcgccaccaggaagattggcattgctattgcgaccttcctcatctgctttgccccgtatgtcatgaccaggctggcggagctcgtgcccttcgtcaccgtgaacgcccagtggggcatcctcagcaagtgcctgacctacagcaaggcggtggccgacccgttcacgtactctctgctccgccggccgttccgccaagtcctggccggcatggtgcaccggctgctgaagagaaccccgcgcccagcatccacccatgacagctctctggatgtggccggcatggtgcaccagctgctgaagagaaccccgcgcccagcgtccacccacaacggctctgtggacacagagaatgattcctgcctgcagcagacacactga

SEQ ID NO: 1177 - DNA, 1002 bp, Homo sapiens
atgcaggccgctgggcacccagagccccttgacagcaggggctccttctccctccccacgatgggtgccaacgtctctcaggacaatggcactggccacaatgccaccttctccgagccactgccgttcctctatgtgctcctgcccgccgtgtactccgggatctgtgctgtggggctgactggcaacacggccgtcatccttgtaatcctaagggcgcccaagatgaagacggtgaccaacgtgttcatcctgaacctggccgtcgccgacgggctcttcacgctggtactgcccgtcaacatcgcggagcacctgctgcagtactggcccttcggggagctgctctgcaagctggtgctggccgtcgaccactacaacatcttctccagcatctacttcctagccgtgatgagcgtggaccgatacctggtggtgctggccaccgtgaggtcccgccacatgccctggcgcacctaccggggggcgaaggtcgccagcctgtgtgtctggctgggcgtcacggtcctggttctgcccttcttctctttcgctggcgtctacagcaacgagctgcaggtcccaagctgtgggctgagcttcccgtggcccgagcgggtctggttcaaggccagccgtgtctacactttggtcctgggcttcgtgctgcccgtgtgcaccatctgtgtgctctacacagacctcctgcgcaggctgcgggccgtgcggctccgctctggagccaaggctctaggcaaggccaggcggaaggtgaccgtcctggtcctcgtcgtgctggccgtgtgcctcctctgctggacgcccttccacctggcctctgtcgtggccctgaccacggacctgccccagaccccactggtcatcagtatgtcctacgtcatcaccagcctcacgtacgccaactcgtgcctgaaccccttcctctacgcctttctagatgacaacttccggaagaacttccgcagcatattgcggtgctga

SEQ ID NO: 1178 - DNA, 1098 bp, Homo sapiens
atgaacatcacaaactgtaccacagaggccagcatggctataagacccaagaccatcactgagaagatgctcatttgcatgactctggtggtcatcaccaccctcaccacgttgctgaacttggctgtgatcatggctattggcaccaccaagaagctccaccagcctgccaactacctaatctgttctctggccgtgacggacctcctggtggcagtgctcgtcatgcccctgagcatcatctacattgtcatggatcgctggaagcttgggtacttcctctgtgaggtgtggctgagtgtggacatgacctgctgcacctgctccatcctccacctctgtgtcattgccctggacaggtactgggccatcaccaatgctattgaatacgccaggaagaggacggccaagagggccgcgctgatgatccttaccgtctggaccatctccattttcatctccatgccccctctgttctggagaagccaccgccgcctaagccctccccctagtcagtgcaccatccagcacgaccatgttatctacaccatttactccacgctgggtgcgttttatatccccttgactttgatactgattctctattaccggatttaccacgcggccaagagcctttaccagaaaaggggatcaagtcggcacttaagcaacagaagcacagatagccagaattcttttgcaagttgtaaacttacacagactttctgtgtgtctgacttctccacctcagaccctaccacagagtttgaaaagttccatgcctccatcaggatcccccccttcgacaatgatctagatcacccaggagaacgtcagcagatctctagcaccagggaacggaaggcagcacgcatcctggggctgattctgggtgcattcattttatcctggctgccatttttcatcaaagagttgattgtgggtctgagcatctacaccgtgtcctcggaagtggccgactttctgacgtggctcggttatgtgaattctctgatcaaccctctgctctatacgagttttaatgaagactttaagctggcttttaaaaagctcattagatgccgagagcatacttag

SEQ ID NO: 1179 - DNA, 1137 bp, Homo sapiens
atggtctgggggaaaatttgctggttcagccagagggctggatggacagtgtttgctgagtcacagatatctctctcatgtagcctttgtctccacagtggtgaccaggaggcacagaacccaaacctggtatctcagctctgtggcgtctttcttcaaaatgagacgaatgaaaccatacatatgcagatgagcatggcagtgggacagcaggccctgcccttgaatatcattgcccccaaggctgtgctggtctccctctgtggggtcttattgaatggcactgtcttctggctgctttgctgtggggccacgaatccctacatggtatacatcctccacctggtcgctgctgacgtgatctatctttgctgctcggcagtggggttcttacaggtgactctgctaacttatcatggagtcgtgttttttatccctgatttcctggccatattgtctcccttctcctttgaggtgtgtctctgtctcctggtggccatcagcacagagcggtgtgtgtgtgtcctcttccccatctggtacagatgccaccgcccaaaatacacatctaatgttgtctgcaccctcatctggggcctgcctttttgcatcaacatagtaaaatcacttttcctaacttactggaaacatgtaaaggcatgtgtcatatttctaaagctttctgggctcttccatgctatcctttcacttgtgatgtgtgtgtcgagtctgactctactcattagattcctgtgctgctcccagcagcaaaaggccaccagggtctatgcggtggtgcagatctcggcccccatgttcctactctgggccctacccctgagcgtggcacccctcataacagatttcaaaatgtttgtcaccacctcctatttaatttccttgttcctcattataaacagcagcgccaaccctatcatttatttctttgtggggagcctcagaaagaaaaggctgaaggaatctctcagagtgattctccaacgggcgttagcagataagccagaggtggggaggaacaaaaaggcagctggcatcgacccaatggagcaaccacactctactcagcatgtggagaaccttcttcccagggagcacagggtcgatgtggaaacataa

SEQ ID NO: 1180 - DNA, 969 bp, Homo sapiens
atggatccaaccatctcaaccttggacacagaactgacaccaatcaacggaactgaggagactctttgctacaagcagaccttgagcctcacggtgctgacgtgcatcgtttcccttgtcgggctgacaggaaacgcagttgtgctctggctcctgggctgccgcatgcgcaggaacgccttctccatctacatcctcaacttggccgcagcagacttcctcttcctcagcggccgccttatatattccctgttaagcttcatcagtatcccccataccatctctaaaatcctctatcctgtgatgatgttttcctactttgcaggcctgagctttctgagtgccgtgagcaccgagcgctgcctgtccgtcctgtggcccatctggtaccgctgccaccgccccacacacctgtcagcggtggtgtgtgtcctgctctgggccctgtccctgctgcggagcatcctggagtggatgttatgtggcttcctgttcagtggtgctgattctgcttggtgtcaaacatcagatttcatcacagtcgcgtggctgatttttttatgtgtggttctctgtgggtccagcctggtcctgctgatcaggattctctgtggatcccggaagataccgctgaccaggctgtacgtgaccatcctgctcacagtactggtcttcctcctctgtggcctgccctttggcattcagtttttcctatttttatggatccacgtggacagggaagtcttattttgtcatgttcatctagtttctattttcctgtccgctcttaacagcagtgccaaccccatcatttacttcttcgtgggctcctttaggcagcgtcaaaataggcagaacctgaagctggttctccagagggctctgcaggacgcgtctgaggtggatgaaggtggagggcagcttcctgaggaaatcctggagctgtcgggaagcagattggagcagtga

SEQ ID NO: 1181 - DNA, 993 bp, Homo sapiens
atggatccaaccaccccggcctggggaacagaaagtacaacagtgaatggaaatgaccaagcccttcttctgctttgtggcaaggagaccctgatcccggtcttcctgatccttttcattgccctggtcgggctggtaggaaacgggtttgtgctctggctcctgggcttccgcatgcgcaggaacgccttctctgtctacgtcctcagcctggccggggccgacttcctcttcctctgcttccagattataaattgcctggtgtacctcagtaacttcttctgttccatctccatcaatttccctagcttcttcaccactgtgatgacctgtgcctaccttgcaggcctgagcatgctgagcaccgtcagcaccgagcgctgcctgtccgtcctgtggcccatctggtatcgctgccgccgccccagacacctgtcagcggtcgtgtgtgtcctgctctgggccctgtccctactgctgagcatcttggaagggaagttctgtggcttcttatttagtgatggtgactctggttggtgtcagacatttgatttcatcactgcagcgtggctgatttttttattcatggttctctgtgggtccagtctggccctgctggtcaggatcctctgtggctccaggggtctgccactgaccaggctgtacctgaccatcctgctcacagtgctggtgttcctcctctgcggcctgccctttggcattcagtggttcctaatattatggatctggaaggattctgatgtcttattttgtcatattcatccagtttcagttgtcctgtcatctcttaacagcagtgccaaccccatcatttacttcttcgtgggctcttttaggaagcagtggcggctgcagcagccgatcctcaagctggctctccagagggctctgcaggacattgctgaggtggatcacagtgaaggatgcttccgtcagggcaccccggagatgtcgagaagcagtctggtgtag

SEQ ID NO: 1182 - DNA, 969 bp, Homo sapiens
atggattcaaccatcccagtcttgggtacagaactgacaccaatcaacggacgtgaggagactccttgctacaagcagaccctgagcttcacggggctgacgtgcatcgtttcccttgtcgcgctgacaggaaacgcggttgtgctctggctcctgggctgccgcatgcgcaggaacgctgtctccatctacatcctcaacctggtcgcggccgacttcctcttccttagcggccacattatatgttcgccgttacgcctcatcaatatccgccatcccatctccaaaatcctcagtcctgtgatgacctttccctactttataggcctaagcatgctgagcgccatcagcaccgagcgctgcctgtccatcctgtggcccatctggtaccactgccgccgccccagatacctgtcatcggtcatgtgtgtcctgctctgggccctgtccctgctgcggagtatcctggagtggatgttctgtgacttcctgtttagtggtgctgattctgtttggtgtgaaacgtcagatttcattacaatcgcgtggctggtttttttatgtgtggttctctgtgggtccagcctggtcctgctggtcaggattctctgtggatcccggaagatgccgctgaccaggctgtacgtgaccatcctcctcacagtgctggtcttcctcctctgtggcctgccctttggcattcagtgggccctgttttccaggatccacctggattggaaagtcttattttgtcatgtgcatctagtttccattttcctgtccgctcttaacagcagtgccaaccccatcatttacttcttcgtgggctcctttaggcagcgtcaaaataggcagaacctgaagctggttctccagagggctctgcaggacacgcctgaggtggatgaaggtggagggtggcttcctcaggaaaccctggagctgtcgggaagcagattggagcagtga

SEQ ID NO: 1183 - DNA, 969 bp, Homo sapiens
atggatccaaccgtcccagtcttcggtacaaaactgacaccaatcaacggacgtgaggagactccttgctacaatcagaccctgagcttcacggtgctgacgtgcatcatttcccttgtcggactgacaggaaacgcggtagtgctctggctcctgggctaccgcatgcgcaggaacgctgtctccatctacatcctcaacctggccgcagcagacttcctcttcctcagcttccagattatacgttcgccattacgcctcatcaatatcagccatctcatccgcaaaatcctcgtttctgtgatgacctttccctactttacaggcctgagtatgctgagcgccatcagcaccgagcgctgcctgtctgttctgtggcccatctggtaccgctgccgccgccccacacacctgtcagcggtcgtgtgtgtcctgctctggggcctgtccctgctgtttagtatgctggagtggaggttctgtgacttcctgtttagtggtgctgattctagttggtgtgaaacgtcagatttcatcccagtcgcgtggctgatttttttatgtgtggttctctgtgtttccagcctggtcctgctggtcaggatcctctgtggatcccggaagatgccgctgaccaggctgtacgtgaccatcctgctcacagtgctggtcttcctcctctgcggcctgcccttcggcattctgggggccctaatttacaggatgcacctgaatttggaagtcttatattgtcatgtttatctggtttgcatgtccctgtcctctctaaacagtagtgccaaccccatcatttacttcttcgtgggctcctttaggcagcgtcaaaataggcagaacctgaagctggttctccagagggctctgcaggacaagcctgaggtggataaaggtgaagggcagcttcctgaggaaagcctggagctgtcgggaagcagattggggccatga

SEQ ID NO: 1184 - DNA, 1095 bp, Homo sapiens
atggcccagcagtggagcctccaaaggctcgcaggccgccatccgcaggacagctatgaggacagcacccagtccagcatcttcacctacaccaacagcaactccaccagaggccccttcgaaggcccgaattaccacatcgctcccagatgggtgtaccacctcaccagtgtctggatgatctttgtggtcactgcatccgtcttcacaaatgggcttgtgctggcggccaccatgaagttcaagaagctgcgccacccgctgaactggatcctggtgaacctggcggtcgctgacctagcagagaccgtcatcgccagcactatcagcattgtgaaccaggtctctggctacttcgtgctgggccaccctatgtgtgtcctggagggctacaccgtctccctgtgtgggatcacaggtctctggtctctggccatcatttcctgggagaggtggctggtggtgtgcaagccctttggcaatgtgagatttgatgccaagctggccatcgtgggcattgccttctcctggatctggtctgctgtgtggacagccccgcccatctttggttggagcaggtactggccccacggcctgaagacttcatgcggcccagacgtgttcagcggcagctcgtaccccggggtgcagtcttacatgattgtcctcatggtcacctgctgcatcatcccactcgctatcatcatgctctgctacctccaagtgtggctggccatccgagcggtggcaaagcagcagaaagagtctgaatccacccagaaggcagagaaggaagtgacgcgcatggtggtggtgatgatctttgcgtactgcgtctgctggggaccctacaccttcttcgcatgctttgctgctgccaaccctggttacgccttccaccctttgatggctgccctgccggcctactttgccaaaagtgccactatctacaaccccgttatctatgtctttatgaaccggcagtttcgaaactgcatcttgcagcttttcgggaagaaggttgacgatggctctgaactctccagcgcctccaaaacggaggtctcatctgtgtcctcggtatcgcctgcatga

SEQ ID NO: 1185 - DNA, 1116 bp, Homo sapiens
atggatcgaggtgccaagtcctgccctgccaacttcttggcagctgccgacgacaaactcagtgggttccagggggacttcctgtggcccatactggtggttgagttcctggtggccgtggccagcaatggcctggccctgtaccgcttcagcatccggaagcagcgcccatggcaccccgccgtggtcttctctgtccagctggcagtcagcgacctgctctgcgctctgacgctgcccccgctggccgcctacctctatccccccaagcactggcgctatggggaggccgcgtgccgcctggagcgcttcctcttcacctgcaacctgctgggcagcgtcatcttcatcacctgcatcagcctcaaccgctacctgggcatcgtgcaccccttcttcgcccgaagccacctgcgacccaagcacgcctgggccgtgagcgctgccggctgggtcctggccgccctgctggccatgcccacactcagcttctcccacctgaagaggccgcagcagggggcgggcaactgcagcgtggccaggcccgaggcctgcatcaagtgtctggggacagcagaccacgggctggcggcctacagagcgtatagcctggtgctggcggggttgggctgcggcctgccgctgctgctcacgctggcagcctacggcgccctcgggcgggccgtgctacgcagcccaggcatgactgtggccgagaagctgcgtgtggcagcgttggtggccagtggtgtggccctctacgccagctcctatgtgccctaccacatcatgcgggtgctcaacgtggatgctcggcggcgctggagcacccgctgcccgagctttgcagacatagcccaggccacagcagccctggagctggggccctacgtgggctaccaggtgatgcggggcctcatgcccctggccttctgtgtccaccctctactctacatggccgcagtgcccagcctgggctgctgctgccgacactgccccggctacagggacagctggaacccagaggacgccaagagcactggccaagccctgcccctcaatgccacagccgcccctaaaccgtcagagccccagtcccgtgagctgagccaatga

SEQ ID NO: 1186 - DNA, 1023 bp, Homo sapiens
atgaatccatttcatgcatcttgttggaacacctctgccgaacttttaaacaaatcctggaataaagagtttgcttatcaaactgccagtgtggtggatacagtcatcctcccttccatgattgggattatctgttcaacagggctggttggcaacatcctcattgtattcactataataagatccaggaaaaaaacagtccctgacatctatatctgcaacctggctgtggctgatttggtccacatagttggaatgccttttcttattcaccaatgggcccgagggggagagtgggtgtttggggggcctctctgcaccatcatcacatccctggatacttgtaaccaatttgcctgtagtgccatcatgactgtaatgagtgtggacaggtactttgccctcgtccaaccatttcgactgacacgttggagaacaaggtacaagaccatccggatcaatttgggcctttgggcagcttcctttatcctggcattgcctgtctgggtctactcgaaggtcatcaaatttaaagacggtgttgagagttgtgcttttgatttgacatcccctgacgatgtactctggtatacactttatttgacgataacaactttttttttccctctacccttgattttggtgtgctatattttaattttatgctatacttgggagatgtatcaacagaataaggatgccagatgctgcaatcccagtgtaccaaaacagaragtgatgaagttgacaaagatggtgctggtgctggtggtagtctttatcctgagtgctgccccttatcatgtgatacaactggtgaacttacagatggaacagcccacactggccttctatgtgggttattacctctccatctgtctcagctatgccagcagcagcattaacccttttctctacatcctgctgagtggaaatttccagaaacgtctgcctcaaatccaaagaagagcgactgagaaggaaatcaacaatatgggaaacactctgaaatcacacttttag

SEQ ID NO: 1187 - DNA, 1269 bp, Homo sapiens
atgttgtgtcaccgtggtggccagctgatagtgccaatcatcccactttgccctgagcactcctgcaggggtagaagactccagaaccttctctcaggcccatggcccaagcagcccatggaacttcataacctgagctctccatctccctctctctcctcctctgttctccctccctccttctctccctcaccctcctctgctccctctgcctttaccactgtgggggggtcctctggagggccctgccaccccacctcttcctcgctggtgtctgccttcctggcaccaatcctggccctggagtttgtcctgggcctggtggggaacagtttggccctcttcatcttctgcatccacacgcggccctggacctccaacacggtgttcctggtcagcctggtggccgctgacttcctcctgatcagcaacctgcccctccgcgtggactactacctcctccatgagacctggcgctttggggctgctgcctgcaaagtcaacctcttcatgctgtccaccaaccgcacggccagcgttgtcttcctcacagccatcgcactcaaccgctacctgaaggtggtgcagccccaccacgtgctgagccgtgcttccgtgggggcagctgcccgggtggccgggggactctgggtgggcatcctgctcctcaacgggcacctgctcctgagcaccttctccggcccctcctgcctcagctacagggtgggcacgaagccctcggcctcgctccgctggcaccaggcactgtacctgctggagttcttcctgccactggcgctcatcctctttgctattgtgagcattgggctcaccatccggaaccgtggtctgggcgggcaggcaggcccgcagagggccatgcgtgtgctggccatggtggtggccgtctacaccatctgcttcttgcccagcatcatctttggcatggcttccatggtggctttctggctgtccgcctgccgatccctggacctctgcacacagctcttccatggctccctggccttcacctacctcaacagtgtcctggaccccgtgctctactgcttctctagccccaacttcctccaccagagccgggccttgctgggcctcacgcggggccggcagggcccagtgagcgacgagagctcctaccaaccctccaggcagtggcgctaccgggaggcctctaggaaggcggaggccatagggaagctgaaagtgcagggcgaggtctctctggaaaaggaaggctcctcccagggc

SEQ ID NO: 1188 - DNA, 1491 bp, Mus musculus
atggccagaaccctgcagctctccctgactgctctcctcctgctgcctatggctattgctatgcactctgactgcatcttcaagaaggagcaagccatgtgcctggagaggatccagagggccaacgacctgatgggcctaaatgagtcttccccaggttgccctggcatgtgggacaatatcacatgttggaagcctgctcaaataggtgagatggtccttgtgagctgccctgaggtcttccggatcttcaacccggaccaagtctggatgacagaaaccataggggattctggctttgctgatagtaattccttggagatcacagacatgggggtcgtgggccggaactgcactgaggatggctggtcggagcccttcccccattacttcgatgcttgtgggtttgatgactatgagcccgagtctggggatcaggattattactacctgtcggtgaaggccctctacacagtcggctacagcacctccctcgtcaccctcaccactgccatggtcatcttgtgccgcttccggaagctgcactgtacccgtaacttcatccacatgaacctgtttgtatccttcatgctgagagctatctctgtcttcatcaaagactggatcttgtatgccgagcaggacagcagtcattgcttcgtttccaccgtggaatgcaaagctgtcatggttttctttcactactgcgtggtgtccaactacttctggctgttcattgaaggcctatacctctttacactgctggtggagaccttcttccctgagaggagatatttctactggtataccatcattggctgggggacacctactgtgtgtgtaactgtgtgggctgtgctgaggctctactttgatgatgcgggatgctgggatatgaatgacagcacagctctgtggtgggtgatcaaaggccctgtagttggctctataatggttaactttgtgcttttcatcggcatcatcatcatccttgtgcagaagctgcagtccccagacatgggaggcaatgagtcgagcatctacttcagctgcgtgcagaaatgctactgcaagccacagcgggctcagcagcactcttgcaagatgtcagaactatccaccattactctacggctggcccgctccaccctgctgctcatcccactctttggaatccactacacagtatttgccttctctccagagaacgtcagcaagagggaaagacttgtgtttgagcttgggctgggctccttccagggctttgtggtggctgtactctactgcttcctgaatggggaggtacaggcagagattaagaggaaatggaggagctggaaggtgaaccgttacttcactatggacttcaagcaccggcatccatccctggccagcagtggagtgaacgggggcacccagctgtccatcctgagcaagagcagctcccagctccgcatgtccagcctcccggccgacaacttggccacctga

SEQ ID NO: 1189 - DNA, 1568 bp, Mus musculus
agcgcctgctccgcaaagctgcctctgcagcctcctggcactaacagccccatccacaggctccccgggacaggtgctcccaagagaaatccagacccaagttggccctcatgtcagtcatacccagccccaggcccgtctccaccttggaaccggacaatgattttagagacatccacaactggacagagctgctccacctcttcaaccagacctttaccgattgccacatagaattcaacgagaacaccaaacacgtggtcctcttcgtcttctacctggccatcttcgtggtaggcttagtagagaacgtcctggtgatatgtgtcaactgccgccgttcaggccgggtggggatgctgaacctgtacatcctcaacatggccatcgcagacctgggcatcatcctgtctctgcctgtttggatgctggaggtcatgctggagtacacttggctctggggcagcttctcctgtcgcttcattcattatttctaccttgtcaacatgtacagcagcatcttcttcctgacgtgcctcagcattgaccgctacgtcaccctcaccaacacctctccctcctggcagcgccaccagcaccgaatacggagggccgtgtgcgcaggcgtctgggtcctctccgccattatcccactgccggaggtggtgcacatccagctgttggatggctccgagcccatgtgcctcttcctagcaccttttgaaacgtacagcgcctgggccctggcagtggccctgtcggccaccatcctgggcttcctactgccttttcttctcatcgcagtgttcaatatcctgacagcctgccggcttcggaggcaaaggcagacggagagcaggcgccactgcctgttgatgtgggcttacatagttgtctttgccatctgctggctgccctaccaagtgactatgctgctgctcactctgcacgggacccacatcttcctccactgtcacctggttaaccttctctacttcttctacgaaatcatcgactgcttttccatgctgcactgtgtggccaaccccatcctctacaactttctcagcccgagcttccggggccgactgctgagccttgtggtccgttaccttcccaaggagcaggccagggcagcaggtggtcgagcctcctcttcttcttccacccagcactccatcatcattaccaaagagggcagcctgccgctgcagcggatctccacacccaccccatccgaaacgttcaggcgtcctctccgcctccaaacacctcacctacactctgcaattctgtagccagctaaggtagactctagcttcctccaccaacaagaaagttcagagggggatgcgagaggtctgtgggagggggtgggaaggactggcttgttcagggccaatttaagtatatcaaaatgttgctgtggggagagggaaacggttcgggaaggacagagaatggatctttccttgatagtacactatttgtttgggtactgatgtctaagggagccacaccggtggggcgtggggggtggggaaccgaaataaataaatcatagagac

SEQ ID NO: 1190 - DNA, 3206 bp, Mus musculus
gtggacccgccaggtcctgggcttagtccctcagaatcacgcctgccatccagtcccaggtacgaaacaggggcactacctctttaaaggcgtccggggctgagcctctgccacaccatgtgattgcttgaaaggccgggctgggagcgcagcggcgggagcctggagaacgatgagccgatgcgcgcgcggtgcccagaacccaaccctgcccggcgcggctccggaaagccgcccggggaacttagggcaacgcctttgggaccccctaccggttggcaggcaggatggtgagctccttgcctccgggtcggcggacacctgtgggcactgtggattcacaggggatccttgtggagtaagtgtacagggagccacctcacacctgatacaaaaaccagtggtggagtgagtgctgctattttaagttgctgaatggaacctctaaggacaaggggaggggacagaggttaagcagatagtgagcctgagtgtctggccagcttgggcaggcactgcatcactttactggggcacatcttcgcagggctgcctatgtccccctccttcccaggctggcatccccaccgcaggcttcctgaccacaggtgctggcctcgcgccccagggcgcctgtctgctgatgtgcccagctcctgcccaccatgccgccgtacatctcggccttccaggctgcctacattggcatcgaggtgctcattgccttggtctctgtgcccggaaatgtactggtgatttgggctgtgaaggtgaaccaggcacttcgcgatgctaccttctgcttcatcgtatccctggcggtagctgatgtggctgttggcgccctggtcatcccactggccatccttatcaacattgggccacagacctacttccacacctgcctcatggtggcctgtcctgtcctcatcctcacccagagctccatcctggctctgcttgctattgctgtggatcggtacctccgagtcaagatccctctccggtacaagacagtggtgactcagcggcgggcagcagtggccatagccggctgctggattctctcccttgtggtaggcctgacacccatgtttggctggaacaacctgagtgaggtggaacaagcctggatagccaacggcagtgttggggagcccgtgatcaagtgtgagttcgagaaggttatcagcatggagtacatggtctacttcaacttcttcgtctgggtgctgccgccattgctcctcatggttcttatctacctggaggtcttctacctgatccgcaagcagctcaacaaaaaggtgtcagcctcctctggtgacccccagaagtactacgggaaggagctcaagatcgccaagtcgctggccctcatcctcttcctctttgccctcagctggctaccgctacacatcttgaactgcatcaccctcttctgccccacctgccagaaacccagcatcctcatctacattgccatcttcctcacacacggcaactcggccatgaaccccatcgtctatgccttccgaatccacaagttccgggtcacctttctgaagatttggaacgaccacttccgatgccagcccaagccccccattgaggaagatatcccagaggagaaagctgatgactaggctctgccttgctccatctagcccacacccagtggctctctgttcaacccccatgtcctccctgttcccccctgtcccactgttcctcctcagccttcccagctgggctgtgggctgtggacaccagggaggctctgaagagatgccatggaacagggccccttctgtaaggagctggctgccctgtaccttggggacctggaggaggtttggagttggggcaggccatagcagggaattgggtgccctcaggtgagaggagagtcttgtgtgcatcattcctggctgttctctgagcagttcagagagctggggttagaatattctggctccttcagtcagacaggggagcctactattaggtgttggtggcccaagggaccaacttcaaagtgaggaagacagtcccttagaggtggatgaatagagagaaatggatatgccgccgcttcgctgtctctcctgttctctaggagaagatagtaaaacacagggaaggagacctcggcccctcctccaaggattgtgttcttggccacgcgggtgctctcctgaccccgagaagcccagggttatacttgggagacacagaaagaatgggtccagggattgtctctcacatttgctctattcacagcctgggactcccagtgggccataaagtccttgggaataaaaatagtgcagaaggtgctggcctcacatagccagcagggagcagcactgagcccttcttgccctgaacttcctgggagtctccaatgcaattttctgtctgggccaccaagcttcaccaactctcagagcaggcctggactctcctgagggacaccatctctgcttccaagccccaggagaagagcttccccaggaagtacaacccttgggagcatgctgcctgagggggggaggagggagaggaaagcatctaagaagatcccaggtgctcctgggcacctctggtgtgcccagaagtgtgaaagaccagaccagaccagaccagaccagaccagaccagaccaaaggagactgctgtcttcagtgtgagaaagtgccttgctggcatttaaatatccaaaaggctcctggaggtggctttagctcaggagctgtgttgcaaatagagtgtaggcttttgtggaggtctcaggtgggaccaatccatgttctgctgagcctggatgtcttccttgtatggacagcaggcaggggagggtgtcaggttctcccctccttgggtgtgaatattgactccaagtcttgattccaggctcttccttcagttggaggtaaggtgtccctggctctcaaggaggaccctatgtctaataaaagattgtgaagccctgtggggagtggggtgctggcaccccagcactgccagagggcaaccaaaccacctcagcggagaagatgtaatggtgggggtggaggggaagctgggagagggctgtggaggcagatggaaagtcccagagatggtgtgtctgttgctatagttacacatttagggtagcacattgtgaatcagaaagcaagatccagaacactcacatgtct

SEQ ID NO: 1191 - DNA, 1230 bp, Mus musculus
atgggctcctcggtgtacatcatggtggagctggccattgctgtgctggccatcctgggtaacgtgcttgtgtgctgggccgtgtggatcaacagcaacctgcagaacgtcaccaacttcttcgtggtatctctggcggcggctgacatcgcggtgggcgtgctcgccatcccattcgccatcaccatcagcactggcttctgcgctgcctgccatggctgcctcttcttcgcctgctttgtcctggtcctcacgcagagttccatcttcagcctcttggctattgccatcgacagatacatcgccatccgaattccactcaggtacaatggcttggtgacgggtatgagggcgaagggcatcattgcgatttgctgggtgctgtcattcgccatcggcctgacccccatgctgggctggaacaactgcagtcagaaagatgagaactccacaaagacctgcggcgagggccgggtgacctgtctgtttgaggacgtggtacccatgaattacatggtttactacaacttcttcgcttttgtgttgctccccctcctgctcatgctggccatctacctaaggatttttttggcagcccggagacagctgaagcagatggagagccaacccctaccaggggagcggactcgctccacactgcagaaggaagtccacgccgccaagtccctggccatcatcgtggggctctttgccctctgctggttgcccctgcacatcatcaactgcttcaccttcttctgctccacgtgccagcacgcccctccttggctcatgtacctggccatcatcctctcccacagcaattccgttgtcaaccccttcatctacgcctacaggatccgggagttccgccagaccttccggaagatcatccgaacccacgtcctgaggcggcaggaacccttcagggcagggggttccagtgcctgggccttggcggctcacagcactgagggcgagcaggtcagcctccgcctcaatggccaccccctgggagtatgggccaatgggagtgctccccactctggacggcggcccaatggctacaccctggggccgggaggtggagggagcacccaagggtctcctggggatgtagagcttcttacccaggagcaccaggaagggcaagagcaccctggcctaggggatcatctggcccagggtagggtaggaacagcctcatggtcttcagagtttgccccttcc

SEQ ID NO: 1192 - DNA, 999 bp, Mus musculus
atgcagctagagacgcaagacgcgctgtacgtggcgctggagctggttatcgctgcgctggcggtggcgggcaacgtgctggtgtgcgccgcggtgggagcctcgagtgcattacagacccccaccaactactttctggtatccctggcgacggcagacgtggccgtgggactcttcgccatcccctttgccatcaccatcagcttgggcttctgcacggactttcacggctgcctcttcctcgcctgcttcgtgctggtgctcacacagagctccatctttagcctcttggcggtggctgtcgaccgatatctggccattcgcgtcccgctcaggtataaaggtttggtcactgggacacgagcgagagggatcattgctgtcctctgggtccttgcctttggcattggattgactccgttcctggggtggaacagtaaagacagtgccaccagcaactgcacagaactgggggatggcatcgcgaataaaagctgctgtcctctgacatgtctctttgagaatgtggtccccatgagctacatggtgtatttcaacttctttgggtgtgtccttcctcccctgctgataatgctggtgatctacatcaaaatcttcatggtggcctgcaagcagcttcagagcatggaactgatggaccactccaggaccactctccagcgggagatccacgcagccaagtcactggctatgatcgtgggcatttttgctctgtgttggctcccagtgcatgccatcaactgtatcaccctcttccatccagccctggccaaggacaagcccaagtgggtgatgaatgtggccatcctcctgtcacatgccaattcagttgtcaaccccattgtctatgcctacaggaaccgagacttccgctacagtttccacaagatcatctccagatatgttctctgccaggccgagaccaagggtgggagtgggcaggctggggcgcagtctactctcagtctgggcttatga

SEQ ID NO: 1193 - DNA, 960 bp, Mus musculus
atggaagccgacaacaccacggagacggactggctgaacatcacctacatcaccatggaggctgccatcgggctctgtgccgttgtgggcaacatgctggtcatctgggtggtcaagctgaaccccactctgaggaccaccaccgtctatttcattgtctccctagcactggctgacattgccgttggggtgctggtcatacctttggccattgctgtcagcctgcaagtcaagatgcacttctatgcctgccttttcatgtcctgtgtgctgctgatcttcacccatgcttccatcatgtccttgctggccattgctgtacaccgatacctgcgggtcaagctgacagtcagatatagaacggttaccactcaaagaagaatatggctattcctgggcctttgctggctagtttcctttctggtggggctgacccccatgtttggctggaatagaaaagcaaccttagcgagctctcaaaatagcagcactcttttgtgccacttccgttccgtggtcagtttggattacatggtcttcttcagcttcatcacctggatcctcgtccccctggttgtcatgtgcatcatctatctggacatcttctacatcatccgaaacaaactcagtcaaaacctgactggcttcagagagacgcgtgcattttatggacgggagttcaagacagctaagtccctgtttctggttctcttcttgtttgcgctgtgctggctgcctttgtccatcatcaattttgtttcctattttgatgtaaagataccagatgtcgcaatgtgcctggggatcctgttgtcccacgcgaactccatgatgaaccctattgtctacgcctgcaaaataaaaaagttcaaagagacctactttctgatcctcagagctgtcaggctctgtcagacctcagattctttggactcaaacatggaacagactactgagtag

SEQ ID NO: 1194 - DNA, 1401 bp, Mus musculus
atggtgcttctttctgaaaatgcttctgaaggctccaactgcacccacccgccagcacaggtgaacatttctaaggccattctgcttggggtgatcttggggggcctcatcattttcggggtcttggggaacattttagtgatcctctcggtggcctgtcatcggcatctgcactcggtgactcactactacattgtcaacctggctgtggcagacctcctcctcacctccaccgtgctgcccttctctgccatctttgagatcctgggatactgggcctttggcagggtgttctgcaacatctgggcggcggtggacgtcttatgctgcacagcgtccatcatgggcctctgcatcatctccatcgaccgatacattggtgtgagctacccgctgcgctaccccaccattgtcacccagaggaggggcgtcagggctctgctctgcgtctgggcgctttccttggtcatctccatcggacccctgttcggctggaggcagcaggctccggaggatgagaccatctgccaaatcaatgaggagccaggatacgtgctgttctcagcgctgggctctttctacgtgccactgaccatcatcctggttatgtactgtcgagtctacgtggtagccaagagagaaagccgaggcctcaagtccggcctcaagaccgacaagtcagactcagagcaagtgacgctccgtatccaccgtaaaaatgtccctgcagaaggcagcggagtaagcagtgccaagaataagactcacttctccgtgaggctgctcaagttttcccgagagaagaaagccgccaagacgctgggcattgtggtgggatgcttcgtcctctgctggctgccgttcttcctcgtgatgcccattgggtccttcttcccgaatttcaagccaccggaaacagttttcaaaatagtattttggcttgggtacctaaatagttgcatcaaccctatcatatacccatgctccagccaggagttcaagaaagcctttcagaatgtgctgcgaatccagtgtcttcgcagaaggcagtcttccaagcatgccctgggctacactctgcacccacccagccaggctgtagaggaacagcacagaggcatggtgcgtatcccggtgggctcaggagagactttctataagatctccaagacagatggagtctgtgaatggaagtttttctcttccatgccccagggatcggccaggattaccatgccgaaggaccaatccgcctgtaccacagcccgggtgagaagtaaaagctttttgcaggtctgctgctgtgtggggtcgtcgaccccacgccctgaagaaaatcaccaagttccaaccattaagatccacaccatctccctcggtgaaaacggggaggaagtctag

SEQ ID NO: 1195 - DNA, 1545 bp, Mus musculus
atgaatcccgatctggacaccggccacaacacatcagcacctgcccactggggagagttgaaagatgccaacttcactggccccaaccagacctcgagcaactccacactgccccagctggacgtcaccagggccatctctgtgggctgtctgggcgccttcatcctctttgccatcgtgggcaacatcttggtcatcctgtcggtggcctgcaaccggcacctgcggacgccaaccaactacttcattgtcaacctggccattgctgacctgctgttgagcttcacagacctgcccttctccgctaccctggaagtgctcggctactgggtgctggggcgcatcttctgtgacatctgggcagcggttgatgtcctgtgttgcacggcctccatcctgagcctatgtgccatctccattgaccgctacattggggtgcgttactctctgcagtaccccacgctggtcacccgcaggaaggccatcttggcgctcctcagtgtgtgggtcctctccacggtcatctccatcgggcctctccttggatggaaagaacctgcgcccaatgacgacaaagaatgtggggtcacagaagaacccttctacgccctcttttcctccctgggctccttctacatcccactggcggtcatcctggtcatgtactgccgagtctacatcgtggcaaagaggaccaccaagaatctggaggcgggagtcatgaaggaaatgtccaactccaaagagctgaccctgagaatccactctaagaactttcatgaggacaccctcagcagtaccaaggccaagggccacaaccccaggagttccatagctgtcaaactttttaagttctccagggaaaagaaagcagccaaaaccttgggcattgtagtcggaatgttcatcttatgttggctccccttcttcatcgctctcccacttggctccctgttctccaccctaaagcccccggacgcggtattcaaggtagtgttctggctgggctacttcaacagctgcctcaaccccatcatctacccgtgctccagcaaggagttcaaacgcgccttcatgcgtatcctggggtgccagtgccgcggtggccgtcgccgccgccgccgtcgccgtctaggagcgtgcgcttacacctaccggccgtggacccgcggcggctcgctggagaggtcgcagtcgcggaaggactctctggatgacagtggcagctgcatgagcggcagccagcggaccctgccctcggcgtcacccagcccgggatacctgggtcgtggaacgcagccacccgtggagctgtgcgccttccccgagtggaaacccggagcgctgctcagcctgccagagcctcctggccgccgcggccgcctcgactccgggccactcttcactttcaagctcctgggcgagcctgagagcccggggaccgaaggcgacgccagcaatgggggctgcgacaccacaactgacctggccaacgggcagccgggcttcaagagcaacatgcccctggcgcccgggcacttttag

SEQ ID NO: 1196 - DNA, 1677 bp, Mus musculus
atgactttccgcgacatcctgagcgtcactttcgaaggaccccgggcgagcagtagcactgggggctccggcgcgggcggcggagctggcacggttggccccgagggtccggcggtgggcggcgtgccgggtgccacaggcggtagcgctgtggtgggaaccggcagcggcgaggacaaccagagctccacggcagaagcgggggccgcggcaagcggcgaggtgaatggctcggcggccgtcggggggctagtggtgagtgctcagggcgtgggagtgggtgtcttcctagccgccttcatcctcaccgctgtggcgggcaaccttctcgtcatcctctccgtggcctgcaaccgccacttgcagacggtcaccaactatttcatcgtgaacctagcagtggctgacctgctactgagtgcagctgtgttgcccttctcagccactatggaggttctaggcttctgggccttcggccggaccttctgcgacgtatgggccgcggtggacgtgctatgctgcactgcctccatccttagcctctgcaccatctctgtggaccggtacgtgggtgtgcgccactcgctcaagtatccagccattatgacagaacgcaaggccgctgccattctggctctgctctgggcggtggccttggtggtatctgtgggaccgctactaggttggaaggaaccagtgcccccggatgagcgtttctgcggcatcaccgaggaggtgggctatgcgatcttctcttccgtatgctccttctacctccccatggcagtgatcgtggtcatgtactgccgcgtgtatgtggtcgcgcgcagcaccacgcgcagcctcgaggcgggcatcaagagggagccgggcaaggcctctgaggtggttctgaggatccactgtcgcggcgcagccactagcgccaaaggaaatccagggacacagagtagcaaggggcacaccttgcgcagctcgctctccgtaaggctgctcaagttttcccgcgagaaaaaggctgccaagaccctagccatcgtcgtgggtgtcttcgtcctgtgctggttcccctttttcttcgtcctgcctctgggttctctgttccctcagctgaaaccatcagagggcgtcttcaaggtcatcttctggctgggctacttcaatagctgtgtgaacccgctcatctacccctgctccagtcgcgagttcaagcgcgccttcctccgcctcctgcgctgccagtgtcgccgccgccgccgccgcctctggagtctacggccaccactggcgagcctcgaccggcgacccgcgctccgactgtgcccccagcccgcgcatcgcaccccccggggctcccctagccctcactgcacacccaggcccgggctccgtagacacgccggaggcgcaggcttcggtctccggccgtcgaaagccagcctccgcctccgggagtggaggctgcttgggccgctacagagacccacgacccagctgcgtgcgaaggtgtccagcctgtcccataagttccgctctgggggcgcgcggcgcgcggagtctgcgtgtgccctgcgctcggaggtagaagcagtgtccctaaatgttccccaagacggggcagaggctgtcatctgccaggcttatgagccgggcaacctcagcaacctccgggagacc

SEQ ID NO: 1197 - DNA, 1353 bp, Mus musculus
atgggctcactgcagccggatgccggcaacagcagctggaacgggaccgaagcgcccggaggcggcacccgagccaccccttactccctgcaggtgacactgacgctggtttgcctggctggcctgctcatgctgttcacagtatttggcaacgtgctggttattatcgcggtgttcaccagtcgcgcgctcaaagctccccaaaacctcttcctggtgtccctggcctcagcggacatcctggtggccacgctggtcattcccttttctttggccaacgaggttatgggttactggtactttggtaaggtgtggtgtgagatctatttggctctcgacgtgctcttttgcacgtcgtccatagtgcacctgtgcgccatcagccttgaccgctactggtccatcacgcaggccatcgagtacaacctgaagcgcacgccgcgtcgcatcaaggccatcattgtcaccgtgtgggtcatctcggctgtcatctccttcccgccactcatctccatagagaagaagggcgctggcggcgggcagcagccggccgagccaagctgcaagatcaacgaccagaagtggtatgtcatctcctcgtccatcggttccttcttcgcgccttgcctcatcatgatcctggtctacgtgcgtatttaccagatcgccaagcgtcgcacccgcgtgcctcccagccgccggggtccggacgcctgttccgcgccgccggggggcgccgatcgcaggcccaacgggctgggcccggagcgcggcgcgggtcccacgggcgctgaggcggagccgctgcccacccagcttaacggtgccccgggggagcccgcgcccgccgggccccgcgatggggatgcgctggacctagaggagagttcgtcgtccgagcacgccgagcggcccccggggccccgcagacccgaccgcggcccccgagccaagggcaagacccgggcgagtcaggtgaagccgggggacagtctgccgcggcgcgggcccggggccgcggggccgggggcttcggggtccgggcacggagaggagcgcggcgggggcgccaaagcgtcgcgctggcgcgggaggcaaaaccgggagaaacgcttcacgttcgtgctggcggtggtgatcggcgtgttcgtggtgtgttggtttccgttctttttcacctacacgctcatagcggtcggctgcccggtgcccagccagctcttcaacttcttcttctggttcggctactgcaacagctcgctgaaccctgttatctacaccatcttcaaccacgacttccgacgcgccttcaagaagatcctctgccgtggggacagaaaacgcatcgtgtga

SEQ ID NO: 1198 - DNA, 1347 bp, Mus musculus
atggtccaccaggagccctactcggtgcaggccaccgccgccatcgcgtcggccatcacctttctcatcctcttcaccattttcggcaatgcgctggtaattctggctgtgttgaccagccgctctctccgtgcaccacaaaacctcttcctggtgtcactggcagcagccgacatcctagtggctactcttatcatccctttctctctggccaacgagctgctgggctattggtacttctggcgtgcgtggtgcgaggtctacctggcgctagacgtgctcttctgtacctcctccatcgtgcacctgtgtgccatcagtctggacagatactgggcagtgagccgagcattggagtacaactccaagcgcactccacgccgcatcaaatgcatcatcctcaccgtgtggctcattgcagccgtcatttctctaccgcccctcatctacaagggcgaccagcgcccagagccccacgggctcccccagtgtgagctcaaccaagaagcctggtacatcttggcttccagcatcggatctttttttgctccctgcctcatcatgattctcgtctacctgcgaatctatgtaattgccaaacgcagccactgcagaggtctcggagctaagaggggctctggggagggtgagtccaagaagccccgtccggccgccgggggagttccagcctcggctaaagtgcccaccctggtctctcctctatcttctgtcggagaggctaatggacaccccaagcctccaagggagaaggaggagggggagacccctgaagatcccgaagccagggctttgccacccaattggtctgccctgcccagatcagtccaggaccagaagaaggggactagtggggcaactgcagagaagggagctgaagaggatgaagaggaggtggaagaatgtgaaccccaaacactgccagcttctcctgcctcagtattcaacccacccttgcagcagcctcagacttcccgggtgctggccacgctacgtggccaggtgcttctgagcaagaatgtgggtgtggccagtgggcagtggtggcgccgtcggacacagctgagccgagagaagaggttcacctttgtgctggcggtggtcattggtgtttttgtggtctgttggtttcctttcttcttcagctacagcctgggggccatctgcccacagcactgcaaggtaccccatggcctcttccagttcttcttctggattggctactgcaacagctctttgaatcctgtcatctacaccatcttcaaccaggacttccgccgtgcctttcgaaggatcctttgccggcagtggacccagactggctggtga

SEQ ID NO: 1199 - DNA, 1377 bp, Mus musculus
atggcgtccccagcgctggccgcggcgctggcggcggcggcggctgagggccccaacgggagcgacgcgggcgaatggggtagcggcgggggtgccaacgcctcggggaccgactgggtgccaccgccgggccagtactccgcaggtgctgtggcggggttggcagctgtggtgggtttcctcatcgttttcaccgtggtaggcaatgtgctcgtggtgatcgctgtgttgaccagccgagcactgcgcgccccgcagaacctcttcctggtgtctctggcctcagctgacatcctggtggccacactggtcatgcccttttctctggccaatgagctcatggcctactggtacttcgggcaagtgtggtgtggtgtatacctggcactggacgtgctcttctgcacctcgtccatcgtgcacctgtgtgccattagtctggaccgctactggtcggtgacgcaagcggtagagtacaacctgaagcgcacgccgcgccgtgtcaaggccaccatcgtggccgtgtggctcatctccgctgtcatctccttcccgcctctcgtctcgttctaccgccggcccgacgtcgccgcctatccgcagtgcggcctcaacgatgagacctggtacatcttgtcctcctgcataggctccttcttcgcgccctgcctcatcatgggcctggtctatgcgcgcatctaccgcgtggccaagctgcgcacgcgtacgctcagcgagaaacgcggccccgccggccccgacggcgcgtccccgaccacagagaatgggctgggcaaggcagcgggggagaacgggcattgcgcgcccccgcgcactgaagtggagccggatgagagcagtgcggccgagaggcggaggcgccgggcggccgtgcgcagaggaggacggcggcgagagggtgctgagggggacacgggcagtgcggacggaccgggaccgggactggcagccgagcagggtgctcggacggcgtctcggtccccaggccccggagggcgcctgtcgcgggccagctcgcgctccgtcgagttcttcctgtcgcgtcggcgccgggcgcgcagcagtgtgtgccgccgcaaggtggcccaggcacgcgagaagcgcttcaccttcgtgttggcggtggtcatgggcgtgttcgtactgtgctggttccccttcttcttcagctacagcctgtatggcatctgccgtgaggcctgccagttgccagaaccgctctttaagtttttcttctggatcggctactgcaacagttcgctcaacccggtcatctacactgtcttcaatcaggacttcaggcgctctttcaagcatatcctctttcgaaggaggagaaggggcttcaggcaatga

SEQ ID NO: 1200 - DNA, 1401 bp, Mus musculus
atgggcgcgggggcgctcgccctgggcgcctccgaaccctgcaacctgtcgtccgccgcgccgctgcccgacggtgcggccaccgcggcgcggctgctggtgctcgcgtcgcctcccgcctcgctgctgcctccagccagcgagggctcagcgccgctgtcgcagcagtggaccgcgggtatgggcctactcgtggcgctcatcgttctgctcatcgtggtgggtaacgtgctggtgatcgtggccatcgccaagaccccgcggctgcagacgctcaccaacctcttcatcatgtccctggccagcgctgatctggtcatgggattgctggtggtgcctttcggggccaccatcgtggtgtggggccgctgggagtacggctccttcttctgcgagctctggacttcggtagatgtgctgtgtgtgacggccagcattgagaccctgtgtgtcatcgccctggaccgctacctcgccatcacgtcgccctttcgctaccagagtttgctgacgcgcgcgcgagcgcgggccctcgtgtgcacagtgtgggccatctcggcgttggtgtccttcctgcccatcctcatgcactggtggcgggccgagagcgacgaagcgcgccgctgctacaacgaccccaagtgctgcgatttcgtcaccaacagggcctacgccatcgcctcgtccgtcgtctccttctacgtgcccctgtgcatcatggccttcgtgtacctgcgggtgttccgcgaggcccaaaaacaggtaaagaagatcgacagctgcgagcgccgcttcctcggcggcccagcccggccgccctcgcctgagccctcgccgtcacctgggccaccgcgccccgcagactcgctggccaacgggcgctccagcaagcggcggccgtcgcgcctcgtggctctgcgcgagcagaaggcgctcaagacactgggcatcatcatgggtgtgttcacgctctgctggctgcccttcttcctggccaacgtggtgaaggctttccaccgcgacctggtgccggatcgcctcttcgtcttcttcaactggctgggctacgccaactcggccttcaaccccatcatctactgccgcagccccgacttccgcaaggctttccagcgcctgctctgctgcgcgcgccgggccgcctgcagacgccgcgcagcccacggggaccggccgcgcgcctccggctgcctggcgagagctgggccgccgccgtcccccggagctccctcggacgacgacgacgacgacgccgggaccaccccaccggcgcgcctgctggagccctggaccggctgcaacggcgggacaaccactgtggacagcgattcgagcctggacgagccggggcgccagggcttctcctcggagtccaaggtgtag

SEQ ID NO: 1201 - DNA, 1254 bp, Mus musculus
atggggccacacgggaacgacagcgacttcttgctggcacccaacggaagccgagcgccagaccacgacgtcactcaggaacgggacgaagcgtgggttgtgggcatggccatcctcatgtcggttatcgtcctggccatcgtgtttggcaacgtgctggtcatcacagccattgccaagttcgagcgactacaaaccgtcaccaactacttcataatctccttggcgtgtgctgatctagtcatgggcctagcggtggtgccgtttggggccagtcacatccttatgaaaatgtggaattttggcaacttctggtgcgagttctggacttccattgatgtgttgtgcgtcacagccagcatcgagaccctgtgcgtgattgcagtggatcgctatgttgctatcacatcgcccttcaagtaccagagcctgctgaccaagaataaggcccgagtggtcatcctgatggtatggattgtatctggccttacctcctttttgcctatccagatgcactggtaccgtgccacccacaagaaagctatcgattgttacaccgaggagacttgctgtgacttcttcacgaaccaggcctacgccatcgcgtcctcgattgtgtctttctacgtgcccctggtggtgatggtctttgtctattcccgggtcttccaggtggccaaaaggcagctgcagaagatagacaaatctgaaggaagattccacgcccaaaacctcagccaggtggagcaggatgggcggagcggccacggactccgaaggtcctccaagttctgcttgaaagagcacaaagccctcaagactttaggcatcatcatgggcacattcaccctctgctggctgcccttcttcattgtcaatatcgtgcacgttatcagggacaacctcatccctaaggaagtttacatcctccttaactggttgggctacgtcaactctgccttcaatcctcttatctactgtcggagtccagatttcaggattgcctttcaagagcttctgtgccttcgcaggtcttcttcgaaaacctatgggaacggctactctagcaatagcaacggcagaacggactacacaggggagccaaacacttgtcagctggggcaggagagagaacaggaactgctgtgtgaggatcccccaggcatggaaggctttgtgaactgtcaaggtactgtgcctagccttagcgttgactcccaaggaaggaactgtagtacaaatgactcgccactg

SEQ ID NO: 1202 - DNA, 1203 bp, Mus musculus
atggctccgtggcctcacagaaacggctctctggctttgtggtcggacgcccctaccctggaccccagtgcagccaacaccagtgggttgccaggagtaccatgggcagcggcattggctggggcattgctggcgctggccacggtgggaggcaacctgctggtaatcatagccatcgcccgcacgccgagactacagaccataaccaacgtgttcgtgacttcactggccgcagctgacttggtagtgggactcctcgtaatgccaccaggggccacattggcgctgactggccattggcccttgggcgaaactggttgcgaactgtggacgtcagtggacgtgctctgtgtaactgctagcatcgagaccttgtgcgccctggctgtggaccgctacctagctgtcaccaaccctttgcgttacggcacgctggttaccaagcgccgcgcccgcgcggcagttgtcctggtgtggatcgtgtccgctgccgtgtcctttgcgcccatcatgagccagtggtggcgtgtaggggcagatgccgaggcacaggaatgccactccaatccgcgctgctgttcctttgcctccaacatgccctatgcgctgctctcctcctccgtctccttctaccttcccctccttgtgatgctcttcgtctatgctcgagtgttcgttgtggctaagcgccaacggcatttgctgcgccgggaactgggccgcttctcgcccgaggagtctccgccgtctccgtcgcgctctccgtcccctgccacaggcgggacacccgcggcaccggatggagtgcccccctgcggccggcggcctgcgcgcctcctgccactccgggaacaccgcgccctgcgcaccttaggtctcattatgggcatcttctctctgtgctggctgcccttcttcctggccaacgtgctgcgcgcactcgcggggccctctctagttcccagcggagttttcatcgccctgaactggctgggctatgccaactccgccttcaacccggtcatctactgccgcagcccggactttcgcgacgccttccgtcgtcttctgtgtagctacggtggccgtggaccggaggagccacgcgcagtcaccttcccagccagccctgttgaagccaggcagagtccaccgctcaacaggtttgatggctatgaaggtgcgcgtccgtttcccacgtga

SEQ ID NO: 1203 - DNA, 1080 bp, Mus musculus
atggcccttaactcttctactgaagatggcatcaaaagaattcaagatgactgccccagggctggcaggcacagttacatatttgtcatgatccctactctctacagcatcatctttgtggtgggaatatttggaaacagcttggtggtgatcgtcatctacttttacatgaagctgaagactgtggccagtgtctttcttctaaatctcgccctggctgacttatgctttttgctgactttgcccctgtgggctgtctataccgctatggaataccgctggcccttcggcaatcacctatgtaagatcgcttcggccagcgtcagtttcaacctctacgccagcgtgttcctgctcacgtgtctcagcatcgatcgctacctggccattgtccacccgatgaagtctcgcctccgccgcacgatgctggtggccaaagtcacctgcatcatcatctggctgatggctggcttggccagtttgccagccgtcatccaccgaaatgtgtatttcattgagaacaccaatatcactgtttgcgcttttcattacgagtcccggaattcaacgctccccataggactgggcctaaccaagaacatcctgggcttcctgttccctttcctaatcattcttaccagctatactcttatatggaaagctctaaagaaggcttatgaaattcagaagaacaagccaagaaatgatgacatctttaggataattatggcgattgtgcttttcttcttcttctcctgggtcccccaccaaatattcacattcctggatgtgctgattcagctgggcgtcatccatgactgtaaaattgccgacatcgtggacactgccatgcccataaccatctgcatagcgtattttaacaactgcctgaaccctctgttttacggctttctggggaaaaaatttaaaaagtatttcctccagctcctgaaatatattcccccaaaggccaagtcgcactcaagcctgtctacgaaaatgagcacgctctcctaccgcccctcagataacatgagctcagccgccaaaaagcctgcgtcttgttctgaggtggagtga

SEQ ID NO: 1204 - DNA, 1092 bp, Mus musculus
atgaaggacaacttcagttttgctgccaccagcagaaacattaccagcagccgtccttttgataatctcaacgcaactggcaccaatgagtccgcctttaattgctcacacaaaccatcagataagcatttggaagcaattcctgttctctactacatgatttttgtgattgggtttgctgttaatattgttgtggtctcactgttttgttgtcaaaagggccctaaaaaggtgtccagcatttacatcttcaatctggccttggctgacttactccttttggctaccctccctctctgggcaacctattactcttatagatatgattggctttttggacctgtgatgtgcaaagtgtttggttcttttctgactctgaacatgtttgcaagcattttttttattacctgcatgagtgtcgataggtaccaatcggtcatctacccttttctgtctcaaagaaggaatccctggcaagcatcttatgtagttccccttgtttggtgtatggcttgtctatcctcattgccaacattttatttccgggatgtcagaaccattgaatacttaggtgtgaatgcttgtattatggctttcccacccgagaaatatgctcagtggtctgctgggattgccttaatgaaaaatattcttggctttattattcctttaatattcatagcaacgtgttactttggaatcagaaaacatctgctgaagactaatagctatgggaagaacagaattacccgtgaccaagtcctgaagatggcagctgctgttgtgttggcattcatcatttgctggcttcccttccatgttctgaccttcttggatgctctgacctggatgggtatcattaatagctgtgaagttatagcagtcattgacctggcacttccttttgccatcctcctgggattcaccaacagctgtgttaatcccttcctgtattgttttgttggaaaccgcttccaacagaagctccgcagtgtgtttagagttcccattacttggctccaaggcaagagagagactatgtcttgcagaaaaggcagttctcttagagaaatggacacctttgtgtcttaa

SEQ ID NO: 1205 - DNA, 1134 bp, Mus musculus
atggaagatgatggttacaactactatggggctgacaaccagtctgaatgcgactacgcagactggaagccctctggagcgctcattcctgccatctacatgttggtttttcttctaggcaccacaggcaatggcctggtgctctggaccgtgtttcgaaccagccgcgaaaagagacgctcagctgacatcttcattgccagcctggcagtggctgacttgacctttgtggtgactttgccactgtgggccacttatacctaccgggaatttgactggccttttgggaccttctcttgcaagctcagcagctacctcatctttgtcaacatgtacgccagtgtcttttgcctcaccggcctcagctttgaccgatacctggccattgtcaggccggtggccaatgctcggctaaggctgcgagtcagcggggccgtggccacagcagtcttatgggtgctggctgcccttctagctgtgcctgtcatggtgttccgttccacagacgcctcggaaaatggcaccaagatccagtgctacatggactactctatggtggccacttcaaactcagagtgggcctgggaggtgggccttggggtgtcctccactgccgtgggctttgtggtgcccttcaccatcatgctgacatgttacttcttcattgcccaaaccatcgctggccatttccgaaaggagcgcattgagggcctgcggaaaaggcgccggctgctcagcattatcgtggtgcttgtagtgacctttgccctgtgctggatgccttaccacctggtgaaaactctctacatgctgggcagtttgctgcactggccctgtgactttgacatcttcctcatgaatgtctttccgtactgcacctgcatcagttatgtcaacagctgcctcaacccctttctctatgccttctttgacccccgatttcgccaagcctgcacctccatgctctgctgtgatcagagcgggtgcaaaggcacccctcacagcagtagtgctgagaagtcagccagttattcttccgggcacagccagggccctggccccaacatgggaaagggaggagagcagatgcatgagaaatcgattccctatagtcaagaaacccttgtggactag

SEQ ID NO: 1206 - DNA, 1272 bp, Mus musculus
atgagtttcccgcgaggctcccacgatctgcccgcgggcaactccagcccgtggtggcctctgaccaccgagggcgccaacagcagccgggaagcagctgggctcggggaaggcggcagcccgccgggggacgtacgcaacgaggagctggcgaagctggaggttaccgtgctggcggtgattttcgtggtggccgtgctgggtaatagcagtgtgctgctggcgctgcatcgcacgccacgcaagacatcccgcatgcatctcttcatccgacacctcagcctggcagacctggcggtcgccttcttccaagtgttaccacagctgtgctgggacatcacctaccgcttccgcgggccggactggctgtgccgggtggtgaagcacttgcaggtgtttgccatgttcgcatcttcctacatgctggtggtgatgacggctgaccgctacatcgccgtgtgccacccgctcaagaccctgcagcagcccgcgcgccgctcgcgcctcatgatcgccgcctcttgggggctgagtttcgttctgagcataccacagtactttatcttctctgtgatcgaatttgaggtgaacaatggcaccaaagcccaagattgctgggctaccttcatcccgccctggggtacccgtgcctacgtgacctggatgaccagcggggtcttcgtggtacccgtgatcatcttgggtacctgctatggcttcatctgttaccacatctggcgcaatgtccgagggaagacagcatcgcgacagagcaaaggcggcaagggctctggggaagccgcgggtcccttccacaaggggcttctggtcacgccttgtgtcagcagcgtgaagagcatttcccgtgccaagatccgcacagtgaagatgacctttgtgattgtaagcgcctacatcctctgctggacacctttcttcatcgtccagatgtggtcagtctgggataccaatttcgtttggaccgattccgaaaacccttccaccacgatcacggcgttactggcttccttgaacagctgctgcaacccgtggatctacatgttttttagtggtcatctcctacaagattgtgtccagagcttcccatgctgccaaagcatagcgcagaaattcgccaaggatgactcggatagcatgagccggagacagacatcttactctaacaaccgaagcccaacaaacagcactgggacgtggaaggattcacctaaatcttcaaagtccatcagatttatccctgtctccacttga

SEQ ID NO: 1207 - DNA, 1266 bp, Mus musculus
atggattctgagccttcttggactgctaccccctcccctgggggcaccctgtttgtccccaataccaccacaccctggctgggtagggatgaagagctagccaaggtggagattggtatcctagctactgtcctggttctggccacaggaggcaacctggctgtactactgattctgggcctccagggccataagcgctcccgcatgcatctgttcgtgctgcacttggccctgaccgacctgggcgtggcgcttttccaggtactgcctcagctgctctgggacatcacctatcgcttccagggctctgacctcctctgccgggctgtcaaatatctacaggtgctcagcatgtttgcttccacttacatgctgctggccatgacgctggaccggtacctggctgtctgtcaccctcttcgaagcctccagcagcccagccagtccacctacccccttattgctgctccctggctgctggctgccatcctcagcctccctcaagtgttcattttttcgttgcgagaggtgatccagggctcaggggtgctggactgctgggcagatttctacttttcctggggcccgcgggcctacatcacctggaccaccatggccatctttgtgctgcccgtggtggtgctcacagcttgctatggcctcatctgccacgagatctacaagaacctgaaagtcaagacacaggctggcagggaggaaagaaggggctggcccaagtcctcatcttctgccgctgctgcagccactagggggctgccgtcccgggtcagcagcatcagtaccatctccagggcaaagatccgaaccgtgaagatgacctttgtcattgtgctggcctacattgcttgctgggcacctttcttcagtgtccagatgtggtctgtgtgggacgagaatgcccctaatgaagattctaccaatgtggctttcaccatctcgatgcttctgggcaacctcagcagctgctgcaacccctggatctatatgggcttcaacagccacctgttgccacgttccctgagtcaccgcgcctgctgcaggggttccaagccccgagtgcacaggcagctctccaacagcagcctcgctagccgccgcacaacactgctgacccacacctgtggtccatctactctccgtcttagccttaacctcagcctccatgcaaagcctaagcctgcgggctcgctgaaggatttggagcaggtggatggagaagccactatggagaccagcatctcttag

SEQ ID NO: 1208 - DNA, 1116 bp, Mus musculus
atgatcctggtgtctaccacgtctgcagtgcctggggccctttcgtcccctagctctcccagcaacagcagccaggaggagctactggatgaccgagacccgctgttagtccgggctgaactggccctgctatctacaatttttgtggctgtggccttgagcaatggcctagtgcttggggccctaatacgacggggtcggcgtggacgctgggcacccatgcacgtcttcatcagtcatttgtgcctagctgacctggctgtggctctgtttcaagtgctgccccagctggcttgggatgccaccgaccgcttccatggccctgatgccttgtgtcgggccgtcaagtacctgcagatggtgggcatgtatgcctcttcctacatgatcctggccatgacactagaccgccatcgcgccatctgccgccctatgctggcataccgccatggaggtggggctcgctggaacaggccagtgctggtggcctgggccttctcactccttctcagcctgcctcagctcttcatctttgctcaacgtgatgtgggaaatggcagtggggtatttgattgctgggcccgatttgcagagccatggggccttcgtgcctatgtcacctggatcgccttgatggtgtttgtggcacctgccctaggcattgctgcctgccaggttcttatcttccgggagatacatgccagtctggtgccagggccatctgaaagggcagggaggcgccgcagaggacaccggacaggaagtcccagcgagggagcccatgtatcagcagccatggccaagaccgtgaggatgacactagtgattgtgattgtctacgtgctgtgctgggcacccttcttccttgtgcagctgtgggcagcgtgggatccagaagctcctctggaaagacccccctttgtgttgctcatgctgctggctagccttaacagctgtaccaacccctggatctatgcttccttcagtagcagtgtctcctcggagttgcgtagcctgctttgctgtgctcagaggcacaccacacacagcctgggtcctcaagatgagtcctgtgccacagccagctcctctctgatgaaggatacaccctcctga

SEQ ID NO: 1209 - DNA, 1005 bp, Mus musculus
atggcgtcccaggcctcgctgaagctacagccttctaaccaaagccagcaggcccctcccaacatcacctcctgcgagggcgccccggaagcctgggatctgctgtgtcgggtgctgccagggtttgtcatcactgtctgtttctttggcctcctggggaaccttttagtcctgtccttcttccttttgccttggcgacgatggtggcagcagcggcggcagcgcctaaccatagcagaaatctacctggctaacttggcagcttctgatctggtgtttgtgctgggcctgcccttctgggcagagaacgttgggaaccgtttcaactggccctttggaagtgacctctgccgggtggtcagcggggtcatcaaggccaacctgttcatcagcatcttcctggtggtggccatcagtcaggaccgctacaggttgctggtataccccatgaccagctgggggaaccggcggcgacggcaagcccaagtgacctgcctgctcatctgggtagctgggggcctcttgagcacccccacgttccttctgcgttccgtcaaagtcgtccctgatctgaacatctctgcctgcatcctgcttttcccccacgaagcttggcactttgtaaggatggtggagttgaacgttttgggtttcctcctcccattggctgccatcctctacttcaactttcacatcctggcctccctgagaggacagaaggaggccagcagaacccggtgtgggggacccaaggacagcaagacaatggggctgatcctcacactggtagcctccttcctggtctgctgggccccttaccacttctttgccttcctggatttcctggtccaggtgagagtgatccaggactgcttctggaaggagctcacagacctgggcctgcagctggccaacttctttgcttttgtcaacagctgcctgaacccactgatttatgtctttgcaggccggctctttaagaccagggttctgggaactttataa

SEQ ID NO: 1210 - DNA, 1176 bp, Mus musculus
atgccctgctcctggaagctactcgggtttctgtcggtgcatgagcccatgcccaccgcggcctcctttgggatcgaaatgttcaacgtcaccacacaagtcctcgggtctgctcttaacgggaccctttcgaaggacaactgcccagacaccgagtggtggagttggctcaatgccatccaggcccccttcctctgggtcctcttcctgctggccgcactggagaacctctttgtcctcagcgtgttcttcctgcacaaaaacagctgcactgtggccgagatctacctgggcaacctggcagcggcggacctcatcctggcctgcgggttacctttctgggccatcaccatcgccaataactttgactgggtgtttggagaggtgttgtgccgggtggtgaacaccatgatctacatgaacctgtacagcagcatctgcttcctgatgctcgtgagtatcgaccgctacctggcgctggtgaagaccatgtccatgggccggatgcgcggggtgcgctgggccaaactctacagcctggtgatctggggctgtacactgcttctgagttcacccatgttggtgttcaggaccatgagggaatacagcgaagagggccacaatgtcaccgcctgcgtcatcgtctacccgtcccgttcctgggaggtgttcaccaacgtgctgctgaacctggtgggtttcctcctgcccctgagcgtcatcaccttctgcacggtgcgcatcttgcaggtgctgaggaacaacgagatgaagaagttcaaggaggtccagacggagaggaaggccaccgtgctagtgctggccgtcctggggctctttgtgctgtgttgggtgcctttccagatcagcaccttcctggacacgctgctgcgcctcggcgtgctgtccggatgctgggacgagcacgccgtagacgtcatcacgcagatcagttcctacgtggcctacagcaacagcggcctcaacccactggtgtacgtgatcgtgggcaagcgcttccggaagaagtcccgagaggtgtaccgggtgctgtgccagaaaggaggctgcatgggagaacccgtccagatggagaactccatggggactttgagaacctcgatctccgtggaacggcagatccacaagctgcaggactgggcagggaagaaacag

SEQ ID NO: 1211 - DNA, 1125 bp, Mus musculus
atgaactacccactaaccctggacatgggctccatcacatacaatatggatgacctgtacaaggaactggccttctacagtaacagcacggagattcccctacaggacagtaacttctgctctacagtcgagggacccttactgacgtcctttaaggcggtattcatgcctgtggcctacagcctcatcttcctcctgggtatgatgggaaacatcctggtgctggtaatcctggagaggcaccggcacactcggagctcaaccgagaccttcctgttccacctcgcagtagccgaccttctcttagtcttcatcctgccttttgcagtggctgagggctctgtgggttgggtcctagggaccttcctctgcaaaactgtgatcgctctgcacaagatcaatttctactgcagcagcctgctcgtggcctgtatagctgtagaccggtacctagccatcgtccatgctgttcacgcctaccgccgccgtcgactcctctccatccacatcacctgcacggccatttggctggccggcttcctgttcgccttaccggaactcctctttgccaaggttggccaacctcataacaacgactccttaccacagtgcaccttctcccaggaaaacgaagcggaaactagagcctggttcacctcccgtttcctctaccacatcgggggcttcctactaccgatgcttgtgatgggatggtgttacgtgggcgtggtccacaggctactgcaggcccagcggcgccctcagcggcagaaggcggtcagggtggccattttagtgacaagcattttcttcctctgctggtcgccctaccacattgtcatcttcctagatacactggagaggctgaaggctgtgaatagcagctgcgagctgagtggctatctctctgtggccatcaccttgtgtgaattcctgggcctggcacactgctgtctcaatcccatgctttacaccttcgctggcgtaaagttccgcagtgacctctctcggcttctgaccaagctgggctgtgctggcccggcctccctttgccaacttttccccaactggcgcaagagtagtctctctgagtcagagaatgctacttccctcaccaccttctag

SEQ ID NO: 1212 - DNA, 1200 bp, Mus musculus
atgtctcaaaggcagtctcagtcacctaatcagactttaatttccattacaaatgacacagaaacatcaagctctgtcgtctccaacgatactacacataaaggatggaccggagacaactctccaggaatagaagcactgtgtgccatctatatcacttatgctgggatcatttcagtgggcatcctcggaaatgctatcctcatcaaagtctttttcaagactaaatccatgcaaacagttccaaatattttcatcaccagcctggctttcggagacctgttacttctgctgacttgtgtgcctgtggatgcaacccactacctggcagaaggatggctgtttggaaaggtcggttgtaaagtgctttccttcatccggctcacttctgtcggtgtgtcagtgttcacgctaacaattctcagcgctgacagatacaaagcagtcgtgaagccacttgagcgacagccccccaatgccattctgaagacctgtgcaaaagctggtggcatctggatcgtgtctatgatatttgctctgccagaggctatattctcaaatgtatacactttccaagatcctaacagaaatgtgacatttgaatcatgtaactcctaccctatctctgagaggcttttgcaagaaatacattctctgttgtgtttcttggtattctacattatcccgctctcgattatctctgtctattattctttgattgccaggactctttacaaaagcaccctgaacataccgactgaggaacaaagccatgcccgaaagcagattgaatcccggaagagaattgccaaaacagttttggtgctggtggctctgttcgcactctgctggttgccgaatcatctcctgtatctctaccactccttcacttatgaaagctatgcaaaccactctgatgtcccttttgttatcatcattttctctcgggtgctggctttcagtaattcctgcgtgaacccctttgctctctattggctgagcaagaccttccagcagcattttaaagctcagctctgctgcctcaaggcagagcagcctgagcctcctcttggtgacatcccccttaacaacctcactgtgatggggcgggtcccagctactgggagtgcacatgtctctgaaattagtgtgaccctgttcagtggcagtagtgccaagaagggagaggacaaagtttag

SEQ ID NO: 1213 - DNA, 1434 bp, Mus musculus
atggagtctttcgatgctgacaccaattcaactgacctacactcacggcctctgtttcaaccccaagacattgcctccatggtcattcttggtctcacttgtctattgggactgctaggcaatgggctggtgctgtgggtagctggcgtaaagatgaagacgaccgtgaacacagtctggttcctccatctcaccctggccgatttcctctgctgcctctccttgcccttctccttggctcacctgattctccaaggacactggccctatggcttgttcctgtgcaaacttatcccatccatcattattctcaacatgtttgccagtgtcttcctgcttactgccattagcctggaccgatgtctgatagtacataagccaatctggtgccagaatcatcgaaacgtgagaaccgccttcgccatctgtggatgtgtctgggtggtagcctttgtgatgtgtgtgcccgtatttgtataccgtgatctgttcattatggacaatcgcagtatatgtagatataattttgattcctccaggtcatatgattattgggactacgtgtacaaactaagtctaccagaaagcaattctactgataactccactgctcagctaactggacatatgaatgacaggtcagctccttcctctgtacaggcaagggattacttttggacagttaccactgccctccagtcacagccattcctaacatctcctgaagactcattctctctagattcagcaaaccaacaaccccattatggtggaaagcctcctaatgtcctcacagccgccgtacccagcgggtttcctgttgaagatcgtaaatccaatacactgaacgctgacgcttttctctctgctcacacagaacttttccctactgcttctagtggtcatttatacccctatgatttccagggggattatgttgaccaattcacgtatgacaatcatgtgccgacaccgctgatggcaataaccatcacaaggctggtggtgggcttcctggtgccgtttttcatcatggtaatttgttacagcctcatcgtcttcagaatgcgaaaaaccaacttcaccaagtctcggaacaaaacctttcgggtggctgtggctgtggtcactgtcttttttatctgctggactccataccatcttgtcggagtcctgctattgattactgatccagaaagttccttgggggaagctgtgatgtcctgggaccacatgtccattgctttagcatctgccaatagttgcttcaaccctttcctgtatgccctcttggggaaagactttaggaagaaagcaagacagtctataaagggcattctggaagcagccttcagcgaagagctcacgcactctaccaactgtacccaagacaaagcctcttcaaaaagaaacaatatgagtacagatgtgtga

SEQ ID NO: 1214 - DNA, 1056 bp, Mus musculus
atggaccccatagataacagcagctttgaaatcaactatgatcactatggaaccatggatcctaacatacctgcggatggcattcacctcccgaagcggcaacctggggatgttgcagcccttatcatctactcggtggtgttcctggtgggagtacccgggaatgccctggtggtgtgggtgacagccttcgagccagacgggccgtcaaacgccatctggtttctgaatctggcggtggccgacctcctctcgtgcttggccatgcctgtcctgttcacgaccgttttaaatcataactactggtactttgatgccaccgcctgtatagtcctgccctcgctcatcctgctcaacatgtacgccagtatcctgctgctggctaccattagtgccgaccgtttcctgctggtgttcaagcccatctggtgtcagaaggtccgcgggactggcctggcatggatggcctgtggagtggcctgggtcttagcattgctcctcaccattccatccttcgtgtaccgggaggcatataaggacttctactcagagcacactgtatgtggtattaactatggtgggggtagcttccccaaagagaaggctgtggccatcctgcggctgatggtgggttttgtgttgcctctgctcactctaaacatctgctacaccttcctcctgctccggacctggagtcgcaaggccacgcgctccaccaagacgctcaaagtggtgatggctgtggtcatctgtttctttatcttctggctgccctatcaggtgaccggggtgatgatagcgtggctgcccccgtcctcgcccaccttgaagagggtggagaagctgaactccctgtgcgtgtccctggcctacatcaactgctgtgttaaccctatcatctacgtcatggctggccagggtttccatggacgactcctaaggtctctccccagcatcatacgaaacgctctctctgaggattcagtgggcagggatagcaagactttcactccgtccacagacgacacctcaacccggaagagtcaggcggtgtag

SEQ ID NO: 1215 - DNA, 1548 bp, Mus musculus
atgaggttccttctcgtgaacaggttcaccctgctgctcctgctcctagtgagcccaactccagttcttcaggctcctaccaatctcactgactccggccttgatcaggagccattcctgtacttggttggccgcaagaagctgctggatgctcagtacaaatgctatgaccggattcatcagttgccctcttatgaaggagaaggtctgtactgcaaccgcacctgggatggctggatgtgctgggacgacactcccgctggagccacagcctatcagcactgccctgactacttcccggactttgacacagcagaaaaggtttcaaaatactgtgatgaaaatggagagtggtttagacaccctgacagcaaccgaacctggtccaactatactctgtgcaacgctttcacttctgagaaactgcaaaatgcgtacgttctttattacctggctcttgtgggtcactccttgtcgattgctgctttggttgcttccatgctgatcttctggattttcaagaaccttagctgccagagggtgaccttgcacaagcacatgttccttacttatattctgaattctatcattatcatcatccacctggttgaggttgtgcccaatggagatctggtgcggcgggatcctatgcatatttttcatcataacacacatatgtggacaatgcagtgggaactgtcaccacccttacccctgtgtgcacacgagggaaagatggaccctcatgccagtgaagtgataagttgcaaggttctacactttttacatcagtacatgatgtcttgcaactacttctggatgctctgcgaggggatctatcttcatactctgattgtcatggctgtgtttaccgacgagcaacgcctacgctggtactatcttcttggctgggggttcccgatagtgccaaccattatccacgccatcactcgtgccctctactacaacgacaactgctggctgagtgcagaaacccacttgctttacatcatccatggacccgtcatggtggctctggtggtcaacttcttctttcttctcaacattgtccgcgtgcttgtgaccaagatgaggcaaacccacgaggccgagtcctacatgtacctgaaggctgtgaaggccaccatggtccttgtgcccctgctggggatccagtttgttgtgtttccctggaggccctccaacaaggtgcttgggaagatctatgattatctcatgcactctctgattcatttccagggattctttgtggcgactatctactgcttctgcaaccatgaggtgcaagtcaccctgaagcgccagtggacgcagttcaagatccagtggagccaacgctggggaaggcgccgccccaccaaccgcgtagttagtgctcctcgggctgtagccttcgctgagccagatggcctccccatttacatctgccatcaggaaccacggaatcctccaatcagcaacaacgaaggcgaggagagtactgaaatgatccccatgaacgtcatccagcaagacgcatccgcttga

SEQ ID NO: 1216 - DNA, 1392 bp, Mus musculus
atggataaaaagcatatactatgttttctggttctcttgcctcttaatatggctctcatctcagcagagtcggaagaaggcgtgaaccaaacagacttgggagtcactagaaacaagatcatgacggctcaatatgaatgttaccagaagatcatgcaggaccccattcaacaagcagaaggcctttactgcaataggacctgggacggatggctatgctggaatgacgttgcagcagggacggaatcaatgcagtactgccctgactattttcaggattttgatccttcagagaaggttacaaagatctgtgaccaagatggacactggtttcggcatccggatagtaatagaacatggaccaactacaccctgtgtaataacagcacgcatgagaaagtgaagacagccctgaatctgttctacctaactataattggacatggattatctattgcatctctgatcatctctctcatcatatttttttacttcaagagcctaagttgccaacggatcacattgcataaaaacctgttcttttcatttatttgtaattcgattgtaacaatcatccacctcacggcagtggccaataaccaggccttagtggccacaaatcctgtgagctgcaaagtgtctcagtttatccatctctacctgatgggctgtaactacttctggatgctctgtgaaggcgtttacctgcacacactcatcgtggtggctgtgtttgcggagaagcagcacttgatgtggtattattttctcggctgggggtttcctctgcttcctgcctgcatccacgccattgccagaagcttgtattacaacgacaattgctggatcagctcagacactcatctcctctacattatccatggtccgatttgtgctgctttgttggtaaatctctttttcctattaaatattgtacgtgttctcatcaccaagttgaaagttacacaccaagtggaatccaatctctacatgaaagccgtaagagctactctcatcttggtaccactacttggcattgaatttgtgctttttccgtggcggcctgaaggaaaggttgcagaggaggtgtatgactatgtcatgcacattttgatgcactttcagggtcttttggtggctactattttctgcttctttaatggagaggttcaagcaattctgagaagaaattggaaccagtataaaatccaatttggaaatggcttttcccactctgatgctctccgcagtgcatcctacacagtgtcaacaatcagtgacatgcaagggtacagccatgactgccccactgaacacttaaatggaaaaagcatccaggatattgaaaatgttgccttaaaatcagaaaatacgtatgatctagtgatgtga

SEQ ID NO: 1217 - DNA, 4550 bp, Mus musculus
tacagccccgctgaagcaacgctggagtctagcagaacgcctaagagtgtttattatactgtgagttctggatctttactaggaaaaaagtgccccatcctctggcacagttgccttgtgatcctctttccatctccagggaggagcgggaagcgtgtgtgctgcggggaaggagggggttgtatcttcccagaccaacagcaggagcaggatcggaagcctgggatggctagagcctcatcgcacacaggaggactccagcgctagacctcggtctctcagaaaacatctcgggcagtctctacatgatgtcacttctcaggactcgaggaccaaccaccctacacctctgcatcggagaaggcagaaatggacacagaagggccatgacttctcttctgtcattaaccactctgtagacatgtatccccatcagaaggcgtgaaccacaccgagggctgtggagttctcgggcccccaaaccactaacacctttaactgtcccctggagagaaggcagagccatggcatggtttggctactgtttggccctcctggctctcacctggcactcctctgcctatgggcctgaccagcgagcccaaaagaagggggacattatcctaggaggtctctttcctatccattttggagtagcagccaaagatcaagatctgaagtcaagaccagagtctgtggagtgcatcaggtataacttccgtggattccgatggttacaagccatgatctttgccatagaggagataaacagcagccccgcccttcttcccaacatgactctgggatataggatattcgacacctgtaacaccgtctccaaggctctggaggccaccttgagttttgttgcccagaacaaaatcgattctctgaacctggatgagttctgcaactgctccgagcacatcccttcaaccatcgcagtggtgggagcaaccggctccggtgtctccacagcggtagccaacctgctgggacttttctatatcccccaggtgagctacgcctcctctagcaggcttctcagcaataagaaccagttcaagtccttcctccgcaccattcccaacgacgaacaccaggccaccgcgatggctgacattatcgagtatttccgttggaactgggtgggcacaattgcagccgacgacgactatggcaggcctggcattgagaagttccgagaggaagccgaggagagggacatctgcattgacttcagcgagctcatctcccagtactctgatgaggaagagatccagcaggtggtggaagtgatccagaactctacagccaaggtcattgtcgttttctccagcggcccagacctagaacctctcatcaaggagattgtgcgccgtaacatcacaggcaggatctggctggccagcgaggcctgggccagttcctccctgattgctatgcctgagtacttccatgtagtcgggggtaccattgggttcggtctgaaggctgggcagattccaggcttccgagaattcctacagaaagtccatcccaggaagtctgtccacaatggttttgccaaagagttttgggaagaaacatttaattgccacctgcaagacggcgcaaaaggacctttacccgtggacaccttcgtgagaagtcacgaggaaggcggcaacaggttactcaatagctccactgccttccgacccctctgcacgggggatgaaaacatcaatagtgtcgagaccccttacatgggctacgaacatttacggatatcctacaacgtgtacttagccgtctactccattgcgcacgccctgcaagatatatacacctgcttacccggaagagggcttttcaccaacgggtcctgtgcagacatcaagaaggttgaggcctggcaggtcctgaaacacctacggcacctgaatttcaccaacaacatgggggagcaggtgaccttcgatgagtgcggtgacctggtggggaactactccatcatcaactggcacctctccccagaggacggctccattgtgttcaaggaagttgggtactacaatgtgtatgccaagaagggagaaagactgttcatcaatgaggggaagatcttgtggagtgggttctccagagaggtgcccttctccaactgcagccgggactgtcaggcagggaccaggaagggcatcattgagggagagcccacctgctgttttgagtgtgtggagtgtcctgacggcgagtacagtggtgagacagatgcgagtgcctgtgacaagtgcccggatgacttctggtccaatgagaactacacttcctgcattgccaaggagattgagttcctggcgtggactgagccctttggaatcgctctcactctctttgcggtgctgggcattttcctgaccgcctttgtgctgggcgtcttcatcaagttccgaaacacgcccattgtcaaggccaccaaccgagagctgtcctacctcctgctcttctcactcctctgctgcttctccagctccctgttcttcattggggagccccaggactggacctgccgcctgcgacagcccgccttcggcatcagcttcgtgctttgtatctcgtgcatcttggtgaagaccaatcgagtcctcctggtatttgaggccaaaatacccaccagcttccaccggaagtggtggggactcaacctgcagttcctgctggttttcctctgcaccttcatgcagattgtcatctgcatcatctggctctacacggcacccccctccagctaccgcaaccacgagctggaagacgaaatcatcttcatcacgtgccatgagggctcactcatggcgctcggctccctgatcggctacacctgcctcctggctgccatctgcttcttctttgccttcaagtctcggaagctgccagagaacttcaacgaagccaagttcattaccttcagcatgctcatcttcttcatcgtctggatctccttcattccagcctatgccagcacctacggcaagtttgtctctgccgtggaggtgatcgccatcctggcagccagctttggcttgctagcctgcatcttcttcaacaaggtctacatcatcctcttcaagccttcacggaacaccatcgaggaggtgcgctccagcactgcggctcatgctttcaaagtggcagcccgcgccactctacgccgccccaacatctcccggaagcggtccagcagcctcggaggctccactgggtccaatccctcctcctccatcagcagcaaaagcaacagcgaagaccggttcccacagccggagaggcagaagcaacagcaaccactggccctgacccagcaagaacagcagcagcagcccctgactctccagccgcagcaacagcaacagccacagcagccgagatgcaaacagaaggtcatcttcggcagtggcacagtcaccttctctctgagctttgatgagcctcagaagaatgctatggcccacaggaactccatgcgccagaactccctggaggcccagaagagcaatgacactttgaacagacaccaggccctgcttcccctacagtgtgcagaggcggactcagaaatgaccattcaggagacgggcttgcaagggccaatggtgggggaccaccagccagaaatagaaagcccagatgaaatgtccccagctctggtcgtgtccacctctcggagcttcgtcatcagcggtggaggtagctctgtgacggaaaacatactgcactcctaatggagggagaggttacccggttgagagtttttcttagagtcccaggaaaaaggatgggtcttcccaggaagccagggatagtgggtgcatcaaagcctgtactcggctgcactgctttgaatgacagtgaactgactggtgggctctttacaagttagaagagccatgttttggggatcgttttccagagctcagtgtcatacctggatttgctgaaatcttttcctctgctccatccaccaccagctcggatgaaagcaaggctataagctacccacctgcttccctctaaaaacgcttatatccagaaatccctaccccgaggcacagtccagatacagatggatgggacatcagatctgccaccattaaagttgagtctaaaagccagatagtcaccaggactgtctatcacattgacagtggacagaactgtacatttgcaagacatcaggcagacatgtcctctcctatttataaagaccttaagaagtgtggcctttttatcctccctgttgctgctactgtgtaacatctgttccatctgcatccttcctgtgacgtcatgcatggatgtatccagaacctgaaggcaatgccacatttagatcttaggatcataagtatcacctccaagcaccgggaaaggactgactcaacccaacgagctgtctctgtagctaatatcaatgtacatagcgtaatccttaagaaactgcttctgttgtaatagtccatgggcgattataaactgaaaaatgtcgcagtctaaaaaaaaaaaaaaaa

SEQ ID NO: 1218 - DNA, 1137 bp, Mus musculus
atgcccaccgttgcttccccactgcctctcaccaccgtcggttccgagaacagcagctccatctacgactacgactacttagatgatatgaccatcttggtttgcaggaaggacgaggtcctgtcctttggaagagtctttctgccggtcgtctacagcctgatcttcgtgctgggcttggctggaaacctcctcctcctggtggtgttgctccactctgcacctcgaagacggacgatggagctttacctgctgaacctggccgtctccaacctcttgtttgtagtgactatgcccttctgggccatctctgtggcctggcattgggtttttggtagtttcctgtgcaaggtgataagcactctctactctattaacttttactgtggtatcttcttcatcacctgcatgagcctggacaaatacctggagattgtccacgctcagcctctccacagaccgaaggcccagttcaggaacctgcttctcattgtcatggtgtggatcacatccctggccatctctgtcccagaaatggtctttgtgcagatccaccagaccttagatggtgtgtggcactgctatgcggattttggcggacatgcgaccatttggaagctgtacctgcgcttccagctgaaccttctggggtttctcctcccactcttggccatgatcttcttttactcccgcatcggttgcgttctggtcaggctgaggccgccaggccagggccgggctctgaggatggccgcggccctggtgatagttttcttcatgctgtggttcccatattacctcaccttgtttctgcactcgttgctggacctgcatgtctttgggaactgtgagatcagccaccgtctggactatacgttgcaggtgacagagagcctggccttctcccactgctgcttcaccccggtcctctacgccttctgcagtcaccgcttccgccggtacctgaaggcatttctgtctgtgatgttgagatggcaccaggcacctggcaccccttcctctaaccattctgagagcagcagggttactgcccaggaagacgtggtcagcatgaatgaccttggggagaggcagtctgaggactcccttaacaagggggagatggggaatacttag

SEQ ID NO: 1219 - DNA, 1311 bp, Mus musculus
atggatgtggtcgacagccttcttatgaatgggagcaacatcactcccccctgtgaactcgggctggaaaatgagacgcttttctgcctggatcaacctcagccttcaaaagaatggcagtctgcagtgcagattctcctgtactccttcatattccttctcagtgtgctggggaacacgctggttatcacggtgctgattcgaaacaagaggatgcggactgtcaccaacatcttcctgctgtccctggctgtcagtgacctcatgctttgcctcttctgcatgccgttcaacctcatccccaacctgctcaaggatttcatcttcggaagtgccgtgtgcaagactaccacctacttcatgggcacttccgtgagtgtttccaccttcaacctggtagccatctctctggagagatacggtgccatctgcagacccctacaatcccgcgtctggcaaacaaagtcccatgctttgaaggtcatcgctgccacctggtgcctctcctttaccatcatgactccgtaccccatttacagcaacttggtgccttttactaaaaacaataaccagacggcgaacatgtgccgcttcctgttgccaagtgacgctatgcagcagtcctggcaaacattcctgctactcatcctcttccttatccctggggttgtgatggtggtggcttacggactcatctctctggaactctaccaaggaatcaaatttgatgccagccagaagaaatctgctaaagagaagaggctaagcagcggcggcggcggcggcggcggtagcagcagcagccgatatgaggatagcgatggctgttacttgcagaaatccaggcctccaaggaagctagagctgcagcagctgtcaaccagcagcagtggtggcagaatcaaccggatcaggagcagtggttctgctgccaacctgatcgccaagaagcgcgtgatccgcatgctcattgtcattgtggtcctcttcttcctgtgctggatgcccatcttcagtgccaatgcctggcgggcatatgacacggtttctgccgagaaacacctctcagggacccccatctccttcatcctcctcctctcctacacctcctcctgtgtcaaccccattatctactgcttcatgaacaaacgctttcgcctgggcttcatggccaccttcccctgttgcccgaatcctggtcccaccggggtgagaggagaagtgggagaggaggaagatggaaggaccataagggcatccctgtcccggtattcctacagccacatgagcacctctgccccaccccactga

SEQ ID NO: 1220 - DNA, 1362 bp, Mus musculus
atggatctgctcaagctgaaccgcagcttgcagggaccaggacccgggtcagggtcttctttgtgccgcccgggtgtctccctcctcaacagcagtagcgccggcaacctcagctgcgagacccctcgtatccgcggaaccgggaccagagaattggagttgaccattcgaatcaccctttatgcggtgatctttctgatgagtgttggcggaaacgtgctcatcattgtggtcctgggactgagccgacgcctaagaacggtcaccaacgccttcctactctccctggcagtcagcgacctcctgctggctgtcgcttgcatgcccttcacactcctgcccaacctcatgggcacattcatcttcggcacagtcatctgcaaggccgtttcctacctcatgggggtatcagtgagtgtgtccactctaaatctcgcggccatcgccctggagcgatacagcgccatctgccgaccactgcaagcacgagtgtggcagacacgctcccacgcagctcgggtgatcttagccacgtggctgctgtctggattgcttatggtcccctaccccgtgtacaccgtggtgcagccagtggggcctcgaatactgcagtgcatgcatctctggcccagtgaacgtgtccaacaaatgtggtccgtgcttctgctaatactgctgttcttcatcccgggcgtggttatggcggtggcctatggactcatctcccgcgaactctacctagggctccgctttgatggtgataatgacagcgagacccaaagccgggtccgaaaccaagggggtctgccgggtggggcagcagcaccagggcctgtccaccagaacgggggttgccggcatgtgaccagcctgactggggaagacagtgatggctgctacgtgcaacttccgcgttcccgactggagatgacaacgctgaccacgcccactactgggccaggccctggccctcggcccaaccaggccaagctgctggctaagaagcgggtggtgcgaatgctgctggtgattgttttgctttttttcgtgtgttggctgccagtgtacagcgccaacacgtggcgtgccttcgatggcccaggcgcgcgccgagcactcgcaggggcccctatctctttcatccacttgctgagctacacctctgcttgtgccaaccccctggtctactgtttcatgcaccgccgattccgccaggcctgcctggacacatgtgcccgctgttgcccacgccctccacgagctcgcccacggcctcttccggatgaggatcctcctaccccctccatcgcttctctgtccaggctaagctataccaccatcagcacgctgggacctggctga

SEQ ID NO: 1221 - DNA, 1071 bp, Mus musculus
atggagatttcagatttcacagaagcctaccccacaactacagaatttgactatggggactccactccatgccaaaagactgctgtaagagcctttggggctggactcctgccccccctgtattctctagtgttcatcattggagtggtgggcaatgtcctagtgattctggtgctcatgcagcataggaggcttcaaagcatgaccagcatctacctgttcaacctggctgtctctgatctggtcttccttttcactttacctttctggattgactacaagttgaaagacgactggatttttggtgatgccatgtgcaagcttctctctgggttttattacctgggcttatacagtgagatcttctttatcatcctgttgacgattgacagatacctggccattgtccatgctgtgtttgccctgagggcccgaactgttactcttggcatcatcaccagtattatcacctgggccctagccatcttagcttccatgcctgccttatacttttttaaggcccagtgggagttcactcaccgtacctgtagccctcatttcccctacaagagcctgaagcagtggaagaggtttcaagctctaaagctaaaccttcttggactaattttgcctctgttagtcatgataatctgctatgcagggatcatcagaattctgctcagaagacccagtgagaagaaggtcaaagccgtgcgtctgatatttgctattactcttctattcttcctcctctggaccccctacaatctgagtgtatttgtttctgctttccaagatgttctattcaccaatcagtgtgagcagagtaaacatctggacctggccatgcaggtgactgaggtgattgcctacacccactgctgtgtcaacccaatcatttatgtttttgtgggtgaacggttctggaagtaccttcggcagctgtttcaaaggcatgtggctataccactggcaaaatggctgcccttcctctctgtggaccaactagaaaggaccagttctatatctccatccacaggagaacatgagctctctgctggcttctgaccr

SEQ ID NO: 1222 - DNA, 1122 bp, Mus musculus
atggaagacaataatatgttacctcagttcatccacggcatactatcaacatctcattctctatttacacgaagtatccaagagcttgatgaaggggccaccacaccgtatgaccacgatgatggtgagccttgtcataaaaccagtgtgaagcaaattggagcttggatcctgcctccactctactccctggtattcatctttggttttgtgggcaacatgttggtcattataattctgataggctgtaaaaagctgaagagcatgactgatatctatctgctcaacttggccatctctgacctgctcttcctgctcacattaccattctgggctcactatgctgcaaatgagtgggtctttgggaatataatgtgtaaagtattcacagggctctatcacattggttattttggtggaatctttttcattatcctcctgacaattgataggtacttggctattgttcatgctgtgtttgctttaaaagccaggacagttacctttggggtgataacaagtgtagtcacttgggtggtggctgtgtttggctctctaccaggaatcatatttactaaatccaaacaagatgatcaccattacacctgtggcccttattttacacaactatggaagaatttccaaacaataatgagaaatatcttgagcctgatcctgcctctacttgtcatggtcatctgctactcaggaattctccacaccctgtttcgctgtaggaatgagaagaagaggcacagggctgtgaggctcatctttgccatcatgattggctactttctcttctggactccatacaatattgttctcttcttgaccaccttccaggaatccttgggaatgagtaactgtgtgattgacaagcacttagaccaggccatgcaggtgacagagactcttggaatgacacactgctgcattaatcctgtcatttatgcctttgttggagagaagttccgaaggtatctctccatatttttcagaaagcacattgctaaacgtctctgcaaacagtgcccagttttctatagggagacagcagatcgagtgagctctacattcactccttccactggggagcaagaggtctcggttgggttgtaa

SEQ ID NO: 1223 - DNA, 1080 bp, Mus musculus
atggcattcaacacagatgaaatcaagactgtggttgaaagctttgagaccacaccctatgaatatgagtgggcaccaccctgtgaaaaagtcagaatcaaagagctggggtcatggctcctgcctccactgtactccctggtgttcatcatcggcctcctgggcaacatgatggttgtgttgatcctcataaagtacaggaagctacaaattatgactaatatctacctgttcaacttggcaatttctgacctgctctttctcttcactgtcccattctggattcactatgttctgtggaatgagtggggttttggccactacatgtgcaaaatgctgtctgggttttattacctggccttgtacagcgagatctttttcatcatcctgctgacaattgacagatacctggctatcgtccatgctgtgtttgcccttcgagcccgaactgtgacttttgctactatcaccagtatcattacctggggccttgcaggactggcagcattgcctgaatttatcttccatgagtctcaagacagctttggagagttttcctgcagtcctcgctatccagaaggtgaagaagacagctggaaacgtttccatgctctaagaatgaatatctttggtctagctcttcctctcctcgttatggttatctgctactcaggaatcattaaaactctgctgagatgtcccaataaaaaaaaacacaaggccatccgtcttatttttgttgttatgatagtcttttttattttttggaccccgtacaacctggttctccttttttctgcttttcacagcacgtttttagagaccagctgtgagcagagtaaacatctggacctggccatgcaggtgactgaggtgattgcctacacccactgctgtgtcaacccagtaatctacgcctttgttggtgagaggttccggaaacaccttcggctctttttccacagaaatgtggcagtttacctgggaaaatatattccatttcttcctggtgagaaaatggaaagaacaagctctgtctccccatcaactggggagcaagaaatctctgtggtgttttag

SEQ ID NO: 1224 - DNA, 1531 bp, Mus musculus
cgctgcctgctggtacccggagcgcgacggcattgcttcatagactgtcctcaggatcactttcagaagagcaaggcagctcaactgttctcattggcttctcctgctggtacccggagcgcgacgattccaaagatgaatgccacagaggtcacagacaccacccaggatgaaactgtgtacaatagttattacttctacgaaagcatgccaaagccttgcaccaaggaaggtatcaaggcatttggggaggtcttcctgcctcctctctactccttggtcttcttgttgggtctgtttggaaattctgttgtggttctggtcctgttcaaatacaagaggctcaagtccatgacggacgtgtacctgctgaacctggccatctcggatttgctgttcgtcctgtccctcccattctggggctactacgccgccgaccagtgggtttttggactaggtctgtgcaagatcgtttcatggatgtacctggtgggcttctacagcggcatcttcttcatcatgctcatgagcatagacagatacctggccatcgtgcacgcggtattctccttgaaggcaaggaccctgacctatggggtcatcaccagcctgatcacgtggtcagtggctgtgtttgcctccctcccaggcctcttgttcagcacttgctacacagagcacaaccacacgtactgcaaaacccagtactcggtcaactcgacgacgtggaaagtcctcagctccctggagatcaacgtcctggggctgcttatccccctgggcatcatgctgttttggtattccatgatcattaggactctgcaacactgcaagaatgagaagaagaacagagcagtgcgcatgatcttcggcgtggtggtcctcttcctcggcttctggacgccgtacaacgtggtgcttttcctggagacgctggtggagcttgaagtccttcaggactgcaccttggagaggtacctagactacgccatccaggctacagaaaccctgggcttcattcactgctgccttaaccccgtcatttacttctttctcggggagaaattccgcaagtacatcacccaactcttcagaacatgccggggtcccctcgtgctctgcaaacactgtgacttcctccaggtctactcggctgacatgtccagctcctcttacacgcagtccactgtggatcatgacttccgtgacgctttgtaaggtgtgagtgggggtaacatggcgttaacaagctccacacacccagcacctgctcgccttgtttcagtcagggtgccctgaacagggctctgaggaagaaaacaagtaaaaccaagaccatggcaagatggcttctcaccctgcaggtggctcccaagaggttcagagccctgctgggtggaggaaatcaccccttcatgacaatgagcccttgagtggatctctagtttggttgaactacctagaattcttggacatgctgtattccataaagccagatgtctggagaaaaaaaaaaaaaaaaaaaaaaaaa

SEQ ID NO: 1225 - DNA, 1065 bp, Mus musculus
atggattttcaagggtcagttccgacctatatctatgacatcgattatggtatgtcagcaccctgccaaaaaatcaatgtgaaacaaattgcagctcagctcctgcccccactctactccctggtattcatctttggttttgtgggtaacatgatggtcttcctcatcttgataagctgcaaaaagctgaagagcgtgactgatatctatctgctcaacttggccatctctgacctgctcttcctgctcacactaccattctgggctcactatgctgcaaatgagtggatctttgggaatataatgtgtaaagtattcacaggtgtctatcatattggttattttggtggaatcttcttcattatcctcctgacaattgataggtacttggctattgtccatgctgtgtttgctttaaaagtcagaacggtcatctttggggtgataacaagtgtagtcacttgggtggtggctgtgtttgcctctctcccagaaataatctttaccagatctcagaaagaaggttttcattatacatgcagtcctcattttccacacactcagtatcatttctggaagagtttccaaacattaaagatggtcatcttgagcctgatcctgcctctacttgtcatgatcatctgctactcaggaattctccacaccctgtttcgctgtaggaatgagaagaagaggcacagggctgtgaggctcatctttgccatcatgattgtctactttctcttctggactccctacaacattgtcctcctcctgaccaccttccaggaattctttggactgaataactgcagtagttctaatagactagaccaggccatgcaggcaacagagactcttggaatgacacactgctgcctaaaccctgtcatctatgcctttgttggagagaagttccggagttatctctcagtgttcttccgaaaacacattgtcaaacgcttttgcaaacggtgttcaattttccagcaagacaatcctgatcgtgtaagctcagtctatacccgatccacaggagaacatgaagtttctactggtttatga

SEQ ID NO: 1226 - DNA, 1104 bp, Mus musculus
atgaattccacagagtcctactttggaacggatgattatgacaacacagagtattattctattcctccagaccatgggccatgctccctagaagaggtcagaaacttcaccaaggtatttgtgccaattgcctactccttaatatgtgtctttggcctcctgggcaacattatggtggtgatgacctttgccttctacaagaaagccagatccatgactgacgtctacctgttgaacatggccatcacagacatactctttgtcctcaccctaccgttctgggcagttactcatgccaccaacacttgggttttcagcgatgcactgtgtaaactgatgaaaggcacatatgcggtcaactttaactgtgggatgctgctcctggcctgtatcagcatggaccggtacattgccatcgtccaggcaaccaaatctttccgggtacgctccagaacactgacgcacagtaaggtcatctgtgtggcagtgtggttcatctccatcatcatctcaagccctacatttatcttcaacaagaaatacgagctgcaggatcgtgatgtctgtgagccacggtacaggtctgtctcagagcccatcacgtggaagctgctgggtatgggactggagctgttctttgggttcttcacccctttgctgtttatggtgttctgctatctgttcattatcaagaccttggtgcaggcccagaactccaagaggcacagagccatccgagtcgtgatcgctgtggttctcgtgttcctggcttgtcagatccctcacaacatggtcctcctcgtgactgcggtcaacacgggcaaagtgggccggagctgcagcaccgagaaagtcctcgcctacaccaggaacgtggccgaggtcctggctttcctgcattgctgcctcaaccccgtgttgtatgcgtttattggacagaaattcagaaactacttcatgaagatcatgaaggatgtgtggtgtatgagaaggaagaataagatgcctggcttcctctgtgcccgggtttactcggaaagctacatctccaggcagaccagtgagaccgtcgaaaatgataatgcatcgtcctttaccatgtaa

SEQ ID NO: 1227 - DNA, 1137 bp, Mus musculus
atggacccagggaaacccaggaaaaacgtgctggtggtggctctccttgtcattttccaggtgtgcttctgccaagatgaggtcaccgatgactacatcggcgagaataccacggtggactacaccctgtacgagtcggtgtgcttcaagaaggatgtgcggaactttaaggcctggttcctgcctctcatgtattctgtcatctgcttcgtgggcctgctcggcaacgggctggtgatactgacgtacatctatttcaagaggctcaagaccatgacggatacctacctgctcaacctggccgtggcagacatccttttcctcctaattcttcccttctgggcctacagcgaagccaagtcctggatctttggcgtctacctgtgtaagggcatctttggcatctataagttaagcttcttcagcgggatgctgctgctcctatgcatcagcattgaccgctacgtagccatcgtccaggccgtgtcgcgtcatcgccaccgcgcccgcgtgcttctcatcagcaagctgtcctgtgtgggcatctggatgctggccctcttcctctccatcccggagctgctctacagcggcctccagaagaacagcggcgaggacacgctgagatgctcactggtcagtgcccaagtggaggccttgatcaccatccaagtggcccagatggtttttgggttcctagtgcctatgctggctatgagtttctgctacctcattatcatccgtaccttgctccaggcacgcaactttgagcggaacaaggccatcaaggtgatcattgccgtggtggtagtcttcatagtcttccagctgccctacaatggggtggtcctggctcagacggtggccaacttcaacatcaccaatagcagctgcgaaaccagcaagcagctcaacattgcctatgacgtcacctacagcctggcctccgtccgctgctgcgtcaaccctttcttgtatgccttcatcggcgtcaagttccgcagcgacctcttcaagctcttcaaggacttgggctgcctcagccaggaacggctccggcactggtcttcctgccggcatgtacggaacgcgtcggtgagcatggaggcggagaccaccacaaccttctccccgtag

SEQ ID NO: 1228 - DNA, 1062 bp, Mus musculus
atggattacacgatggagcccaacgtcacgatgaccgactactaccctgatttcttcaccgccccctgtgacgcagagttcctcctcaggggcagcatgctgtatctggccatcttgtactgcgtcttgtttgtgctgggccttctggggaacagcctggtcatcttagtcctcgtgggctgcaagaaactgaggagcatcacagatatctacctcctgaacctggccgcatccgacctgctctttgtcctctctattccttttcagacccacaacctgctggaccagtgggtgtttgggactgcgatgtgtaaggtggtctctggcctttattacattggttttttcagcagtatgttcttcatcaccctaatgagtgtggacaggtatctggctattgtccacgctgtctatgccatcaaggtgaggacggccagcgtgggcacagccctgagtctgacagtgtggctggctgctgtcacagccaccatccccttgatggttttttaccaagtggcctctgaagacggcatgctacaatgtttccagttttatgaagagcagtctttgaggtggaagctctttacccactttgaaatcaacgccttgggtctgctgctcccctttgccatcctcctgttctgctatgtcaggatcctgcagcagctgcggggctgcctgaaccacaacaggaccagagccatcaagctggtgctcaccgtagtcattgtgtctttactcttctgggtcccattcaacgtggcccttttcctcacgtccctgcacgacctgcacatcttggatggatgtgccacgaggcagaggctggctctggccatccatgtcacagaggtcatctcttttacccactgctgcgtgaaccccgtcatctacgcgttcataggagagaagtttaagaaacacctcatggatgtgtttcaaaagagctgcagccacatcttcctctacttagggagacaaatgcccgtgggggcgttggaaaggcagctgtcctcgaaccagcgatcttcccattcttccaccctggatgacatcttgtaa

SEQ ID NO: 1229 - DNA, 1110 bp, Mus musculus
atgatgcccacagaactcacaagccttattcctggcatgtttgatgacttcagctatgactccactgcttccacagatgactacatgaatttgaatttcagtagcttcttctgtaagaaaaataatgtcaggcagtttgcaagccattttcttccacctctgtactggcttgtgttcattgtgggcaccttgggcaacagcctggtcatccttgtctactggtattgcacaagagtgaagaccatgactgacatgttccttttgaatttagccattgctgatctgctctttcttgccactcttcccttctgggccattgctgctgctggtcaatggatgttccagaccttcatgtgcaaggttgtgaacagcatgtacaagatgaacttctacagctgtgtgcttctcatcatgtgcatcagtgtggacagatacattgccattgtacaggccatgaaggctcaggtctggaggcagaaaaggctgctatacagcaagatggtctgcattaccatctgggtgatggcagctgtgctctgcaccccagaaatcctgtacagtcaagtcagtggggaatctggtattgccacatgcaccatggtctaccctaaggataagaatgccaagctaaagtcagctgtcttgatcctgaaggtcaccttggggtttttcctcccctttatggtcatggccttctgctataccatcatcattcataccttggtacaggccaagaagtcatccaagcacaaggccctcaaggtgaccatcactgtcctcactgtcttcattatgtctcagttcccctacaactccattcttgtagtgcaggctgttgacgcttatgccatgttcatctccaactgcactatttccaccaatattgacatctgcttccaggttactcagactattgcattcttccacagttgtctgaacccagttctctatgtttttgttggcgagagattccgaagggatctggtgaagaccctgaagaacctgggatgcattagccaggcccagtgggtttcattcacaaggagagagggtagcttgaagctttcttctatgctactggagacaacttcgggggctctctccctatga

SEQ ID NO: 1230 - DNA, 1050 bp, Mus musculus
atggctctggagctgaaccagtcagcggaatactattatgaggagaatgagatgaactacactcacgactacagccagtacgaagtgatctgcataaaagaagaggtcaggcagttcgcaaaagtcttcctgcctgccttcttcacagtggcctttgtcactgggctcgcagggaactccgtagttgtggcgatttacgcctattacaagaagcagaggaccaagaccgatgtgtacatcctgaacctggctgtagcagacttgttacttctgatcacgctgcctttctgggcagttaatgcagttcacggatggattctaggcaaaatgatgtgcaaagtaacgtcagccctgtacacggtaaactttgtctctgggatgcagttcctggcttgtatcagcattgacagatattgggcaattaccaaagcccccagccaatcaggagcggggagaccctgttggatcatctgttgctgtgtgtggatggccgccatcttgctgagcataccccagctggttttttacacagtgaatcagaatgctaggtgcactcccatctttccccaccacctaggaacatccctgaaagcatccattcagatgctggaaatcggcatcggctttgtggtcccgtttctcatcatgggcgtgtgctatgccagtaccgccagggcgctcatcaagatgcccaacattaaaaagtctcgccccctcagggttctgctcgcggtggtggtggttttcattgtcacccagctgccctataacgttgttaagttctgccaagccatagatgccatctacctgctgatcaccagctgcgatatgagcaaacgcatggatgtcgccatccaagtcacagagagcatcgcgctcttccacagctgcctcaaccccatcctgtatgtcttcatgggggcctccttcaaaaactatatcatgaaagtggccaagaaatatggatcctggagaagacagagacagaacgtggaagaaattccttttgattctgagggtcctacagagccaaccagttcttttaccatt

SEQ ID NO: 1231 - DNA, 969 bp, Mus musculus
atggagtcctctacagccttttatgattatcatgataaattgagtcttctatgtgagaacaatgtcatcttcttttccaccatctctaccattgtcctgtactctctggtatttctcctcagccttgtgggtaacagcctggttttgtgggtcttggtgaagtatgagaatctagagtcactcaccaatatcttcatcctcaacctgtgtctctcagacctgatgttctcctgtctactgcctgtgttgatctcagcacaatggagttggtttctaggtgacttcttctgcaagttcttcaacatgatcttcggcatcagcctctacagcagcatcttcttccttaccatcatgaccatccaccgatacctgtctgtagtgagccccatctctactctgggtatccataccctccgctgccgtgtgctggtgacatcatgtgtgtgggcagccagcatcctgttctccatccctgatgctgtcttccacaaagtgatctccttaaattgtaaatattctgaacatcatgggttcttggcctcagtctaccagcacaacatcttcttcctcctctccatgggaatcatcctattctgttatgtacagattctcaggactttgtttcgcacaaggtccagacagagacaccgaacagtcaggctcatcttcaccgtcgtggtagcatacttcctcagctgggctccctacaacctcacactcttcctgaaaactggaatcatccagcagagctgtgagagccttcagcaactggacattgctatgattatctgtcgccatttggccttctctcattgctgtttcaacccagtgctttatgtctttgttgggatcaagttccgcagacacctaaaacatctcttccagcaggtctggctgtgccggaagacatccagcactgttccctgctcccctggtacctttacatatgagggaccctccttctactga

SEQ ID NO: 1232 - DNA, 2457 bp, Mus musculus
atgaggagcgtcagatgccccggcctgcttgtggtgtgcattttactgagtctctcaggagctggaacccagaaggcagagattaagaactgtgccaagtggtgccctatcaactcaaaatgtgtcagtaacagaagctgtgtctgcaagcccggcttcagctcggagaaggaattgatcactaaccctgcagagagctgtgaagacatcaacgagtgtttactacctggattttcctgtggagactttgccatgtgtaagaactcagaggggagttatacctgcgtctgtaacctgggatataagctcctttctggtgcagaatcttttgttaacgagagtgagaatacatgtcaagcatcagtgaacactgggacgacacctgtgccctccaggatccacacagttactactgcgcctggaaatctccccgagcagacaactacagtgcaccagacacagatgggagactcagaagagaggacacccaaggatgtgaatgagtgcatctccgggcaaaaccattgccaccaatccacccactgcatcaacaaattgggcggctattcttgcatctgtcgtcaaggctggaaacctgttcctggatcccccaatggccctgtcagcacagtgtgcgaagatgtggatgagtgcagctctgggcagcatcaatgtcacaattccaccgtctgcaaaaacaccgtaggctcctacaagtgccactgccgtccaggttggaagccaacttctgggtccctccgtggtccagacaccatatgccaagagccaccgttccctacttggacactgctgcccacagcccacagtcagactctcttgagattctctgttgaagtccagaatctgctccgagacttcaatccagccacggtcaactacaccatccagaaactcatcgaggctgtggacaagctgctggaagaccccatggagactcaaacccaacaagtagctgcccagttgctctcgaacctggaacaaagccttcggaccttggcccagttcttacccaaaggccccttcacctacacgtccccttcaaatactgaactgtccctgatggtgaaggagcaagacaacaaagatgttaccacagtgcaccacggccaaacttggatggagctggactgggctgtgacagctggagccaaaatctcagaaaatggctcctcggtggcaggcatcctgtccagcccaaacatggaaaagctgctgggcaacaccccgctgaacttggagcagagaagggcctccttggaggacttctatggaagcccgattccgagcgtctcacttaaacttctctcaaacatcaattctgtcttcctgaccaacacgaacactgagaagcttgcctcgaatgtcacgttcaagttcgactttacttctgtggagtcaattgagccacgtcacgagctgatatgtgccttctggaaagcccacaacgggaatgggtactgggacaccgacggctgctcaatgaatggcactggcttctgccactgcaaccacctgaccagctttgccatcctaatggctcagtaccatgtgcaggacccaaggctggaattgatcaccaaggtggggctgttgttgtccctgatctgcctgctgctgtgcatcctgaccttcctgctggtgaagcccatccagagctctcgaaccatggtgcacctgcacctgtgcatctgcctcttcctgggctcaatcatattcctggtcggcgtggagaatgaagggggtgaggtgggcctgcgctgccgcctggtggccatgatgctgcatttctgcttcctggccgccttctgctggatggcactggagggcgtggagctctacttcctggtggtgcgtgtgttccagggccaaggcctgagtacatggcaacgctgcctgattggctacggggtgcccctcctcatcgtggccatctcaatggcagttgtcaaaatggatggctatgggcatgcaacatactgctggctggactttaggaagcagggctttctctggagcttttcgggacccgtggccttcatcattttctgcaatgctgccattttcgtgatcactgtctggaagctcacaaagaagttttctgaaatcaacccaaacatgaagaagttaaggaaggcgagggtgctgaccatcaccgccatcgcccagctccttgtgctgggttgcacctggggcttcggcctgttcctcttcaacccccatagcacatggctatcctacatctttaccctgctcaactgcctgcagggcctattcctctatgtgatgctctgcctgctcaacaaaaaggtgagggaagagtactggaaatgggcctgcatggtcactgggagcaagtacacagagttcaactcttccacaacaggcactggcaccagccaaacacgggctctcaggtcctcagaatcagggatgtga

SEQ ID NO: 1233 - DNA, 9105 bp, Mus musculus
atggcgccgtcatcgccgcgcgtgctgcccgcgctggtgttgctggccgccgccgccctgccagccctggagttgggagcagccgcttgggagctgcgggtgcctggcggggcccgcgccttcgctctcggaccgggctggagctacaggttggacaccacgcgcacgcctcgggagctgctggacgtgagccgcgaggggccagcagcgggtcggaggcttgggcttggcgcggggactctgggctgtgcccgcttggccgggaggctgctgccgctgcaggtccggctggtcgcccgcggcgccccgacggccccgagcttggtactaagggcacgcgcctatggtgcccgctgtggggtccggctgttgcgccgctcggcccgcggtgcagagctgcgctctccggccgtccgctcagttcctggacttggagatgcgctctgcttcccggccgcaggcggcggcgcagcctcgctgacttcggtgcttgaggccatcaccaacttccccgcctgcagctgcccgccggtcgccgggaccggctgcaggcgcggacccatttgcctgcggccaggaggttcagctgagctgcgtctggtgtgcgccctgggacgcgcggcaggcgccgtttgggtagagctggtaatacaggcgacctctgggacgccctcagagtcgccctcggtgtcgccatcgttgcttaacctgtcccaacctcgggcgggggtggtgcgacggtctaggcggggcacgggcagcagcacgagcccgcagttcccgctgcccagctaccaggtgtcagtgcctgagaatgagcctgcgggcactgcggtcatcgaactgcgcgcgcacgacccagacgaaggcgatgcaggacgccttagctaccagatggaggcgctgttcgatgagcgctctaatggctacttcctcatcgatgccgccacgggtgcagtgaccacagcccgctccctggaccgggagaccaaggacactcatgtactcaaagttagtgctgtggaccacggctccccgaggcgctcagctgccacctacctcaccgtaactgtcagtgacactaacgaccacagcccagtctttgagcagtctgagtatcgagagcgaattcgagaaaacctggaggtgggctatgaggttctgaccatccgtgccaccgacggggatgccccttccaacgcaaacatgcgctatcgtctgctggagggcgcaggtggtgtctttgagatagacgcacgatcaggtgtcgtgcgcacacgggctgtggtggaccgtgaggaggcggctgagtaccagctgctggtggaggccaatgaccagggtcgcaatccaggcccactcagtgcctcagccaccgtccacatagtggtagaagacgagaatgacaactacccccagttcagtgagaagcgctatgtggttcaagtcccagaagacgtagccgtcaacacggctgtgcttcgagtccaggccactgaccgggaccaggggcagaatgcagccatacactacagcatcgttagtggcaacctgaagggtcagttctacctgcattcgcttagtgggagcctggatgttatcaacccgctggacttcgaagccatccgggaatacaccctgcgcatcaaagcccaagatgggggccggcctcctctcattaattcctcaggactggtctcggtgcaggtgttagatgtgaacgacaatgcgcccatctttgtgagcagcccctttcaggctgccgtgctagagaatgtgcccctcggccactcagtcctgcacatccaagcggtggacgcagatgcaggggagaacgccaggctgcagtaccgtctagtggacacagcctccactatcgtggggggcagcagtgtcgactctgagaaccctgcctctgccccagacttccccttccaaatccacaacagctccggttggattactgtgtgcgcggagctggaccgtgaggaggtggaacactatagctttggagtagaagcagtggaccatggctcaccagccatgagctcctctgccagcgtgtccatcacagtgctggatgtaaatgataacgaccccatgttcacgcagcctgtgtatgagctgcgtctgaatgaggatgcggctgtcgggagcagcgtgctgaccctcagggcccgagaccgtgatgccaatagtgtgatcacctaccagctgacgggtgggaacacccgcaaccgcttcgcactcagcagccagagcggcggtggccttatcaccttggcactgcccctggactacaagcaggaacggcagtatgtgctggctgtgaccgcgtccgatggcacgcgttcacacaccgcgcaggtctttatcaacgttacagatgccaacacccacaggccggttttccagagttcccactacacggtcagtgtgagtgaagaccggcccgtgggcacctccatcgctaccatcagtgccacggatgaggatacgggtgagaacgcccgcatcacctatgtgctagaggatcccgtaccacagttccgcattgacccggacactggcaccatttataccatgacggaactggactatgaggaccaggctgcctacacgctggccatcacggctcaggacaatggcattcctcagaagtcagacactacctctctggagatccttatcctcgacgccaatgacaacgcgcccaggttcctgcgagatttctaccagggttctgttttcgaggatgcccccccatctaccagtgtcctccaggtctctgctacagaccgtgactcaggccctaatggccgcctcctgtacactttccagggtggggatgatggagatggagatttctacattgagcccacgtctggtgtgatccgtacccagcgccggctggacagagagaatgtggccgtgtacaacctttgggctctcgctgtggatcggggcagcccgaatcccctcagtgcgtcagtgggaattcaggtgagtgtgttggacattaacgacaaccccccagtgtttgagaaggacgagctggagctgtttgtggaagagaacagccctgtgggttcagtggtagcaagaataagggccaacgacccggacgaaggtccgaatgctcagatcatttatcagatcgtggagggcaatgtgcccgaggtcttccagctggacctactgagtggtgacctccgtgccctggtcgagttggattttgaggtccggagggactatatgttggtggtgcaggccacgtctgctcctctggtaagccgggccaccgtgcacatccgtctcctggaccagaatgacaacccaccggagttgcctgacttccagatccttttcaacaactatgtcaccaataaatccaacagcttccccagtggtgtgatcggccgcatcccagcccacgaccctgacctatctgacagcctcaattacacctttctgcaaggcaacgagctgagcctgctgctgctggatcccgccacaggagagttgcagctcagccgggatctggacaacaaccggccactggaggcgctcatggaggtgtctgtgtcagatggtatccacagcgtcaccgctctctgcactctgcgcgtgaccatcattacagatgacatgctgaccaacagcatcactgtccgcctggagaacatgtcgcaggagaagttcctgtccccgctgctgtccctctttgtagaaggggtggccacagtactgtccaccaccaaggatgacatcttcgtcttcaacatccagaacgacacggacgtcagctccaacatcctgaacgtgactttctcggcactgctccccggtggcacccgtggccggttcttcccgtcagaggacctgcaggagcagatctacctgaaccggacactgctcaccaccatctccgcccagcgtgtgctgccctttgatgacaacatctgcctgagggagccctgcgagaactacatgaagtgcgtgtccgtgcttaggtttgacagttcggcacccttcattagttccaccacggtgctcttccggcctatccatcccatcacgggcctgcgctgccgctgcccgccgggtttcaccggggactactgcgagactgaaattgatctttgctactccaatccgtgcggggccaatggccggtgccggagccgtgagggtggctacacttgtgagtgcttcgaggacttcactggggagcattgccaggtgaacgttcgctcaggccgctgtgccagcggagtatgcaaaaacgggggcacctgcgtgaacctgctcattggaggcttccactgtgtgtgcccgcccggcgagtatgagcatccctactgtgaagtgagcaccaggagcttcccaccccagtccttcgttaccttccgaggcctgcggcaacgcttccacttcaccgtctccctggcgtttgccacccaggacaggaatgccctgctgctctacaatggccgcttcaatgagaagcacgacttcatcgccctggagattgtggaggagcagctgcagctcacgttctcggcaggtgagaccacaaccacggtgacaccgcaggttcctggaggtgtgagcgatgggcggtggcattcggtgctggtgcagtactacaacaagcccaacattggccacctgggcctgccccacgggccgtctggagagaaggtggctgtggtgactgtggatgactgtgacgcagcggtggccgtgcactttggaagttacgtggggaactacagctgcgctgcccagggcactcagagcggctccaagaagtcactggatctgactggtcctctgcttctgggtggtgtccccaacctgccagaagacttccccgtgcacagccgtcagtttgtgggatgcatgcgaaacctgtccatcgatggccggattgtggacatggctgcgtttattgccaacaatggtaccagggcaggctgtgcttctcagaggaacttctgcgatgggacctcatgccagaacgggggcacctgtgtgaacaggtggaacacgtacttatgtgagtgcccgctccgctttggtggaaagaactgtgaacaagctatgccacaccctcagcgcttcactggtgagagcgtcgtgttgtggagtgaccttgacatcaccatctctgtgccttggtacctggggctcatgttccggacccggaaggaggatggtgtgctgatggaagccacagctggcacgtcttccaggctccatctccagattctcaacagctacatccgctttgaggtctcctacggcccctctgacgtggcatccatgcagctgtccaagtcccggataactgacggggggtggcatcacctgctcatagaactgaggagtgccaaggagggcaaggacatcaaatacctggcagtcatgaccttggactatgggatggaccagagcacagtgcagattgggaatcagcttcctgggttgaagatgcggactattgtcatcggaggtgtgaccgaggacaaggtctctgtccgccatggtttccgaggctgtatgcagggagtgaggatgggagagacgtccaccaacattgccaccctgaacatgaatgacgccctcaaggtcagggtgaaggacggctgtgatgtggaggacccatgtgcctcaagcccctgccctccccatagaccctgccgtgacacatgggacagctactcctgcatctgtgacagagggtactttggaaaaaagtgtgtggatgcgtgtctcctgaacccctgcaagcacgtggcagcctgtgtgcgctcccccaacactcctcgaggctactcctgcgagtgcggacccggccactatgggcagtactgtgagaacaaagtcgaccttccgtgccccaaaggctggtgggggaacccggtgtgtggcccctgtcactgtgctgtcagccaaggctttgatcccgactgcaacaagaccaatggccaatgccagtgcaaggagaattactacaagcccccagcccaggatgcttgccttccctgtgactgtttcccccacggctcccacagccgtgcctgcgacatggacactgggcagtgtgcctgcaagcctggtgtcatcggccgtcagtgcaaccgctgtgataatcctttcgcggaggtcacctcgctcggctgtgaagtgatctacaatgggtgtcccagagcatttgaggctggcatctggtggccacagacgaaatttgggcagccagcagcggtgccatgccccaaaggatccgtgggtaacgcagtccggcactgcagtggggagaagggctggcttcccccagagctcttcaactgcacctctggctcctttgtggacctcaaggccttgaacgagaaactgaaccgcaacgagacaagaatggacgggaaccggtccctgcggctggcaaaggctctgaggaacgccacgcaggggaacagcaccctctttggcaatgatgtgcgcacggcctaccagcttctggcccgcatcttacagcatgagagccgccagcagggctttgacctggcagccacccgagaggctaattttcatgaggatgtcgtccatacaggcagcgccctcctggccccagctacagaggcatcgtgggaacagatccagcgaagcgaggctggtgcagcgcagctactgaggcatttcgaggcatacttcagcaacgtggcacgaaatgtgaagaggacctatctgaggcccttcgtcatcgtcaccgccaacatgattcttgcagttgacatcttcgacaagctgaacttcacgggtgcccaggtgccaaggtttgaggacattcaggaagagctcccaagggagctggagtcctccgtgtccttcccagctgacaccttcaagccaccagagaaaaaagaaggccccgtggtgaggctgaccaaccggaggactaccccactcacggcacaaccagagcccagggctgagagggaaacctcatccagcagacggaggagacaccccgatgagcctggacagtttgctgttgccctggttgtcatttaccggaccctgggtcagctgctgcctgaacactatgaccccgaccatcgcagcctccgactgcctaaccggcctgtcatcaacacccccgtggtgagtgctatggtgtacagtgagggaaccccactccccagctctctgcagaggcctatcctggtggagttctccctgttggagacggaggaacgaagcaaacctgtctgtgtattctggaaccactccctcgacactggtgggactggagggtggtcagccaagggctgtgaacttctgtcgaggaaccggacccacgtcacttgccagtgcagccattcggccagctgcgcggtgctcatggacatttccagacgtgagcacggggaggttctgcccctgaagatcatcacctatgccgccctgtccttgtctttggtggccctcctggtggcctttgtccttctctcgctcgttcggacactgcgctccaacctgcacagcatccacaagaacctcatcgcggctctgttcttctcccagctcatcttcatggtcggcatcaaccagactgagaacccgtttctctgcacagtggtcgccatcctcctgcactacgtctccatgggcaccttcgcctggacccttgtggagaacttgcatgtctaccgcatgctgacagaagtgcgcaacatcgacactgggcccatgcggttctaccacgtggtgggctggggcatccctgccattgtcacaggactggctgttggcttggaccctcagggctatggaaaccctgacttctgctggctgtcccttcaggataccctgatttggagctttgctgggcctgtcggaacggttataatcatcaacacggtcatctttgtcctgtctgcaaaggtttcctgccaaagaaagcaccattattatgaaagaaagggggttgtctccatgctgaggacggccttcctcctgctgctgctcgtcactgccacctggctgctgggactgctggcggtcaacagtgacactctgagctttcactacctctttgctgccttcagctgcttgcagggcatctttgtcctcctgttccactgcgtggcccacagggaggtgcggaagcacctgagggcggtgctggcagggaagaagctgcagctggatgactcggccaccactcgggccactctgctaacgcgctccctcaactgcaacaacacctacagcgaagggccagacatgctccgcaccgccctgggcgagtccacagcctctctggacagtaccaccagggatgaaggggtccagaaactcagtgtgtcctctggcccagcccgtggtaaccatggagaaccagatacatccttcatccctaggaactccaaaaaagctcacggccctgactctgactctgacagtgagctgtccctggacgagcacagtagttcctacgcctcttcacacacatcggacagcgaggatgatggcggagaggctgaagacaaatggaatccggctgggggccccgcccatagcaccccaaaagcagatgctctggccaaccacgtcccagctggctggcccgacgagagcctggctgggagtgacagtgaggagttggacactgagccccacctgaaggtggagaccaaggtcagcgtggagttacaccggcaggcgcagggcaatcactgtggcgaccggccctccgacccggaaagtggggtcctggccaagccagtggccgtgcttagcagccagccccaggagcagcggaaaggcatcctgaaaaacaaagtcacctacccgccgccattgccagagcagccactgaagtcccggctgcgagagaagctggctgattgtgagcagagccccacatcctcccgcacatcctcccttggctctggcgatggtgtccatgccactgactgtgtcattaccatcaagactccgaggagggagccaggccgtgagcatctcaatggggtggccatgaatgtacgcacagggagtgcccaggccaacggttctgactcagagaaaccatga

SEQ ID NO: 1234 - DNA, 8763 bp, Mus musculus
atgcggacgcgggctgccagcgcccccctcccaacgccgctgctgccgctgctactgctgttgctgctgctgccaccgtcgccactactgggagatcaagtggggccctgtcgttctctgggatccgggggacgcagctcctctggggcctgcgcccccgtgggctggctctgcccagcctctgcttcgaacctctggctctacaccagccgctgcagagaatcgggcattgagctgaccggccacctggtgccccaccacgatggcctgagggtttggtgtccagaatcaggggctcatatccctcttccgccatcctctgaaggctgcccctggagctgtcgtctcctgggtatcggaggacacctttctccacaaggcacgctgaccctgcctgaagagcacccttgcttaaaggccccacggctcagatgccagtcttgcaagctggcacaggccccagggctcagggctggggaaggctcaccagaggaatctctgggtgggcgcaggaaaaggaatgtgaatacagctccccagttccagcctcccagctaccaggccacagtgcctgagaaccagcctgctggtacctctgttgcatccttaagagccattgatccagatgagggtgaggcgggtcgacttgagtacaccatggatgccctctttgatagccgctccaatcatttcttctccttggacccaatcaccggtgttgtcaccacagctgaggagctggatcgggagaccaagagcacccacgtcttcagggtcactgcacaggatcacggtatgccccgacggagtgccttggccacgcttaccatcttggtgaccgacaccaacgatcacgaccctgtttttgagcagcaagagtacaaggagagcctcagggagaacctggaggttggctatgaggtgcttacagtcagggccaccgacggcgacgcccctcccaatgccaacattctgtaccgcctgctggagggggccggagacagcccctcagacgcctttgagatcgatcctcgctcgggggtgatccgaacccgcggccctgtagaccgggaggaagtggaatcctacaagttaacagtggaggcgagtgaccagggccgggacccaggcccgcggagttccacagccattgttttcctgtcggtggaggatgataatgacaacgccccccagtttagcgagaagcgttatgtggtccaggtgcgggaggatgtgaccccaggagccccagttctccgagtcaccgcctccgatagagacaagggcagcaatgccctagtgcactacagcatcatgagtggcaatgctcggggccagttctatctggatgctcagactggagccctggatgtggtaagcccactcgactatgagacaaccaaagagtatacgcttcggatccgggctcaggacggtggccgtcctccactctccaatgtctctggcctagtaacagtgcaagtcctagacatcaacgatatacggccccccatctttgtcagcacccctttccaggccaccgtcctagagagtgtccctttaggctaccttgttctgcacgtccaggcaattgatgctgacgctggtgataacgcccgcctcgagtatagcctggcaggggttgggcacgactttcccttcaccattaacaatggcacaggctggatctctgtggccgcagagttggatcgggaagaggttgatttctacagctttggtgtagaggcccgggaccatggcaccccagcgctcacggcctcagccagtgtcagtgtaaccatcctggacgtcaatgacaacaacccaaccttcacgcagccagagtacaccgttcggctcaacgaggacgccgccgtgggcaccagtgtggtgaccgtctcagccgtggatcgacacgctcacagtgtcattacctaccagatcaccagcggcaacacccgcaaccgcttctctatcaccagccaaagtggtggtggactggtctcccttgccttaccgctagactacaaactcgagcggcagtatgtgctggcagtgactgcctcagatggcacaaggcaggacacagctcagatagtagtgaatgtcaccgatgccaacacccaccgtcccgtcttccagagctcccactacacagtcaacggtaatgaagaccggccagcaggcaccacagtggtgctgatcagcgccacggatgaggacacgggggagaatgcccgaatcacctactttatggaggatagcatcccccagttccgaatcgacggggacactggggctgtcaccacccaggctgagctggactacgaggaccaggtgtcttataccctggccatcactgctcgggacaatggcattccccagaagtctgacaccacctatttggagatcctggtgaatgacgtgaacgacaacgccccccagttcctcagagattcctaccagggcaccgtctacgaggacgtgccgcccttcaccagcgtcctgcagatcttagccacggatcgagactccggtctgaatggcagggttttctacacctttcaaggaggagatgatggggacggtgactttattgtagagtcgacatcgggcattgtgcgcacactgcggaggctggatcgtgagaacgtggcccagtacgttctgcgggcctatgcggtggacaagggcatgccaccagcccgcacacccatggaagtgacagttactgtcctggatgggaatgacaacccccctgtctttgaacaggatgagtttgacgtatttgtggaagagaacagccccatcgggctggccgtggcccgggtcacagccactgacccagatgaagggaccaacgcacagatcatgtaccagattgtggagggcaatatccctgaggtctttcagttggatatattctctggcgagctaactgccctggtagatttggactatgaggaccggcctgaatatgtcctggtcatccaggctacgtctgctcccttggtgagcagggctactgtccatgtccgcctccttgaccgcaatgataacccgcccgtgctgggcaactttgagattctctttaacaactatgtcaccaaccgctccagcagcttccccggtggtgccataggccgtgtgcctgcccacgaccccgatatctcagacagcctgacgtacagcttcgagcgaggaaatgaactcagcttggtcctgctcaatgcctccaccggtgagctgagactgagccgggcactggacaacaaccggcccctggaagccatcatgagtgtgctggtgtcagatggtgtccacagtgtgacagcccagtgctcgctacgtgtcaccatcatcacggacgagatgctcacacacagcatcacgctgcgcttggaagacatgtctccagaacgctttctctcaccactgctgggactcttcattcaggccgtggcagccacgttggccacacccccggatcatgtggtggtcttcaatgtgcaaagggatactgatgccccaggcggccatatcctcaacgtaagcctgtcggtgggccagcctccaggacccgggggtgggccaccctttctgccttcagaggatctccaggagcgcctgtacctcaaccgcagcctgctcaccgccatctcggcgaagcgcgtgctccccttcgacagacaacatttgctgcgggagccctgcgagaattacatgcgatgtgtgtctgtgctgcggttcgactcctctgcgcccttcatcgcttcctcttcggtgctcttccggcccatccacctcgtcggaggtctgcgctgtcgctgcccacccggcttaacaggcgactactgcgagaccgaggtggacctctgctactcaaggacctgtggaccccatgggcgctgccgcagccgagagggtggctatacctgcctctgtcgtggatgctacacgggcgagcactgtgaagcgagtacccactcaggccgttgtactccaggtgtctgcaagaacgggggtacctgtgtcaacctgttggtgggaggtataaagtgtgactgcccatccgggcactttgagaaacccttctgccaggtgaccacacgcagcttccctgcccgccccttcatcaccttccgtggcctgcaccagcgcttccacttcaccctggccctctcgtttgctaccaaggagcgtaacgggctactgctgtacaatgggcgcttcaatgagaagcacgactttgtggctctcgaggtgatccaggaacaggtgcagctcaccttctctgcaggggaatcgaccaccaccgtgtctccgtttgtgccgggaggggtcagtgatggccagtggcacacagtgcagctgaagtactataacaagccactgttgggtcagacagggcttccccaaggtccatctgagcagaaggtagccgtggtgtccgtggatggctgtgacacaggggtggctctgcgctttggagctatgctgggcaactactcctgtgctgcccagggcacccaaggaggcagcaagaagtctctggacctgacagggcccttgttgctgggtggggtgccggatctgcccgagagcttccccgtccgaatgcggcactttgtgggctgcatgaaggacctccaggtggatagccggcacatcgacatggccgacttcattgccaacaatggcactgtgcctggctgccccaccaagaagatcgtgtgcgacagcagcatttgccacaacggtggcacctgtgtgaaccagtggaatacgttcagctgcgagtgtccactaggcttcgggggcaagagctgcgcccaggaaatggccaacccccagcgttttctgggcagcagccttgtagcctggcatggcctctatctacccatctctcagccctggcacctcaacctcatgttccgcacacgccaggcagatggcgtcctactgcaggccgtcaccagggggcgcagcaccatcaccctgcagcttcgggcaggccacgtgaggctaagtatggagggcacagggctccaggcgtcatctctgcatcttgagccaggccgagccaatgatggtgactggcatcatgcacagctggcactgggagccagccggggccctggccatgccattctgtccttcaactatgggcaacagacagcagagggtaatctgggccctcggctgcatggactgcacctgagcaatattacagtcgggggagttcctgggccagccagcggagtggcccgtggcttccggggctgtttgcagggtgtcagggtaagcgagacacctgagggggttcacagtctagatcccagccgcggggagagcatcaatgtggagccaggctgtagcctgccagacccttgtgactcgaatccatgccctaccaacagctactacagcaatgactggaacagctattcttgtagctgtgttctaggttactatggtgacaactgtacaaatgtgtgtgacctgaacccatgcgagcaccagtccgtgtgtacccgaaaacccaatacaccccacggctacatctgcgagtgtttaccaaattaccttgggccatattgtgagaccaggattgaccaaccttgcccccgtggctggtggggacaccccacatgtggtccatgcaactgtgatgtcagcaaaggctttgacccagattgcaacaagacaagtggggagtgccactgcaaggagaagcactaccggccccccggcagccccacttgtctcttgtgtgactgttaccccactggttctttgtcccgagtctgtgacccagaggacggccagtgtccgtgcaagcctggagtcattgggcgtcagtgtgaccgctgtgacaacccttttgctgaggtcaccaccaatggctgtgaagtgaattacgacagctgcccacgggccatagaggctgggatctggtggccccgcacgcggttcgggctacctgctgctgccccctgccccaaaggctcctttgggactgctgtgcgccactgtgatgagcacaggggttggctccccccaaacctcttcaactgcacgtcagtcaccttctcagaactaaagggcttcgctgagcggctgcagaggaacgaatcgggcctggactcaggacgctcccagaggctagccctgctcctgcgcaatgccacccagcacacctctggctacttcggcagtgatgtcaaggtggcctaccagctggccacacggctcttggctcatgagagtgcccagcggggctttgggctatccgccacacaggatgtacacttcacggagaatctgctgagggtgggcagcgccctcctggatgcagccaacaagaggcactgggaactgatccagcagacagagggtggcaccgcctggctgctccagcactatgaggcttacgccagcgcccttgcccagaatatgcggcacacctacctaagccccttcaccatcgtcacacccaacattgtcatctctgtagtgcgcctggataaggggaactttgctgggaccaagctgccccgttatgaagcattacgtggggagcgccccccagatgttgagaccacagtcattttgccagaatctgtgttcagagagatgccctccatggtgaggtctgcaggacctggtgaagcccaggagacggaggagctggcccggcggcagcggaggcacccagaactgagtcagggagaggcagtggccagtgtcatcatctaccacaccctggctggactgctgccccacaactatgaccccgataagcgtagcttgagagtccccaagcgccccgtcatcaacacccctgcggtgagcatcagcgttcacgacgacgaggaactcctgccgcgggctctggacaagccagtcaccgtgcagttccggctgctggagaccgaggagcggaccaagcccatctgtgtcttctggaaccattcaatcctggtcagtggcactggcggctggtccgcccgaggctgcgaagtcgtcttccgtaacgagagccacgtcagctgccagtgcaaccatatgacaagctttgctgtgcttatggatatgtcacgacgagagaacggtgagatcttgccactgaagaccctgacatacgtggcccttggagtcaccttggctgccctgatgctcaccttcctcttcctcaccctcctccgtgccctccgctccaaccagcacggcatccgacgcaacctcacagctgccctgggcctggcccagctggtctttctcctgggcatcaaccaggctgacctcccttttgcctgtacagtcatcgctatcctgctgcatttcctgtacctctgcaccttctcctgggctctgctggaggccttacacctgtaccgcgcgctcacagaggtgcgcgacgtcaatgccagtcccatgcgtttctactacatgctgggctggggcgtccctgctttcatcacaggcctcgctgtgggcttggatccggaaggctatgggaaccctgacttctgctggctctctgtctatgataccctcatctggagctttgctggaccagtggcctttgctgtttcgatgagggtcttcctgtacatcctgtcggcccgagcctcctgtgctgcccaacggcagggcttcgagaagaaagggcctgtctcgggcctgcgctcctccttcacggtcctcctgctgctgagtgccacgtggctgctggcactgctctctgtcaacagtgacactctgctcttccactacctcttcgctgcctgcaattgtgtccagggccccttcatcttcctctcatacgtggtgctcagcaaggaggtccggaaagcactcaagttcgcctgcagccggaagcccagtcccgaccctgccttgaccactaagtataccctgacctcgtcctataactgccccagcccctacgcagacgggaggctgtaccagccttacggagattcggctggctcgttgcacagtgccagccgctccggcaagagtcagcccagctacatccccttcttgctgagggaggagtccacgctgaaccctggccaggttccccctggcctaggggacccaagcggcctgttcttggaaggccaagcccaacaacatgatcccgacacggactctgacagtgacctgtccctggaagatgaccagagtggttcctatgcctccacccactcatcagacagcgaggaagaggaggaggaggccgccttccctggcgagcagggctgggacagctgcctgggtcctggagctgagagactgccccttcacagtacccccaaggatgggggtccgggttctgggaaggtcccttggctgggagactttgggaccacaacaaaggagaatagtggtagtggggcccttgaagagcggccacgggagaatggagatgccctaactcgggaagggtctctgggaccccttccgggcccttctacccaacctcacaaaggcatcctcaagaagaagtgtctgcccaccatcagcgaaaagagcagcctcctaaggctgcccctggagcagggcacagggtcttctcggggctcctccatcagtgagggcagtcggcacggacctcctccccgcccacctccgcgccagtctctgcaggaacagctgaatggggtcatgcctgtcgccatgagcatcaacgcaggcacggtggatgaggactcctctggctctgaatttctcttctttaacttcctgcattaa

SEQ ID NO: 1235 - DNA, 11541 bp, Mus musculus
atggcgaggcggcctctatggtggggtctcccgggaccgtcgaccccggtactactgctccttctcctctctttgttcccttttagccgggaggagctggggggcggtggggaccaggactgggacccaggggttgctactactactgggccaagagcgcaaatcggcagtggagccgtagctctttgtcccgaatctcccggcgtctgggaagatggagatcctggcctgggggtcagggagcctgtcttcatgaggctccgagtaggtaggcaaaacgcccggaatggtcgaggggcccctgagcaaccaaacgcggaggtggtggtccaggcattgggtagtcgcgagcaagaggcaggtcagggtccagggtatctgttatgttggcacccagagatctcctcttgtgggcggacagggcctttacgaagaggtagcctgccactcgatgctctgtccccaggggattctgatctgaggaacagctctcctcacccttcagaacttctggctcagcctgatggctccaggccagtggccttccagcgtaatgctaggagaagcatccgcaaaagagtggaaacctctcgctgctgcgggaagctgtgggagccaggacacaagggtcagggtgagagatccgcgacttccacagtggagaggggaccctttcggcgggactgcctccccggctctttaggatctggcctgggggaggattcagcaccacgtgctgtgaggacagctcctacgccgggttcagcacctcgcgagtctcggacagctcccgggcgcatgcgctcccgcggtctcttccgccgccgtttcctctttgagcgccctgggccgcgccctcccgggtttccgactggtcctgaagccaagcaaatactctcaactaaccaggctcgtcctcgtcgtgctgcaaaccgccacccgcagtttcctcaatacaactaccagacactggtacctgaaaatgaggcagcgggcacatcagtactgcgcgtggtggcacaagacccggacccaggcgaggccgggcgcctcatctactcgctggcggcgctcatgaacagccgctcgctggagcttttcagtattgatcctcagagtggcctcatccgcacggctgccgctctggatcgtgagagtatggaacgccactaccttcgagtaacagcacaggaccacggctcaccgcgcctctcagctaccaccatggtggcggtgacagtagctgaccgcaacgatcacgcgccagtgtttgagcaagcccagtatcgggaaacacttcgtgagaatgtggaagaaggttaccccatcctgcagttgcgtgccaccgacggcgacgcgccacctaacgccaacctgcgctaccgcttcgtgggatcgccagctgtgcgcaccgcagccgccgctgctttcgagattgatccacgttcgggtcttatcagcaccagtggccgcgtggacagggaacacatggaaagctatgagctagtagtagaggctagtgaccagggccaggagcctgggccacgttcagccaccgtgcgagtgcacataactgtgctggatgagaatgataatgcgccccagttcggcgagaagcgctatgtggcacaggtgcgtgaggatgtgcgccctcacacggtggtgctacgtgtcacggccacggacaaggacaaggatgccaatggtttggtgcattataacattatcagcggcaacagccggggccattttgccatcgacagtctcacgggtgagatacaggtaatggcacccctggactttgaggcagagagagagtacgctttgcgaatccgggcacaagatgcaggccggccacctttgtccaacaacacgggcctggcaagcatccaggtggtagacatcaatgaccatgctcctatctttgtcagcacaccctttcaggtctctgttttggaaaatgcacccctgggtcactcagtaattcacattcaagcagtggatgcagatcatggggagaactccaggttagagtattctctaactggtgtggcatcagacacaccctttgtgataaacagtgccactggctgggtctctgtgagcggtcccctggaccgtgaatctgtggaacattacttttttggtgtggaggctcgagaccatggttcacccccactctctgcttcagccagtgtcaccgtaactgtgttggatgtcaatgacaatcggcctgagttcaccatgaaagagtaccaccttcggctcaatgaggacgcagctgtaggcaccagtgtggtcagtgtgactgcggtagatcgagatgctaacagcgccatcagctaccaaatcacgggtggcaacactcggaaccgatttgccatcagcacccagggtggtgtgggcctggtgacactggctctgccgctggattacaagcaggaacgctacttcaagctggtgcttactgcatctgatcgtgcccttcatgaccactgctatgtgcatatcaacatcacagatgccaacacacacaggcctgtctttcaaagtgcccactactcggtgagcatgaatgaagaccgcccagtgggtagcactgtggtggtcatcagtgcttctgatgatgacgtaggtgaaaatgcccgcatcacctaccttctggaagacaacctgccccagttccgaattgatgctgactctggggccattacgctgcaagctccattggactatgaggaccaagtgacctatacactggccataaccgctcgggacaatggtataccacagaaagcagataccacctacgtggaggtaatggtaaatgatgtgaatgacaatgctcctcagtttgtggcctctcactatacaggcctggtctccgaggatgcaccacctttcactagtgtcctgcagatctcagccactgacagggatgcccatgccaatggccgcgtccagtacactttccagaatggggaagacggggatggggattttaccattgagcccacctctggcattgtcaggactgtgaggcgactggaccgggaagcagtgccagtgtatgagctgactgcctacgcagtggaccgtggtgtgcccccactgaggactccagtcagcatccaggtgactgtacaggacgtaaacgacaacgcacccgtcttcccagctgaggagtttgaagtgagggtgaaggagaacagcatcgtaggatccgtggtggctcagatcaccgcagtggaccccgatgatggccccaacgctcatataatgtaccagattgtggaagggaacatccccgagttgttccaaatggatatcttctctggagagctcacagcactcattgacctggattatgaggctcgtcaggaatatgtgattgtggtgcaggccacatctgctcctctggtcagccgggccactgtacatgtgcgcctagtcgaccagaatgacaacagccctgtgctgaacaacttccagattctctttaacaactatgtatccaaccgctccgacactttcccctcaggcatcattgggcgaatcccagcttatgacccggatgtctctgaccacctcttttactcctttgagaggggcaatgaactgcagctgctggtggtcaaccggaccagtggggagcttcgactcagcaggaagttggacaacaaccgcccactagtggcctccatgctggtaactgtaacagatggcctgcatagtgttacagcccagtgtgttctgcgtgtggtcatcatcacggaggagttgctggccaatagcttgactgttcgcctggagaacatgtggcaagagcgcttcctgtcaccgctgctgggtcattttcttgaaggcgtggctgcagtgcttgcaacaccaaccgaggacgttttcatcttcaacatccagaacgacacggatgtggggggcaccgtgctcaacgtgagcttctcagcgctggcacctcgtggggctggggcaggcgctgcagggccctggttcagctcggaggagctacaggagcaactgtatgtgcgccgtgccgccctggcggcccgctcgctgctcgacgtgctgccctttgacgacaacgtgtgcctgcgcgagccctgcgagaactacatgaaatgcgtgtcagtgctccgctttgactcctccgcgcccttcttggcctcgacctccacgctcttccgacccatccagcccatcgcgggtttgcgctgccgctgccctcctggcttcacgggagacttctgtgagacagagctcgacctctgttactcgaacccttgtcgcaatggcggcgcgtgcgcgcggcgcgagggaggctacacctgtgtgtgccgcccgcgcttcaccgactgcgagctggacactgaagctggacgctgcgtgccgggtgtctgccgcaacgggggcacctgcaccaacgcacccaatggcggctttcgctgccagtgccccgcgggcggcgctttcgagggtccacgctgtgaggtggccgcacgctcctttcctcccagttccttcgtcatgttccgcggccttcgacagcgcttccacctcacgctctccctctcgtttgcaactgtgcaacccagcgggctactcttctacaacgggcgcctgaacgagaagcatgactttttggctctagagcttgtggctggccaagtgcggcttacatattccacgggtgaatccaacacagtggtcagccccacagttccaggaggcctgagtgacggacaatggcatacagtgcatctgagatactacaacaagccccggacagatgccctagggggtgctcagggcccgtcaaaggacaaggtggccgtgttgagcgtggatgactgcaacgtggctgtggctctgcagttcggtgccgagattggcaactactcgtgtgcagctgctggtgtgcaaacaagctccaagaagtccctggacctgacgggccctctgctcttggggggtgtccccaaccttcccgagaacttccctgtgtcccacaaggacttcattggctgcatgcgagacttgcacattgatggccgccgaatggacatggcagcctttgttgcaaacaacggcactatggcaggctgccaggccaagtcacacttttgtgcctcaggcccctgcaagaacaatggcttctgctccgagcgctggggtggcttcagctgtgattgtcctgtgggctttggtggcaaagactgtcgactcacaatggcccatccctaccatttccaaggcaatggaacactgagttgggactttggaaatgacatggctgtgtctgtgccatggtacctgggactatcatttcggacacgggcaacaaaagggatcctgatgcaagtacagcttgggccacacagcgtgctcctctgcaagctagatcgagggttgctgtctgtgacactaaatagggcctcaggccacactgtccacctcctgttggaccagatgactgtcagcgatggccggtggcatgatcttcggctggagttgcaggaggagccaggtggccgaaggggccaccatatctttatggtttcactggacttcaccctcttccaggacaccatggccatggggggtgagctgcagggcctgaaagtaaaacagctccacgtgggaggcctgccccccagcagtaaggaggaggggcatcagggtctggttggctgtattcagggggtgtggattggcttcacaccctttgggtcctcagccctgctacctcccagccacagagtgaatgtggagcctggctgtactgtgaccaacccctgtgcatctgggccttgtcctccccacgctgattgcaaagacctctggcagaccttttcctgtacctgtcggccaggttactatggcccaggctgtgtggatgcctgcctcctgaacccttgtcaaaaccagggatcatgccggcacctccaaggggccccccatggctatacttgtgactgtgtgagtggctattttggtcagcactgtgagcacagagtggaccagcagtgccctcggggatggtggggaagcccgacctgtggtccctgcaactgtgatgttcacaagggctttgaccccaactgcaacaagacgaatggccagtgccactgcaaggagttccactatcgaccgaggggcagtgactcatgcctcccatgtgactgctaccctgtgggctccacctcccgctcatgtgcaccccacagcgggcagtgcccctgccgcccaggagcccttggccgccagtgtaacagctgtgacagcccctttgcggaagtgacagccagtggttgccgagtgctctacgatgcctgccccaagtccctgagatctggtgtgtggtggccccagactaagtttggtgttttggccacagtaccctgtccccggggggccttgggtgctgcggtgcggctgtgcgatgaggaccagggttggttggagcctgatctcttcaactgtacctcccctgccttccgagagcttagtctgctgttggatggcctagaactgaacaagacagcactggatactgtggaggccaagaagctggctcagaggctgcgggaggtgactggccagactgaccactactttagccaagatgtccgagtcactgcccgcttgctggcctacttgctagcttttgagagccatcagcagggcttcgggctgacagccacacaagatgcccacttcaatgagaatcttctatgggctggttctgcactgctggctccggagacaggacacttgtgggcagccctggggcagcgggcccctgggggctccccgggtagtgcaggactggtgcagcatctggaggaatatgcagccacccttgcaaggaatatggagctgacatatctgaatcctgttggactagtcacacccaatatcatgctcagcattgaccgtatggagcatcctagttcaactcagggagcccggcgttacccccgttaccacagcaaccttttccggggccaggatgcctgggatcctcatacacacgtgctgttgccttcccaggcctcacagccatcgccatctgaagttctgcccaccagcagcaacgcagaaaacgccacagcctcaagtgtggtctccccacctgcacctctggagcctgagtctgagcctgggatttccatagtcattctactggtgtaccgagccttgggagggcttctccccgcccagttccaagctgagcgccggggtgccaggctccctcagaaccctgtcatgaactctccggtggtcagcgtggctgttttccatggtcgcaacttcctcaggggtgtcctggtgtccccaatcaaccttgagttccgcctactacagacggcgaatcggagcaaggcaatctgtgtgcagtgggacccacctggcccgacagaccagcatggtatgtggactgctagggactgcgagctggtgcacaggaatggatcccatgcacggtgtcgctgtagccgcacgggcacttttggagtccttatggatgcctctccccgggagcggctagagggagacctagagctgctggcagtgttcactcacgtggtcgtggcagtgtctgtaacggcgctagtactgactgccgctgtcctgctgagtctgcgcagcctcaagtccaatgtgcgtgggatccatgccaatgtggcagctgccctgggagtggcagagctcctcttcctgctgggaatccacaggacccacaaccagctgctgtgcaccgctgtcgccatcctcctgcattacttcttcctcagcacctttgcatggctcctggtgcagggcctgcacctctaccgaatgcaggttgagcctcgaaatgtggatcgtggtgctatgcgcttctatcatgccctgggctggggcgtccctgctgtgttgttgggtcttgctgttgggctggacccagagggctatgggaaccctgacttctgctggatctccatccatgaacctcttatctggagttttgctggccctatcgtcctcgttattgtgatgaacgggaccatgtttctcctcgctgcccgcacatcctgctccacaggacagagggaggccaagaagacctctgtgctgacccttcgcagctcctttctgctccttctgctggtcagtgcctcctggctctttggccttctggcagtcaaccacagcatactggccttccactacctccatgctggactctgtggcctccagggcctggctgtactgctgctcttctgtgtcctgaatgcagacgctcgggctgcttggacaccagcctgtctaggcaagaaggcagctcctgaggaaacaaggccagcccccgggccggggtccggggcctacaacaacacggctctctttgaggagagtggccttatccgcatcactctcggtgcctctaccgtctcttcagtgagcagtgcccgctctggcagggcccaggaccaggacagccagcggggccgcagctacctcagggacaatgttctggttcgacacggctcgactgctgagcacactgagcgaagcctccaggctcacgccggccccacggacctggatgtggctatgttccatcgagacgctggtgcagactctgactctgatagcgacctgtcgttggaggaagagagaagtttatccatcccatcttcagagagcgaggacaatggccggactcgagggcgtttccaacgtccactccgcagggcagcccagagtgagaggctccttgcccaccccaaagatgtggacggcaatgacctcctgtcctactggccagccctgggagagtgtgaggcagcaccatgtgctctgcaggcatggggctctgaaaggcgccttggactagacagcaacaaagatgcagccaacaacaaccagcctgaactggccttgaccagtggagatgaaacctccctgggcagggcccagcggcagaggaaaggcatcctgaagaacaggttgcagtacccactggtgcctcagagtcgaggcactcctgagctgtcgtggtgccgtgcagctaccttgggccaccgtgctgtgccggctgcctcctatggtcgcatctatgcaggtgggggtacaggtagtctttcgcagcctgccagccgctactcttcgcgagaacagctggacttgctcttaaggcgacagctgagcaaggagagactagaagaggtcccagttcctgcacctgttctgcatcccctgagccgcccaggctcccaggaacgcctggatactgcaccagcccgcctggaagccagagataggggcagcacattaccaagaaggcagccacctcgggactaccctggcaccatggctggccgctttgggtcacgagatgcactggacttaggggcaccccgagaatggttgagcacactgcccccaccccgccgcaaccgggaccttgacccacagcacccacctctgcccctgtctccacagcggcaactctcaagggaccccctcttgccatctcggcccctggactctttatctaggatctcgaactctcgggaggggctggaccaggtgcctagtcggcacccttcacgggaggcccttggaccagccccacagcttctcagagccagggaggacccagccagtggccctagccatggtccctccacagagcaactggacattctctcttctatccttgcctctttcaactcctcagccctctcctctgtgcagtcctcaagcactccctcaggccctcacaccaccgccacagcctctgcacttgggccttccacacctcgttccgccacgtctcacagcatctcggagttgtcacctgattcagaagttcccagaagcgagggtcactcctgaggggctgaccagcgaatgaggagccaccaggggttgcagaggatttgggctgactgaagagccttcaggactgatcgcaaggcagccttcttcaagccctcccctcagttcagtgcagaaggaaggtccctcctgtgtgcgtctgtgagcatgtgtgtgacaggtgcaggggtgggggctgagggaggacttttatacatttttgtacctttgtaaccagagagatatgcttatgttatttttcagcttttctgtctcccaggggtctcgagactgggctaggagggggaaggggatgggagagagacactccactgggcgcttagctaagcgtctgctctttcatttcatcttacagcagagtgaatgagtcaggccccacctgctctttccccttctcttccccacattgatctgaacgttgttgttggggcccagggtgcaaatttgatctttgcattttctccgatgcccctaggccaaactcctgttggggggggggattggtcttggaaacaggggttcctccatcctcctcctgagggctcacgtgctccactcctccctgtgggtgtggatatgtattacatggagtccctgccgcttactgccttaagacctaggactgatgctgcaggtgctggtggagcagcagaagtcatgtttacagatcaaggcttccctttctcccttagggagggacttgggcctctaatcagacattcctaggggggtgggtggaggggaaactcctttgtccctccttcacttgtctgtggtgccattggttcattacactgtccccttgagggatgaggggggcagtgagcaaagggagcagaaacaagggaacccaagacccagaatgtaggtaggtgccaccgcctctcactgcttacaggatcctccctggcaccaggctgcagcagtggctgccccaccttctgttggtcccttataaagggacaggtaactgttaggatcctgctcacaaaactctcttgttagttgtctgatgtccagtgctggggactttacatttttgttactttgtttacagatcaagattatttttttaacatggttgggttttatttattgtttacagcttcaaccattgaacttacacactttgttttatagttcagaatgtttccccctctttgtttacaagtgaaaggtagaaaaagtgggggaggggcctaaaagacccacctgcgatgcccctggacctggccatcttgaggtaggcttctaatcccaacttttcccaggtcaaaggtcagctgagtcttctaacagcttgccccgaaagtggctcaggaccggggttctgtgcagccgccacccacccctaccctgtgtttactcttgggaggcagtttctgagattcaaaaaaatcccacttcactgcctgtgccaaatcccaccagccaggtccccagctctctttacccagactgacccctgcccttgaagggctgagaggcctgtcggttgggagagtgtccttgctatgtcctaggttctgtagatgcccgtctctggggtccccttccaacagtggccctctttcctgtctgtgtaaattgttccgtgaagccgcgctctgttttgggaataaacttctatag

SEQ ID NO: 1236 - DNA, 1383 bp, Mus musculus
atgaacacctcagtgccccctgctgtcagtcccaacatcaccgtcttggcaccaggaaagggtccctggcaagtggcattcatcggatcaaccacaggcctcctgtctctggctacagtgacaggcaacctgctggtgctcatctccatcaaggtcaacacagagctcaagacagtcaacaactacttcctgctgagcctggcctgtgctgatctcatcattggcactttctccatgaacctctataccacatacctgctcatgggccactgggctctgggcacactggcctgtgacctctggctggccctggactatgtggccagcaacgcctctgtcatgaatcttctgctcatcagctttgaccgttacttctcagtgacccgacccctgagctaccgagccaagcgcactccccgcagggcagctctgatgattggcctcgcgtggttggtttccttcgttctctgggccccagccatcctcttctggcaatacctagttggggagcggacagtgctggctgggcagtgctacatccagttcctctcccaacccatcatcacttttggcacagccatggccgccttctacctccctgtcacagtcatgtgtacgctgtactggcgcatctaccgggagacagaaaaccgagcccgggagctagcagccctacagggctctgagacaccaggcaaaggtggtggcagcagcagcagctcagagaggtcacagccaggagctgaaggctcacccgagtcacctccaggccgctgctgtcgctgttgccgggctcccagacttctgcaggcctacagctggaaagaagaagaggaagaggatgaaggctccatggagtccctcacatcctctgaaggtgaggagcctggctcagaagtggtgatcaagatgcctatggtagatcctgaggcacaggcacccaccaagcagcctcccaaaagctccccaaatacagtcaagaggcccaccaagaaaggccgagaccgaggcggcaaaggccaaaaaccccgagggaaggaacaattggccaagagaaagaccttctcactggtcaaggagaagaaggcagctcggaccctgagtgccatcctgctggccttcatcctcacctggacaccatataacatcatggtgctggtgtctacattctgcaaggactgtgttccagaaaccctatgggagctgggctactggctttgctacgtcaacagcactgtcaaccccatgtgctacgcttcttgcaacaaagccttccgggaccatttccgcctgctgttgctctgccgctgggacaagcggcgctggcgaaaaatccccaagcgccctggctctgtgcaccgcaccccctcccgccaatgctaa

SEQ ID NO: 1237 - DNA, 1401 bp, Mus musculus
atgaataactcaactaactcctcgaacaatggtttggctattaccagtccttacaagacatttgaagtggtatttattgtccttgtggctggatccctcagtctggtgaccatcattgggaacattctagtcatggtttccattaaagtcaaccgccaccttcagactgtcaacaattacttcttgttcagcctggcctgtgctgacctcatcataggtgttttctccatgaacttgtataccctctacactgtgattggctactggcctttgggacctgtagtgtgcgacctttggctagccttggactatgttgtcagcaatgcctccgttatgaatcttctcatcatcagctttgatagatacttctgtgtcacaaaacctctaacctacccagttaagcggaccacaaaaatggcaggcatgatgattgcagctgcgtgggttctttccttcatcctctgggccccagccattctcttctggcagttcatcgtaggggtaaggactgtggaagacggggagtgctacattcagttcttttccaacgctgccgtcacctttggcactgccattgcggctttctatctgcctgtcatcatcatgactgtgctctattggcacatatcccgggcgagcaagagcagaataaagaaagaaaagaaggaaccagtggccaaccaagacccggtgtctcccagtctagtgcaaggaagaattgtaaagccaaacaacaacaacatgcctggtggtgatggtggcctggagcacaacaagatccagaatggcaaggctctgcgggacggtgggactgaaaactgcgttcagggggaggagaaagaaagctccaatgactccacgtctgtcagcgccgtggcctccaacatgagagatgatgagataacccaggatgaaaacacggtttccacttccctgggccactccaaagatgacaactctaggcagacatgcatcaaaattgtcaccaagacccaaaagggtgacgcatgcacaccaacaagtaccacagtagaactagttggatcgtcaggtcagaatggggatgaaaagcagaacattgtagcccgcaaaattgtgaagatgaccaagcagcctgccaaaaagaagcctcctccatcccgggaaaagaaagtgaccaggacaatcttggctatcctgttggctttcatcatcacgtgggcgccatacaatgtcatggtgctcatcaataccttctgtgcaccctgcatccccaatacagtgtggacaattggctactggctctgttacattaatagcaccatcaaccctgcctgctatgcactttgtaacgccaccttcaaaaagacttttaagcacctccttatgtgtcattacaagaacataggcgctacaaggtaa

SEQ ID NO: 1238 - DNA, 1770 bp, Mus musculus
atgaccttgcacagtaacagtacaacctcgcctttgtttcccaacatcagctcttcctgggtgcacagtccctcagaggcggggctgcccttggggacagtctctcaattggacagctacaacatttcccaaacctctgggaatttctcctcaaatgacacctccagtgaccctctagggggccacaccatctggcaagtggtcttcattgcattcttgactggcttcctggcattggtgaccatcatcggcaacatccttgtcattgtggcatttaaggtcaacaaacagctgaagacagtcaacaactacttcctcttaagcctggcctgcgcagatctgatcatcggggtcatttccatgaacctgttcacgacctacatcattatgaaccgctgggctctggggaacttagcctgtgacctctggctttccattgactatgtggccagcaatgcttctgtcatgaatctgctggtgatcagctttgacaggtacttttctattaccaggccactcacctaccgagccaaacgaacaacaaaacgagccggtgtgatgattggtctggcttgggtcatctcctttgtcctgtgggctcctgccatcttgttctggcaatactttgtagggaagagaactgtgccccccggagaatgtttcattcagtttctaagtgagcccaccatcaccttcggcacggccatcgctgccttttacatgcctgtcaccatcatgactattttatactggagaatctataaggagactgagaaacgtaccaaagagctggctgggctacaggcctctgggacagaagcggaagcagaaaactttgtccaccccacaggcagttctcgaagctgtagcagctatgagctacaacagcaaggcacgaaacggtcatctaggaggaagtatggtggctgtcacttctggttcacaaccaagagctggaagcccagtgctgagcagatggaccaagaccacagtagcagtgacagttggaataacaacgatgctgctgcctccctggaaaactctgcttcttctgatgaagaggatattggctcagagaccagagccatctattccattgtactcaagctgccgggtcatagcaccatcctcaactctaccaagctaccctcctcagataacctgcaggtgccagacaaggacctggggactatggatgtagagagaaatgcccataagcttcaggcccagaagagtatggatgaccgtgacaactgtcagaaggacttctccaagctccccatccagttagagtctgccgtggacacagccaagacctctgacaccaactcctcggtggacaagaccacggccgctctacctctgtccttcaaagaagccacgctggctaagaggtttgctctcaagaccagaagtcagatcaccaagcggaaaaggatgtcgctcatcaaggagaagaaggccgcccagacactcagtgccatcttgctggctttcatcatcacgtggaccccctacaacatcatggtcctggtgaacaccttctgtgacagctgcatacccaaaacctattggaatctgggctactggctgtgctatatcaacagcaccgtgaaccccgtgtgctatgccctgtgcaacaagacattcagaaccaccttcaagatgcttctcttatgccagtgtgacaagaggaagcggcgcaaacagcagtaccagcagagacagtccgtcatttttcacaagcgagtgcctgagcaggccttgtag

SEQ ID NO: 1239 - DNA, 1440 bp, Mus musculus
atggcgaacttcacacctgtcaatggcagctcagccaatcagtctgtgcgcctggtcacaacagcccacaaccacctggagacagtggagatggtgttcattgcgacagtgactggttccctgagcctggtgactgtggtgggtaacatcctggtgatgctgtccatcaaggtcaacaggcagttgcagacagtcaacaactacttcctgttcagcctggcgtgtgcagatctcatcataggggcgttctctatgaacctttacaccttatacatcatcaagggctactggcccctgggtgccgtggtctgtgacctgtggctggccctggactatgtggtgagcaatgcctctgtcatgaaccttctcatcatcagctttgaccgctatttctgcgtcaccaagcccctcacctatccagcccgccgcactactaagatggcaggcctcatgattgcagccgcctgggtcttgtcctttgtactctgggcccctgccatcttgttctggcagtttgtggtgggcaagaggacagtgcctgataaccagtgcttcatccagttcttgtccaacccggcggtgaccttcggcacagccattgctgccttctacctgcctgtggtcatcatgacggtgctgtatattcatatctcgctggccagccgcagccgtgttcacaagcatcgacccgagggccccaaggagaagaaggccaagactctggctttcctcaagagccctctgatgaagccgagcattaagaaacctccaccagggggcgcttctcgagaggaactgcgcaacgggaagctagaagaggctcctccgccagccctgcccccgcctccacgcccagtggctgacaaggacacttccaatgagtccagctcaggcagtgccacccagaacaccaaggaacggccacccacagagctgtccaccacagaggccgccaccacaccagcgctgcccgctcctaccctgcagccacgaaccctcaacccagcctccaagtggtccaagatccaaattgtgacaaagcagacaggcagtgaatgtgtgactgccatcgagatcgtacctgccacgccagctggtatgcgcccagcagccaatgtggcccgaaagtttgccagcatcgctcgtaaccaggtgcgcaagaagcggcagatggcggcccgggagcgcaaagtgactcggacaatctttgccattctgctggccttcatcctcacctggacaccctacaatgtcatggtcctggtgaacaccttttgccagagctgtatccccgaaagggtgtggtccatcggctactggctctgctacgtcaacagcacgatcaaccctgcctgctatgcactctgcaatgccactttcaaaaagaccttccgccaccttttgctgtgccagtatcggaacatcggcacagccaggtag

SEQ ID NO: 1240 - DNA, 1596 bp, Mus musculus
atggaaggggagtcttatcacaatgaaaccactgtcaacggcaccccagtaaatcaccaggctttggaacgccatggactgtgggaagtcattactattgcagctgtgaccgctgtggtcagtctgatgaccattgtcggcaatgtcttggtcatgatctccttcaaagtcaacagtcagctcaagacagttaacaactattacctgctcagcttggcctgtgcagacctcatcattggcatcttctccatgaacctctacacgacctacatcctcatgggacgctgggttctcgggagtctggcctgtgacctttggcttgcactcgactatgtagccagcaacgcttctgtcatgaaccttctggtgattagctttgatcgttacttttccatcacaagaccactgacataccgagccaagcgtaccccaaagagggctggcatcatgatcggcttggcatggctggtctccttcatcctctgggcgccagccatcctctgctggcagtacttggtcgggaagcggacagtaccacctgatgagtgccagatccagttcctctctgagcccaccatcacttttgggaccgccattgccgctttctatatccctgtctccgtcatgaccatactctactgccggatctaccgggaaacagagaaacgaaccaaggacctggctgacctccaaggttccgattctgtggcagaagtcaagaagagaaaaccggctcacaggaccctgctcagatctttctttagctgccctagacccagcctggcccagagagtacggaaccaggcctcctggtcatcctcccgtagaagcacctcaacaacgggaaagccaacccaggccactgatctaagtgctgactgggaaaaggctgagcaggttaccaactgtagcagctgcccctcttcagaggacgaagccaaggccaccactgaccctgtctttcaagtggtctgcaagaatgaggccaaggaaagcccggggaaggaattcaatacccaagagaccaaggaaacgtttgtgagccctcggactgaaaacaatgactatgacactcccaagtacttcctgtctccaggtgctgctcacagactcaagagtcagaagtgtgttgcctataagttccgattggtggtaaaagctgacgggacccaggagacaaacaatggctgtcgtaaggtgaaaatcatgccctgttccttcccagtgtccaaagacccttcaacaaaaggcctggatccccacctcagccatcaaatgaccaaacgaaagagaatggtcctagtcaaagagaggaaagcggcgcagaccttgagcgccattctcctggccttcatcatcacatggactccttataacatcatggtcctggtttccaccttctgtgacaagtgtgtccctgtcaccctgtggcacttgggttactggctgtgctatgtcaacagcaccatcaaccccatctgttacgctctctgcaacagaaccttcaggaagacctttaagctgctgcttctctgccggtggaaaaagaaaaaagtagaagagaaattgtattggcaaggcaacagcaagctaccc

SEQ ID NO: 1241 - DNA, 1116 bp, Mus musculus
atggagtacgacgcttacaacgactccggcatctatgatgatgagtactctgatggctttggctactttgtggacttggaggaggcgagtccgtgggaggccaaggtggccccggtcttcctggtggtgatctacagcttggtgtgcttcctcggtctcctaggcaacggcctggtgattgtcatcgccaccttcaagatgaagaagaccgtgaacactgtgtggtttgtcaacctggctgtggccgacttcctgttcaacatctttttgccgatgcacatcacctacgcggccatggactaccactgggtgttcgggaaggccatgtgcaagatcagcaacttcttgctcagccacaacatgtacaccagcgtcttcctgctgactgtcatcagctttgaccgctgcatctccgtgctgctccccgtctggtcccagaaccaccgcagcatccgcctggcctacatgacctgctcggccgtctgggtcctggctttcttcttgagctccccgtcccttgtcttccgggacaccgccaacattcatgggaagataacctgcttcaacaacttcagcttggccgcgcctgagtcctccccacatcccgcccactcgcaagtagtttccacagggtacagcagacacgtggcggtcactgtcacccgcttcctttgcggcttcctgatccccgtcttcatcatcacggcctgctaccttaccatcgtcttcaagctgcagcgcaaccgcctggccaagaacaagaagcccttcaagatcatcatcaccatcatcatcaccttcttcctctgctggtgcccctaccacaccctctacctgctggagctccaccacacagctgtgccaagctctgtcttcagcctggggctacccctggccacggccgtcgccatcgccaacagctgcatgaaccccattctgtacgtcttcatgggccacgacttcagaaaattcaaggtggccctcttctcccgcctggccaacgccctgagtgaggacacaggcccctcctcctaccccagtcacaggagcttcaccaagatgtcgtctttgaatgagaaggcttcggtgaatgagaaggagaccagtaccctctga

SEQ ID NO: 1242 - DNA, 1423 bp, Mus musculus
atgaagtcgatcttagacggccttgcagataccaccttccgtaccatcaccacagacctcctctacgtgggctcaaatgacattcagtacgaagatatcaaaggagacatggcatccaaattaggatacttcccacagaaattccctctaacttccttcaggggtagtcccttccaagaaaagatgacggcaggagacaactccccgttggttccagcaggagacacaaccaacattacagagttctataacaagtctctctcatcgttcaaggagaacgaggacaacatccagtgtggggagaattttatggacatggagtgcttcatgattctgaatcccagccagcagctggccatcgctgtcctgtccctcaccctgggcaccttcacggttctggagaacctgctggtgctatgtgtcatccttcactcccgcagtctccgatgcaggccttcctaccacttcattggcagcctggcggtggccgatctcctgggaagtgtcatctttgtctacagctttgttgacttccacgtgttccaccgcaaagatagtcccaatgtgtttctgttcaaactgggtggggttaccgcctccttcacagcatctgtgggcagcctgttcctcacggccatcgacaggtacatatccattcacaggcctctggcctataagaggatcgtcaccaggcccaaggccgtagtggccttttgcttgatgtggactattgcaatagtaattgctgtgttgcctctcctgggctggaactgcaagaagctgcaatctgtttgctcagacatcttcccactcattgatgaaacctacctgatgttctggatcggagtcaccagtgtgctgttgctgttcattgtgtatgcatacatgtacattctctggaaggctcacagccacgcagttcgcatgatccagcgtggaacccagaaaagcatcatcattcacacctcagaagatggcaaggtgcaggtgacacggcctgaccaagcccgcatggacattaggctggccaaaaccctggttctgatcctggtggtgttgatcatctgctggggccctctgcttgcgatcatggtgtatgatgtctttgggaagatgaacaagcttatcaagacggtgtttgccttctgtagtatgctctgcctgctgaactccaccgtgaaccccatcatctatgctctgaggagcaaggacctgagacatgctttccgcagcatgttcccttcatgtgaaggcactgcgcagcctctagataacagcatgggggactcagactgcctgcacaagcacgccaataacacagccagcatgcacagggccgcggaaagctgcatcaagagcactgttaagatcgccaaggtgaccatgtctgtgtccacagacacgtctgccgaggctctgtgag

SEQ ID NO: 1243 - DNA, 3715 bp, Mus musculus
atatctggatacagaatagccaggacaaggctccacaagaccctggggcccagcggctgacaaatgacacccagtcttctgggacagctccagtagaagaagccaaagcccatccatggagggatgccgggagacagaagtgaccaacggctccaacggtggcttggagttcaaccccatgaaggagtacatgatcctgagcagtggccagcagatcgccgtggcggtgctgtgcaccctgatggggctgctgagcgccctggagaacatggccgtgctctatattatcctgtcctcccggcggctccgcagaaagccctcgtacctgttcatcagcagcttggctggagctgacttcctggccagcgtgatcttcgcctgcaactttgtcatcttccacgtcttccacggggtcgactccaacgctatcttcctgctgaagatcggcagtgtgaccatgaccttcacagcctctgtgggcagcctgctgctaaccgctgttgaccgctacctatgtctgtgttacccgcctacctacaaagctctagtcacccgtgggagggcactggtggccctctgtgtcatgtgggtcctctcagcattgatttcttacctgccgctcatggggtggacttgttgccctagtccctgctctgagcttttcccactgatccctaacgactacctactgggctggcttctattcattgccatcctcttttccggcatcatctatacctatgggtatgtcctctggaaagcccaccggcatgtagccaccttggctgagcaccaggacaggcaggtgcctgggatagctcggatgcggctagacgtgaggttggccaagactctgggcctggtgctggctgtgctgctcatatgctggttccctgcactggctctcatgggccacagcctggtcaccacgctgagtgaccaggtcaaggaggccttcgccttctgttccatgctgtgccttgttaactctatggtcaatcctatcatttacgccctgcggagtggagagattcgctctgctgcccagcactgcctgataggctggaagaagtatctacagggcctcggacctgaggggaaagaagaaggcccaaggtcctcggttacagaaacagaggctgatgtgaaaaccacctaggagccaggatccagaactccaggctgctccaactgctgacaccacctgtctttctactggaaacagcccgagtcagaagtccgttcagttcactccctcgaagagagaggggttccagacccggattctttctgaagccagttctagggtaatggaaacagatccccctttttgctaaggaatgctggttggctggaaggtggcctggtcatgcctaccttttccagtctgtggagaggggcctgtaagaatggcaggctctgttcatatcaaatcaggaaagccttctgactccaaagacctagaggccagaggggcctccagagatgatactaaaggattcaggagatctgtgaagacaagggacctgttctcctggaatctagagtaccccagccgtggggccactgccctcaacttcatagatgtccatgtcttccatagtgtggattctagactgtcctgctgaagatagagagaccagctgcttctggttcctgcttcatcctctgtggctgtagagctatgtgaggctctaccttcaggtcacccttgcctcttgggggtcaagaattatgatgccctaaggaccaaggatgttcgcttacatccttcagacagcgtcaggagctgtcagctcagggtatcctgttgttgggaaagggccctcccgacatcctgataagccttgaaagccattatgaccttaggtccttagggacgcagaggaagctgggttcactggaggtacaaagtcttcagagaactctattccttgtgacattttgctgtgtctcacacagcactatcccagtcttgcctagcttcagtacaaagcaagatattcacacagattctttgggtcctaggctgttcccagtgatgcttgactcagccccactggcctcttccacactctggtcctgaaggataagcagaaggagttgggagggaagacttcctgctgcaaaccaggcatcctaggtccacagccccacgctgtgtctctgggtgcctgcctttgcccttcagtaaaggttgcagtcccaacagatggaggttcaaggcgctgctggtggtagaaggggtaggtggcactggggaccacagacacagtgaaaggaaaactcttaaacatttaatacttttgcttttagaagatccggcccgcagacaggacttccccattgcccaaaggaactaacagggtggtgtccagtgcaaagaaaaatcagcctccctaataaagcaaggaggtccactcagctctacagcctctcctaagcttctgcaaggtgacagtttgttttctctatgaaggtcaacggcgtctcattttattcttcccaagacaagttctgtgcatcaaaagctgctgcaaattctaatcgctgtttgggaggatcaggggaagaagtcgattcgcccacgcttagtgatttagactgtatttcaacatcaacttgggggaggaagagacagaaaagacacggtgtttccttattactcctcaaaggaggaagtgcttggttctgtcaacataagccgatctctccaaggtgcctgacagaggaggagggaatacagtttccacagctgtgaattcctgcaccagctttggtccacacttatgtggtcttgatcaacccccgccctttaccttgctttggtttccttctcggtaaattgggaatggtggggaaaacaatgctctccagggccattaaaacctctcattgctctaacatgctgtggttatctctgcaaccatggagacctttgtgccatatggaccatgtgacttctggctcccatacttcctgaagttatgggcacacaccatataccattgggcgtgtgctgactgtagaggaattgggtgactggccatatgagttttagagattttcccagggcaagagggttctcttggctctcaatttttctggtccctcatgcctcagtggtcccctgtgtgtgggtcaggcatgcttgtttagcggtgccagactgaagctccggccttccggtgtaccaagcaagtgttgtactcctgagtcaggttttcttcagttagatgctaactaagctctctgagagaccctcaaagtttttgaggtgtagctcagtcagtagagtgctgcatctgcaagagcaaatctctgggttcaaaggtcagtactacctaaaaccaggaatggcagtgccatcccctacctgtaatcccagcactcctgaggtacaagcaggaagatcaggaatgcaaagttactgtagctgtaagttcgaagccagcctgagctagttgagacccccttacctcaaaataaatttaagttacaattctaaattaaattaaaatgtctagggctggagagatggcttagtggttaagagcacagactgcttttccagaggtcctgagttcaattcccagcaaccacatggtggctcacaaccatctgtaatggaatctgatgccctcttctggtatgtttgaagagagcgatggtgtactcatatacataaaataagtaaataaatcttttttaaaaa

SEQ ID NO: 1244 - DNA, 1248 bp, Mus musculus
atgggacagcgcccgcagctccggctcgtgaaggcccttctccttctggggctgaaccccgtctccacctccctccaggatcagcagtgtgagagcctgtccctggccagcaatgtctctggcctgcagtgcaatgcctccgtggacctcattggcacctgctggcccaggagccctgcagggcagttggtggttcggccctgccctgcctttttctacggtgtccgctacaacaccacaaacaatggctaccgggaatgcctggccaacggcagctgggcagcccgtgtgaattattctgagtgccaggagattctcaacgaagagaagaagagcaaagtgcactaccacattgccgtcatcatcaactacctgggccactgcatctccctggtggccctcctggtggcctttgtcctcttcctgcggctcaggagcatccggtgcctgaggaacatcatccactggaacctcatctcggctttcatcctgcgcaacgccacgtggtttgtggtccagctcaccgtgagccccgaggtccaccagagcaacgtggcctggtgcaggctggtgacagccgcctacaactacttccacgtaaccaacttcttctggatgttcggtgagggctgctacctgcacacagccatcgtactcacgtactccaccgaccgtctgcgcaagtggatgttcgtctgcatcggctggggtgtgcctttccccatcattgtggcttgggccattgggaaactttactacgacaatgaaaagtgctggtttggcaaacgtcctggagtatatactgactacatctaccagggccccatgatcctggtcctgctgatcaactttatctttctcttcaacattgtccgcatcctcatgaccaaactccgagcatccaccacatctgagactattcagtacaggaaggctgtgaaggccactctggtgctcttgcccctcctgggcatcacctacatgttgttcttcgtcaaccctggggaggacgaggtctccagggttgtcttcatctacttcaactctttcctggagtcctttcagggcttcttcgtgtctgtgttctattgttttctgaacagtgaggtccgctctgccatccggaagaggtggcggcgatggcaggacaagcactccatcagagcccgagtggcccgcgccatgtccatccccacctcccccaccagagtcagcttccacagcatcaagcagtccacagcagtgtga

SEQ ID NO: 1245 - DNA, 1296 bp, Mus musculus
atggggaccccaggctctcttcccagtgcacagcttctcctctgcctgttttccctgcttccagtgctccaggtggcccaaccaggccaggcaccccaggaccagcccctgtggacacttttggagcagtactgccacaggaccacaattgggaatttttcaggtccctacacctactgcaacacgaccttggaccagatcgggacctgctggccacagagcgcacccggagccctagtagagagaccgtgccccgagtacttcaatggcatcaagtacaacacgacccggaatgcctacagagagtgcctggagaacgggacctgggcctcaagggtcaactactcacactgcgaacccattttggatgacaagcagagaaagtatgacctgcattaccgaatcgccctcattgtcaactacctgggtcactgtgtttccgtggtggccctggtggccgctttcctgcttttcctagtgctgcggagtatccgctgcctgaggaatgtgatccactggaacctcatcaccaccttcattctgagaaacatcgcgtggttcctgctgcaactcatcgaccacgaagtgcacgagggcaatgaggtctggtgccgctgcatcaccaccatcttcaactattttgtggtcaccaacttcttctggatgtttgtggagggctgctacctgcacacggccattgtcatgacgtactccacagagcacctgcgcaagtggcttttcctcttcattggatggtgcattccctgccctatcatcatcgcctgggcagttggcaaactctactatgagaatgagcagtgctggtttggcaaggaagctggtgatttggtggactacatctaccagggccccgtcatgcttgtgctgttgatcaattttgtatttctgtttaacatcgtcaggatcctgatgacgaagttacgagcatccaccacgtccgagacaatccaatacaggaaggcagtgaaggccacgctggtcctcctccccctgttgggcatcacctacatgctcttctttgtcaatcctggcgaggacgacctgtcccagattgtgttcatctacttcaactctttcctgcagtccttccagggtttctttgtgtccgttttctactgcttcttcaatggagaggtgcgcgcggccctgagaaagcggtggcaccgctggcaggaccaccacgccctccgggtgcctgtggcccgggccatgtccatccctacgtcgcccaccaggatcagcttccacagcatcaagcagacagctgctgtgtga

SEQ ID NO: 1246 - DNA, 1065 bp, Mus musculus
atgtccacctccttccctgaactggatctagagaattttgagtatgacgattctgctgaggcctgttatttgggcgacattgtggcctttggaaccatcttcctgtccgtcttctacgccctcgtcttcacgttcggtctggtgggaaatctgttggtggtcctcgctctcaccaacagccggaagcccaagagcatcactgacatctacctcctgaacctggccttgagcgacctgctctttgtggccaccttgcccttctggactcactacctcatcagccatgagggcctccacaatgccatgtgcaagctcacgactgccttcttcttcattggcttctttgggggcatattcttcatcaccgtcatcagcatcgaccggtaccttgccatcgtcctggccgccaactccatgaacaaccggacagtgcagcacggtgtcaccattagtctgggcgtctgggcggcggccatcttagtggcgtcaccccagttcatgttcacaaagagaaaggacaacgagtgtctgggtgactaccccgaggtcctgcaggaaatgtggcccgtgctccgcaactcggaagtcaacatcctgggcttcgccctgcccttgcttatcatgagcttttgctacttccgcatcatccagacgctgttttcctgcaagaatcgcaagaaggccagagccgtcagactcatcctcctggtggtctttgccttcttcctcttctggacaccatacaacatcatgattttcctggagactctcaagttctacaacttcttccccagttgtgacatgaagagggacctgaggttggccctcagtgtgacggagacagtggcgttcagccactgttgcctcaacccctttatctacgcctttgccggggaaaagttcagaagatacctgggacacctgtataggaagtgcctggccgtcctgtgcggtcatcctgtccacaccggcttctcgccagagtcccagaggagcaggcaggacagcattctgagcagtttcactcactacacaagcgagggagatgggtctctcctgctctga

SEQ ID NO: 1247 - DNA, 1080 bp, Mus musculus
atggaaccgatcagtgtgagtatatacacttctgataactactctgaagaagtgggttctggagactatgactccaacaaggaaccctgcttccgggatgaaaacgtccatttcaataggatcttcctgcccaccatctacttcatcatcttcttgactggcatagtcggcaatggattggtgatcctggtcatgggttaccagaagaagctaaggagcatgacggacaagtaccggctgcacctgtcagtggctgacctcctctttgtcatcacactccccttctgggcagttgatgccatggctgactggtactttgggaaatttttgtgtaaggctgtccatatcatctacactgtcaacctctacagcagcgttctcatcctggccttcatcagcctggaccggtacctcgctattgtccacgccaccaacagtcagaggccaaggaaactgctggctgaaaaggcagtctatgtgggcgtctggatcccagccctcctcctgactatacctgacttcatctttgccgacgtcagccagggggacatcagtcagggggatgacaggtacatctgtgaccgcctttaccccgatagcctgtggatggtggtgtttcaattccagcatataatggtgggtctcgtcctgcccggcatcgtcatcctctcctgttactgcatcatcatctctaagctgtcacactccaagggccaccagaagcgcaaggccctcaagacgacagtcatcctcatcctagctttctttgcctgctggctgccatattatgtggggatcagcatcgactccttcatccttttgggggtcatcaagcaaggatgtgacttcgagagcatcgtgcacaagtggatctccatcacagaggccctcgccttcttccactgttgcctgaaccccatcctctatgccttcctcggggccaagttcaaaagctctgcccagcatgcactcaactccatgagcagaggctccagcctcaagatcctttccaaaggaaagcggggtggacactcttccgtctccacggagtcagaatcctccagttttcactccagctaa

SEQ ID NO: 1248 - DNA, 1056 bp, Mus musculus
atggatgatgggcatcaagagtcagctctgtacgatgggcactacgagggagatttctggctcttcaacaattccagtgataacagccaggagaacaaacgcttcctaaagttcaaggaggtctttttgccctgtgtgtacctggtagtgtttgtctttggactgctaggaaactccctggttctgattatatacattttctaccagaagctgaggactctgacagatgtgtttctgctgaacttgcccctggctgacctggtgtttgtctgtactctgcccttttgggcctatgcaggcacctatgagtgggtctttggcacagtcatgtgcaaaactcttcgaggcatgtatacaatgaacttctacgtgtccatgctcactctcacctgcatcacagtggatcgtttcattgtagtggtccaggctaccaaggccttcaaccggcaggctaagtggaagatctggggccaagtcatttgcttgctcatttgggtggtctccctgttggtttctttgccacagatcatctatggccatgttcaagatattgacaagcttatctgtcagtaccacagtgaggagatatccactatggttcttgttatacagatgactctggggttcttcctgccattgctcactatgattctgtgctactcaggcattatcaagaccttgcttcatgctcgaaacttccagaagcacaaatctctaaagatcatcttccttgtagtggctgtgttcctgctgacccagacacccttcaaccttgccatgttaatccaaagtacaagctgggagtactataccataaccagctttaagtatgccatcgtagtgacagaggctatagcatactttcgggcttgccttaaccctgtactttatgcctttgttggcttaaagttccggaagaacgtctggaaacttatgaaggatatcggctgcctctctcacctgggagtctcaagtcaatggaagtcttctgaggacagttccaagacttgttctgcctcccacaatgtagagaccaccagtatgttccaattgtag

SEQ ID NO: 1249 - DNA, 1059 bp, Mus musculus
atgtacctccaaggcaccaagcagacattcctggagaacatgaatggaactgaaaatctgacgacatctctcattaataacacgtgtcatgacacaattgatgaattccgaaatcaagtatactccactatgtattctgtgatctctgttgtgggtttctttggcaatagctttgtgctctatgtcctcataaaaacataccatgagaaatcagccttccaagtatacatgattaatctagccatagcagatctactctgtgtatgtacattgcctctccgtgtggtctattatgttcacaaaggcaagtggctctttggtgactttttgtgccgcctcaccacctatgccttgtacgttaacctctattgtagcatcttctttatgacagccatgagctttttccggtgtgttgcaattgtctttccagtccagaacattaatttggttacacagaaaaaagccaggttcgtttgcattggaatttggatttttgtgattttgacaagttctccctttttaatgtacaaatcttaccaagatgagaaaaacaatactaaatgctttgagcctccacagaacaatcaagctaaaaaatacgttttgatcttgcattatgtgtcattattctttggtttcatcatcccttttgtcaccataattgtctgttacacaatgatcattctgaccttactaaaaaatacaatgaagaaaaacatgccaagtcgtaggaaggctatagggatgatcatagttgtgacagctgcctttttagtgagcttcatgccatatcatattcaacgaactatccaccttcaccttttacacagtgaaactagaccctgtgattctgtccttaggatgcagaagtcagtggtcataaccttatctctagctgcatcaaattgttgctttgatcctctgctatatttcttttcaggtggaaactttaggagaaggctatctacatttagaaagcattctttgtccagtatgacttatgtacccaagaagaaagcttccttgccagaaaaaggagaagaaatatgtaacgaataa

SEQ ID NO: 1250 - DNA, 1762 bp, Mus musculus
gagagcagacgccagggcgaccgaaggcagaggcacagattcggtcattttattctgtaagacctttttctactccgaagctttgcttttggaagagagaagagtccatctgagaaggcatacttcagtgatttggttcagagtcttttacatgtacctgagagtaatatgaatgaagaaataagaagatgcaatcaaagttgtcctggggaaggatgtgtatcattggctaaagagaagacttggaacttcttgagttgagaggataaaagatgaagaagatgatctgttagagaccacttgtagcaatggtttgaactccaaaggacatataatggcattttaattctgatctggggcctgaatttgggaaaggaagagtgaagaatagttgtccaagagataagatgtccatcatgtgtatgcctgatgtctaccaaggtcacaagagggtgtcggaaaaacttgcttctctccatggtgagactgggtacggcaaatgtttgatcagtaatcaggaagaaaagtagagttgtatgaagtaacttttgggatttatttctttaatataaagagaaaactttgaattagtcctcgcctctgtcaactccacatcagaaatggaagtaactgggacccccagcagttatagtaacaggaactgtacaatagaaaactttaagaaggaattttaccccatcatatacctgataatatttttctggggagccttgggaaatggcttttccatatatgtctttctacagacttgcaagaagtccacatctgtaaatgttttcatgctcaacctggccacttccgattttctattcatcagcaccttgcccttcagggctgactattatttcagaggttccaattggatatttggggacttggcctgcagagtcatgtcttattccttatatgtcaacatgtatactagcatttatttcctaactgtgctgagtgtggtgcgtttccaggccacagtccaccccttccggatgttccatgtcaccagtgtcaggagtgcctggatcctctgtgggatcatatgggttttcatcatggcttcctcagccctgcttctggtgaacggccaagaggagaaagataacattatatcatgcttggagctgagtcctcaaaagtttaaaagtctcctgatcatgaaccacattgcagtagcggtaggcttcttgctcccatttctcacgctcaccgtctgctacctgctgatcatccggatcttgttaaaggctgagattccagaatcaggtccacgtgctgctcataggaaggcgctgaccaccattgtcattgccatgatcaccttcctcctctgttttctgccataccatgcactgcggaccctccacttggtcacatgggataaagattcatgtggggatgtgctacataaggccacagtcatcacactgaccatggctgcagccaatagctgcttcaatccctttctctattattttgctggggagaatttcaaagctcgattaagggctatattcagcaaagttcatctatagaaattaaagtcaaagtgcagccttcctgtttgtgagtagctgaagaacagaattaagagtataaggagctgttctgcaggcatgctcatgaacattggtgtccaccttcattcactcagagtctccaacttactttatatttgcatcctaaccaacaagttggttcctgacatttaattgaccacaacatttgctaataaagtctatttcac

SEQ ID NO: 1251 - DNA, 1335 bp, Mus musculus
atggatccactgaacctgtcctggtacgatgatgatctggagaggcagaactggagccggcccttcaatgggtccgaagggaaggcagacaggccccactacaactactatgccatgctgctcaccctcctcatctttatcatcgtctttggcaatgtgctggtgtgcatggctgtatcacgagagaaggctttgcagaccaccaccaactacctgatagtcagcctcgctgtggccgatcttctggtggccacactggttatgccctgggtcgtctatctggaggtggtgggtgagtggaaattcagcaggattcactgtgacatctttgtcactctggatgtcatgatgtgcacagcaagcatcttgaacctgtgtgccatcagcatcgacaggtacacagctgtggccatgcctatgttgtataacacacgctacagctccaagcgccgagttactgtcatgatcgccattgtctgggtcctgtccttcaccatctcttgcccactgctctttggactcaacaacacagaccagaatgagtgtatcattgccaaccctgccttcgtggtctactcctccatcgtctcgttctacgtgcccttcatcgtcaccctgctggtctatatcaaaatctacatcgttctccgcaagcgtcggaagcgggtcaacaccaagcgtagcagccgagctttcagagccaacctgaagacaccactcaagggcaactgtacccaccctgaggacatgaaactctgcaccgttatcatgaagtctaatgggagtttcccagtgaacaggcggagaatggatgctgcccgccgagctcaggagctggaaatggagatgctgtcaagcaccagccccccagagaggacccggtatagccccatccctcccagtcaccaccagctcactctccccgatccatcccaccacggtctacatagcaaccctgacagtcctgccaaaccagaaaagaatgggcatgccaagattgtcaatcccaggattgccaagttctttgagatccagaccatgcccaatggcaaaacccggacctcccttaagacgatgagccgcaggaagctctcccagcagaaggagaagaaagccactcagatgcttgccattgttcttggtgtgttcatcatctgctggctgcccttcttcatcacgcacatcctgaatatacactgtgactgcaacatcccaccagtcctctacagcgccttcacatggctgggctatgtcaacagtgccgtgaaccccatcatctataccaccttcaacattgagttccgcaaggccttcatgaagatcctgcactgctga

SEQ ID NO: 1252 - DNA, 1341 bp, Mus musculus
atggcacctctgagccagataagcagccacatcaactccacctgtggggcagaaaactccactggtgtcaaccgggcccgtccacatgcctactacgccctgtcctactgtgcactcatcctggccatcatctttggcaacggtctggtatgtgcagctgtgctgagggagcgagccctacagaccaccaccaactacctagtggtgagcctggctgtggcagacctgctggtggccactttggtgatgccgtgggtggtgtacttggaggtgacaggtggagtctggaatttcagccgcatttgctgtgatgtttttgtcaccctggatgtcatgatgtgtacagccagcatcctgaacctctgtgccatcagcatagacaggtacacagcagtggtcatgccagttcactatcagcatggcaccgggcagagctcctgtcgacgtgtggcgctcatgattacggctgtgtgggtgctggcctttgctgtgtcctgccctctcctctttggtttcaacacaacaggggatcccagcatctgctccatctccaaccctgattttgtcatttactcttcggtggtgtccttctatgttccctttggggtgactgtcctggtctatgccaggatctacatggtcctgaggcaaaggcgaagaaaacggatcctcactagacagaacagccagtgtatcagcatcagacctggcttccctcagcagtcttcctgtctgcggctgcatcccattcggcagttttcaataagggccaggtttctgtcagatgccacgggacaaatggagcacatagaagacaaaccatatccccagaaatgccaggaccctctcttgtcacatctacagcccctctctcctggccagacacatggagagctgaaacgctactacagcatctgccaagacactgccttgaggcatccaaacttcgaaggagggggagggatgagccaagtggagaggactcggaactccttaagccccaccatggcacccaagctcagcttagaggttcgaaaactcagcaatggcaggttatccacatccctgaagctggggcccctacagcctcggggagtaccacttcgagagaagaaggccacccagatggtggtcattgtgctcggggccttcattgtctgttggctgcccttcttcttgactcacgttcttaatacccactgtcaggcatgccacgtgtccccagagctttacagagccacgacatggcttggctacgtgaacagtgccctgaaccctgtgatctacaccaccttcaacatagagttccgcaaagccttcctcaagattctatcctgctga

SEQ ID NO: 1253 - DNA, 1164 bp, Mus musculus
atggggaacagcagcgctactgaggacggtgggctgttggccgggcgtgggccagaatccctggggactggcgccgggcttgggggcgcgggcgcggcggcgctggtggggggcgtgctgctcatcggcttggtgttggcagggaactcgctcgtgtgcgtgagcgtggcctccgagcgcacgctgcagacacccaccaactacttcatcgtgagcctggctgctgccgacctcctcctcgcggtgctggtgctgcctctctttgtctactccgaggtccagggtggcgtgtggctcctgagcccccgtctctgtgacacgctcatggccatggacgtcatgctgtgcaccgcctccatcttcaacctgtgcgccatcagcgtggacaggttcgtggccgtgaccgtgccgctgcgctacaaccagcagggtcagtgccagctgctgctcatcgccgccacgtggctgctgtccgccgcggtggcttcgccagtggtgtgtggcctcaatgatgtgcccggccgcgatccggccgtgtgctgcctggagaaccgagactatgtggtctactcgtccgtctgctccttcttcctgccctgtccgctcatgctactgctttactgggccactttccgcggcctgcggcgctgggaggcagcccggcacaccaaacttcacagccgcgcgccgcgccgacccagcggccccggcccgccggtgtcggaccctactcagggtcccttcttcccagactgcccacctcccttacccagcctccggacgagccccagcgactccagcaggccggagtcagagctctctcagagaccctgcagccccgggtgtctgctcgctgatgcagctctcccgcaacctcctgagccgtcttcccgcagaaggagaggcgccaagatcacgggaagggagcgcaaggcaatgagagtcctgccggtggtagtcggggccttcctggtgtgttggacgcctttcttcgtggtgcacatcacgcgggcgctgtgtccggcttgcttcgtgtctccgcgcctggtcagtgccgtcacctggctaggctatgtcaacagtgccctcaaccccatcatctacaccatcttcaacgcggagtttcgaagtgtcttccgcaagactctccgtctccgctgctga

SEQ ID NO: 1254 - DNA, 1149 bp, Mus musculus
atggtgtccactagcatcccggaggttaaagctctccgcagctcagtctctgactatgggaactatgatatcatagtccggcattacaactacacaggcaagttgaacatcggggcggagaaggaccatggcattaaactgacttcagtggtgttcattctcatctgctgcttcatcatcctagagaatatatttgtcttgctaactatttggaaaaccaagaagttccaccggcccatgtactatttcataggcaacctagccctctcggacctattagcaggcgtggcttacacagctaacctgctgttgtctggggccaccacttacaagctcacacctgcccagtggtttctgcgggaagggagtatgtttgtggctctctctgcatcagtcttcagcctccttgccatcgccattgagcgctacatcaccatgctgaagatgaaactacacaacgggagcaacagctcgcgctcctttctgctgatcagcgcctgctgggtcatctccctcatcctggggggcctgcccatcatgggctggaactgcatcagctcgctgtctagctgctccaccgtgctcccgctctaccacaagcactatattctcttctgcaccaccgtcttcactctgctcctgctttccatcgtcatcctctactgcaggatctactccttggtcaggactcgaagccgccgcctgaccttccgcaagaacatctccaaggccagtcgcagttctgagaagtctctggccttgctgaagacggtgatcattgtcctgagtgtcttcattgcctgctgggcccctctcttcatcctactactgttagatgtgggctgcaaggcgaagacctgtgacatcctgtacaaagcagagtacttcctggttctggctgtgctgaactcaggtaccaaccccatcatctacactctgaccaacaaggagatgcgccgggccttcatccggatcgtatcttgttgcaaatgccccaacggagactctgctggcaaattcaagaggcccatcatcccaggcatggaatttagccgcagcaaatcagacaactcctctcacccccagaaggacgatggggacaacccagagaccattatgtcgtctggaaacgtcaattcttcttcctaa

SEQ ID NO: 1255 - DNA, 3650 bp, Mus musculus
agcacagtgctgccctccgtaggctccgggttgtgctgggtgaggcttgggttgggttggcccggcggctgcgtgaactgcggagctggacctagcaggcttacagttcctcctagcatgaccgagatctgatcagccaacccgcgcattgctttttgtgcctggcactgcagtgcagggggcctcttcatcgccccaaactacagcactgtcatggcagctgcctctacttccagccctgtaatttcacagccccagttcacagccatgaacgaacaacagtgcttctacaatgagtctatcgccttcttttataaccggagtgggaaatatctagccacagaatggaacacagtgagcaagctggtgatgggactgggcatcactgtttgcgtgttcatcatgttggccaatctcctggtcatggtggcaatctacgtcaaccgccgcttccatttccctatttattacttgatggccaacctggctgctgcagacttcttcgctggattggcctacttctacctgatgttcaatacaggacctaatacccggagactgactgttaacacgtggctcctccggcagggcctcattgacaccagcctgacagcttctgtggccaacctgctggctattgctatcgagaggcacatcacggttttccgcatgcagctccatacacgaatgagcaaccggcgcgtggtggtggtgattgtagtcatctggactatggccattgtgatgggtgctatgcccactgtgggctggaactgcatctgtgatatcgatcactgttccaacatggcacccctctacagtgactcctacttagtcttctgggccattttcaacctggtgacctttgtggtcatggtggttctctacgctcacatctttggctatgttcgccagaggactatgaggatgtctcggcatagttctggacccaggaggaatcgggacaccatgatgagccttctgaagactgtggtcattgtgcttggtgcctttattgtctgctggactccgggattggtcttgttattgctggatgtgtgctgcccgcagtgcgatgtcctggcctatgagaagttcttcctcctcctggccgagttcaactctgctatgaaccccatcatctactcctaccgcgacaaagagatgagcgccaccttcaggcagatcctgtgttgccagcgcaacgagaaccctaatggccccacggaaggctctgaccgctctgcctcctccctcaaccacaccattctggctggagttcacagcaacgaccactctgtggtttagaaggaagccagccggcctctgtggatctgtgaaccccaccctaccccccattgccagggcaaggtggggagccagaggagatgaggacactcctgtacttaacactaaccaatggcagtatttgtccctagacccaagagacttgaggatgaatttatttggcaggccccatcttctcctttggaaaacagaaggggaccgtcttgtggtggaattgagaaatggactctggggtgaccgtgtagcattcactaactagacttaaaagattttatgtggtttggcttaagccaggaaaaaaaaatctgctgaattgagtatacaatcgagtatacacaggcttcccctttaaagaacaaacaatacattgcatttattaatgagtatgtttatgcctgacagcatgtttgtgatcgaaaagactgctaaactgacatagatgagttgtttttttttttttgttttttgtttttttttacatgatggaggaaaagtataaattagaatgatttttgtgtttgtttagaaagcaagcatgtggtgtgtgtattcagtatgcctttctttaaagataaaaggccactattttaaatcttctagggaatagaagaatctagtaaaaaccagtattcatttaggctacaggaaaaaccatatcctaatcaattaccttttaattaaagtaatgaaatatacatgaaaggcaaagtaatgtgagcttgtcacccaaagagtgtgtgctctccaaacgctggaggagatgaagctgtagcgttgtccctgcatagtgaagatacccacgtgcgttctcagtgccagaccctcagtgggacttgttttaaagcctgtggttttccaagttagaaaataatacctacttactatagaaaacttgaaaattgcagaactgtgtgaaaaaagaaaaaagaaagaaagattgctgatatacgacctggaagtagccatctttccctgctcacccacgtatgcctatagacatatattatatacctttttttttttttacataatcgggttgatattgtaaaatgttttgtaactttttctttcagaattgccaggtttttctatggcattttttttcaaaaacgttagcggctatataatattccatttaatggatgcagctcagtttatttagtaccattcctgtattgttgactatgcttttggcttttttttcataatattggaagaatcttgtgtatataaaactttgccagtatcattgatgatttacttgggctccattcccatgaaggacctacttttaaaatgtgaaatgtcctcatgtgttgtcactttataaaaagggatattctaccctcaaactgcaggggtgaccatgctgacaaaaagctcagaaattacctttttacaaaagaaacacagtggctactttagttgcgaatgggttcttgacaagatgtttcccaataacccagacccttaacataactagcaaatttactttagtaggaactggtgatccctttctggacacaagaaaacacaaagacatcaagcatcagagtgaatccagcaatgcagtaccaagcagcctgggtggggtgtgctagcaactggctgctgtgtggtctccagcaatcacccaatggacaccctgtgttcagagatgcccagtacagtgtcctggagactaaggtctctaatgtcatgctatgaggaacaaggaggaagaagaatagtcctgaagcaggtgtggagaggtcaggaggacgtctgagagaaggcagtcctgccaagagtggcattctagggaggaggaaggcagggtgtggcttgtgtctggacagtcagtggtaggcatgtgacatttgcctggtggaaaaaaaataagtaggcggagatccagttagcaggacaaagattttgctcgaggattcccccaatccaagaaatttaaactggaaatgagtgaaccgaacttggacttttattgattccccttttatgggggaggtaaggactatttgaattgaaaagcatactaattgaaccttaataaatcattctcaatcagtgtttggcgatgtgtggttctggtctgtgctttttttctattttcgagaagcctctggctgtgctgtgatggcttctctctctgaccttctttaacagtctgaggcagcccaacaactgttcctttagctcagatactggttcctcatccatgagattcatgagagacgtgttacctcaatggaatgagtactagagcaaggtatttagagagattttttttattatttatttatttattttgaataaaatgtatgtaataaataagataaaataaa

SEQ ID NO: 1256 - DNA, 1137 bp, Mus musculus
atggcaaccacgcatgcgcagggccaccagccagtcttgggaaatgacactctccgggaacattacgattacgtggggaaactggcaggcaggctgcgggacccccctgagggtggcaccctcatcaccaccatcctcttcttggtcacctgtagcttcatcgtcttggagaacctgatggttttgattgccatctggaaaaacaataaatttcacaaccgcatgtactttttcatcggcaacttggctctctgcgacctgctggccggcatagcatacaaggtcaatattcttatgtccggcaggaagacgttcagtctgtctccaacagtgtggttcctcagggagggcagtatgttcgtagccctgggcgcatccacctgcagcttactggccattgccattgagcgacacctgaccatgatcaagatgaggccatatgatgccaacaagaagcaccgcgtgttccttctgattgggatgtgctggctaattgccttctcgctgggtgccctgccaatcctgggctggaactgcctggagaactttcccgactgctctaccatcttgcccctctactccaagaaatacatcgccttcctcatcagtatcttcaccgccattctggtgaccatcgtcatcttgtatgcgcgcatctactgcctggtcaagtccagcagccgcagggtggccaaccacaactctgagagatccatggcccttctgcggaccgtagtgattgtggtgagtgtgttcattgcctgttggtccccactttttatcctcttcctcatcgacgtggcctgcagggcaaaggagtgctccatcctcttcaagagtcagtggttcatcatgctggctgtcctcaactcggccatgaaccctgtcatctacacgctggccagcaaagagatgaggcgcgccttcttccggttggtgtgcggctgtctagtcaagggcaaggggacccaggcctcacccatgcagcctgccctcgacccaagcagaagtaagtcaagctccagtaacaacagcagccactctccgaaggtcaaggaagacctgccccgcgtggctacttcttcctgcatcattgacaaaaacaggtcgtttcagaacggggtcctctgcaagtga

SEQ ID NO: 1257 - DNA, 1049 bp, Mus musculus
atgggccagtgctactacaacgagaccatcggctttttctataataacagcggcaaggagctcagccttcactggcgccccaaagatgtggtggtggtggccctggggctgacagtcagtgtgctggtattgctgaccaatctgctggttattgcagccatcgcctccaaccgacgcttccaccagcccatatactacctgcttggcaacttggctgcggctgacctcttcgctggcatggcctacctcttcctcatgttccatactggcccaccgcactgccaggctctccatcaaaggctggttcctgcgacagggcctgctggacaccagcctcacggcgtcagtggccacactgctggcatcgctgtggaacggcaccgcagtgtgatggcggtacagctacacagccgcctgccccggggccgtgtggtcacactcatcgtgggtgtgtgggcggctgcactgggtctggggttgctacctgcacacttctggcactgcctctgtgacttggacagttgctcacgcatggtgcccctgttcagccgctcctacttggctgcgtgggccctatccagcctgcttgtcttcctactcatggtagctgtctacacacgaattttcttctatgtgcgtagacgggtggaacgcatggcggagcacgtcagctgccatccccgctaccgagagaccacactcagcctagtcaagacggttgtcatcattctgggggcatttgtggtgtgctggacaccgggccaggtggtgctgctcctggatggcctggactgtaagacctgcaacgttctggctgtggagaagtacttcctgctcctggctgaggccaactcactggtcaatgcagtggtatattcctgccgagatgctgagatgcgccgcaccttccgccgccttctctgctgcatgtgtctccgctggtccagccacaagtctgcccgttactcagcttctgcccagacgggtgccagcacgcggatcatgcttcctgagaatggccgcccactgatggactccaccctttaadg

SEQ ID NO: 1258 - DNA, 1059 bp, Mus musculus
atgggcggcttatactcagagtacctcaatcctgagaaggttctggaacactacaattacaccaaggagacgctggacatgcaggagaccacctcccgcaaggtggcctcggccttcatcatcatcttgtgctgcgccatcgtggtggagaatcttctggtgctcattgcagtggccaggaacagcaagttccactcagcaatgtacctgttccttggcaacctggcagcctctgacctgctggcaggcgtggccttcgtggccaacaccttactctcagggcatgtcactctgtccttaactcccgtgcagtggtttgcccgagaggtctccgccttcatcacgctctccgcctcggtctttagcctcctggccatcgccatcgagagacaagtggccctcgccaaggtcaagctctacggcagtgacaaaagctgccgaatgctgatgctcatcggggcctcttggctgatatcgctgattctgggtggcttgcccatcctgggctggaattgtctgaaccagctggaggcctgctccaccgtgctgcctctctatgctaagcactacgtgctctgcgtggtcaccatcttctccgtcatcttactggctatcgtggctctgtacgtccgaatctactttgtagtccgctccagccacgcggatgttgctggtcctcagacgctagccctgctcaagacggtcaccatcgtactgggtgttttcatcatctgctggctgccggcttttagcatccttctcttagactccacctgtcccgtccgggcctgccctgtcctctacaaagcccactatttttttgcctttgccacccttaactcactgctcaatcctgtcatctatacgtggcgtagccgggaccttcggagggaggtgctgcggcccctgcagtgctggcggagagggaagggagtgacgggacgcagaggtgggaaccctggtcaccgactcctgcctctccgcagctccagctccctggagagaggcatgcatatgcctacatcaccgacatttctggagggtaacacagtggtctga

SEQ ID NO: 1259 - DNA, 1161 bp, Mus musculus
atgaacatcagtacctggtccacgctggtgaccccagagtcctgccaccggctggcagccagcggccacagcctcctcattgtcctgcactacaatcacagcggcaggctggccagccgcgggggctctgaggacggtggagggctagggatgctgagggggccgtcggtggccgcaggttgcctggtggtgctggagaacgccatggtgctggccgccatcgccatctacatgcggtcccgccgctgggtgtactactgcctgctgaacatcacactgagtgacctgctcacaggcctggcctacgtggtcaacgtgctgctgtcagggactcgtaccttccagctgtcaccggtgcactggttcctgcgggagggcctgctcttcatggccttggccgcatccaccttcagtctgctcttcacggccggcgagcgcttcgccaccatggtgcgggtggctgagagtggggccaccaagaccagccgtgtgtatggctgcatcggtctgtgctggctactggcagctatcctgggcctgctgcccctgctgggctggaactgtgtgtgcgccttcccacgctgctccagcctgctgcccctctactccaagggctatgtgctcttttgtgtggtggtcttcgccctcatcctagtggctatcctgagcctctacggggccatctttagagtggtccgagccaatgggcagaagtctccacgtcctcctgcccgccgcaagtcccgcaggctactcaacaccgtgctgatgatcttggtggcctttgtggtgtgctggggtcccctgtttggcctgctcctggctgacatctttggttctaatgtctgggcccaggagtacctgcgtggcatggactggatcctggccctggccgtgttcaactcagccattaatcctctcatctactccttccgcagccgtgaggtgcagcgcgctgtgctggccttcctgtgctgcggctgtctctggctaggtctgcgaggtccaggagactgcctgacccggatcaccgaggcccactccggtgcatccaccactgacagctccctgaggcccagggacagttttcggacttctcggtcactcagcttcaggatgagagagccgctgtccagcatttccagcgtccgcagcacctag

SEQ ID NO: 1260 - DNA, 1065 bp, Mus musculus
atgaatgagtgtcactatgacaagcgcatggactttttctacaacaggagcaacacagacacagcggacgagtggacagggacaaagcttgtgatcgtcctgtgcgtggggacgttcttctgcctctttatatttttttctaactccctggtcattgctgcggtgatcacaaaccggaagttccactttcccttctactacctgctggctaacttagctgctgcggatttcttcgccggaatcgcttacgtgttcctgatgtttaacactggcccggtgtcgaaaacgttgaccgtcaaccgctggttcctccgccaggggctcctagacaccagcctgactgcctccctggccaatttgctggttattgctgtggaaagacacatgtccatcatgaggatgagagtccacagcaacttgaccaaaaagcgggtgacgctgctcattctgctggtgtgggccatcgccatcttcatgggggccgtccccacgctgggatggaattgcctctgcaacatctcggcctgctcttctctggctcccatttacagtaggagttacctcattttctggactgtgtccaacctcctggccttcttcatcatggtggcggtatacgtacgcatctacatgtatgttaaaaggaaaaccaacgtcttatctccacacaccagtggctccatcagccgccggagggctcccatgaagctaatgaagacagtgatgaccgtcttaggcgccttcgtggtgtgctggaccccgggtctggtggttctgctgctggacggcctgaactgcaagcagtgtaacgtgcaacacgtgaagcgctggttcctgctgctcgcactgctcaactccgtcatgaaccccatcatctactcgtacaaggacgaggacatgtacaacacaatgcggaagatgatctgctgtgccctgcaggacagcaataccgagaggcgcccctcccgcaacccctccaccatccacagcaggagcgagacgggcagccagtacctggaggacagcatcagccagggcccggtgtgcaataaaaacggctcctaa

SEQ ID NO: 1261 - DNA, 2437 bp, Mus musculus
cgataaccttgaagtcctgatcctccgctggcaattgctggggaaccggtgtacaccaaatgcccagcttactccccccagatttccaatagccgctctcctgtgtctgcttctggagtgccggttacaggagacttttgcacagtgctccagtggacgaccggcaggacacagcagcgacatctccgcggcgggcggcgggcagcccatggagcccgggctgctgcggccggcgccggtgagtgaggttattgtccttcactacaactacaccggcaagctccgcggggcgcgctaccagcccggcgccggcctgcgcgcagacgccgcagtgtgtctggctgtgtgtgccttcattgtgctggagaacttggctgtgctcttggtgctggtccgccaccctcgcttccatgcgcccatgtttctgctccttggcagcctcactttgtcggacctgctcgccggggcggcctacgccaccaacatcctactgtccgggccgctcacgctgcgcctgtcgcctgcgctttggtttgcgcgtgaggggggcgtcttcgtggcgctcgccgcgtcggtgctgagcctcttggccattgctttagagcgccaccttaccatggcccgtcgtggacccgcacccgccgccagtcgcgctcgcacgctggcaatggcggtggccgcctggggcgcgtcgctattgctcgggctgctacccgcgctgggctggaactgcttaggacgcctggaaacctgctccaccgtgctgccgctctacgccaaggcctatgtgctcttctgcgtgctggccttcctgggcatcctggctgccatctgtgcgctctatgcaaggatttactgtcaggtgcgggccaacgcgcgtcgcctgcgggcgggtcctgggtcccgcagggccacctcgtcctcgcgatcccggcacacgccgcggtcgctggccctgcttcgtacccttagcgtggtgctcctggccttcgtggcctgctggggaccgctgtttctcttgctattactggatgtcgcgtgcccagcccgcgcgtgtcccgtgctcctgcaggccgatcccttcctgggtctagccatggctaactcgctgctgaatcccatcatctacaccttcaccaaccgagatctgcgccacgcgctcctgcggctgctctgctgtggccgcggaccctgcaaccaagactcctccaacagcttgcagcgatcccccagtgctgccgggccttccggtggtggcctgcgacgctgcctgccaccaaccttggatcgcagctctagcccatcagaacacttgtctccccagcaggacggggtggacaccagctgctccaccggcagtcctggagtagcaaccgccaaccggagcctggtgcctactgctacagactgacgcttcccaaccctttgcaagaacagactgactcgccaaataagcgcatcatctgtaggaaatagccagcgacggagggggacatacaagaaagaagggaaagtgattgatcaccccataacaagaacagacaaaaatgcactcgggatctgagatggacaataagggaaagaagaaagtgatgagaaggtatccaggtagtggaacctaagctgggaagccctgaaggagagccattccatatggctgcagcagaaattgaggagcaggagatgaaagggcaggttgtggggaagtcttgttggttctgaggaagtccttaggtttggctctgagtgaagtgggagccatagagaattctaaacaaaggagggactctcctggattcagacctccacaggtaccctgtgactaccaaagttcaaggggaatggctaaaagatgaagggataaaggagagcggggctccaagaatgctcagaaccaggtgatgtctagataagagtgtgctaagggctggcaggagtagtggctggctacagaggaaacagagctgtggacaaaggtaagcctaggtctggaaatttggctctggagactgtcagatatcagctgccaaacttccagagtgtggacaggttcttcatacaaattacaaccacaataaaaacaattcaaggagttgtccttactgggatctttcagaatctattcattcatctattgattttttttttaattttcccccagaaagttgtaactatcctctttaaaagtgtttatttattggggttggagagatggctcagcagttaagaacacttgttacccttgcaggggacctgtgttccattcccagcacccaagtggtgattctggcaacttcagttccaaggttatctgatgccctcatctgacctctgagggcaccaggcatgcacatggtacaaagattgaatgcaggcaaaactctcatacaaacaagctaaataaatcttttaaaatgttaaaaaaaaaaaaaaaaaa

SEQ ID NO: 1262 - DNA, 2696 bp, Mus musculus
gtctaggagcctgtggagtctaaggaagatcgcgggaggcgtgttcctccggagtttgcttttccttgggagcctcgcgcgcacacccatcccttctagtctggcaactgtgtctaggaggtggggagcctctctctgatccaccggaccatcgctggagcttgcaggctgagcaagatctccccctagagaagcctggctgtccggggaagtttccccgagctgagactgtgctgcagccctggtcacccgccaccctgcgcgccaccctcgttctccagctcaggctccggctggcccgtgcgcggacctggagctgtctgcttccgaggagctctaaggtgaaaaaaagaaaggcgtgagaccaacataagaagacttaaaatccaggttaagatgagtatcttttgccttgcggcatacttttggctgaccatggtgggaggcgtaatggctgacaatccggagagatacagcgctaatctaagcagccacatggaagacttcaccccttttccggggacggagatcaactttctgggcaccacccatcgaccccctaatttggccctgcctagcaatggctcaatgcacggctattgcccacagcagactaaaatcacgacagctttcaaatatattaacactgtgatatcctgcaccattttcatcgtgggaatggtggggaacgcaactctactacgaatcatttaccaaaacaagtgtatgaggaacggccccaatgcgctcatagccagcctggcccttggagaccttatctacgtggtcattgacctccccatcaacgtgtttaagctcttggcaggacgctggcctttcgaccacaatgattttggagtgtttctctgcaagctgttccccttcctgcagaagtcctccgtgggcatcaccgtcttgaacctctgtgctctcagtgtggacaggtacagagcagtggcttcctggagccgagttcaaggaatcgggatccccttgattaccgccattgaaatcgtctccatctggattctttccttcatcttggccatcccggaagcaatcggcttcgtcatggtacccttcgaatacaagggcgagctgcataggacctgcatgctcaacgccacgtccaagttcatggagttttaccaagatgtgaaggactggtggctctttgggttctacttctgcatgcccttggtgtgcacagcaatcttctacaccctcatgacctgtgagatgctcaacaggaggaacggcagcttgcggatcgcccttagtgagcacctcaaacagcgtcgagaagtggcaaagactgtcttctgcttggttgtcatcttcgccctgtgctggttccctcttcacttaagccgcattttgaagaaaactgtatatgatgagatggataagaaccggtgtgaactgctcagcttcttgctgctaatggattacatcggcattaacctggcaaccatgaattcttgcataaacccaatagctctatattttgtgagcaagaaattcaaaaattgttttcagtcctgcctctgttgctgttgtcaccagtccaaaagcctcatgacctcggtccccatgaatggaacgagtatccagtggaagaaccaagagcagaacaaccacaacacggaacggagcagccacaaggacagcatgaactaaccctccgcagaaacaccgagacgtgtgccttcaagtcctaggatggaaacaaccattacgccacagatgcgctcccaaaacctcccaagtctctcccatgctccttttctaagtccatcctaggaaaagctctcctgccctcccaacagcacgtggtggaccggtcccagctatagccaatgggtctttcctgagtactgtatatgatttgcataccgcgcatgtcatttccaacacttgaaaattagagctgggagaaaggagatgatggttcaaagaagccacctagctgccgcctttgcatgaacacagagtttgcaagttcatgaccagcttccgtgcagttctatggaccagctggtgggaactgtccatcctaagattctagagcagtgggtctcaaccttcccaatgctgcagccccttaatacagttcttcattttccagtgaccccccccaaccacaatattattttttgttgctacttcaattattttgaattgttataattgtctgatatttctgatagtcttagcctgcccctgttaaagggtcattagcaacccacaagttgagaaccactgccctagaaattctgttgcgtttcatggcccatgactacaatcctaaaattggagaggtgagggaagatggtcaggtgttcaaggttagcctcatcaacatagttcggaaaagccagggctacctgttctcacaagacacaaacagacaaaaagtgtttcaaagttatggcagattcattattattaattattattatcttatagccaaacacattgtgaggttaaagtactcttttggaaatgtcaccgagtgttggtactttataactgcatggtaccctagaaatgatcgtttcatcttctttcaatgtactctgaagaaaagaaataggagagttccagaagggagatctggaaaggagataatgtttgaaatgtaaagaaggaaaatatccaataaaaaaattcaaagtctaaaaaaaaaaaaaaaa

SEQ ID NO: 1263 - DNA, 1329 bp, Mus musculus
atgcaatcgcccgcaagccggtgcggacgcgccttggtggcgctgctgctggcctgtggcttcttgggggtatggggagagaaaagaggattcccacctgcccaagccacgctgtcacttctcgggactaaagaggtaatgacgccacccactaagacctcctggaccagaggttccaactccagtctgatgcgttcctccgcacctgcggaggtgaccaaaggagggaggggggctggagtcccgccaagatccttccctcctccgtgccaacgaaatattgagatcagcaagacttttaaatacatcaacacgattgtgtcgtgcctcgtgttcgtgctaggcatcatcgggaactccacgctgctaagaatcatctacaagaacaagtgcatgcgcaatggtcccaatatcttgatcgccagtctggctctgggagacctactgcacatcatcatagacatacccattaacacctacaagttgctcgcagaggactggccatttggagctgagatgtgtaagctggtgcccttcatacagaaggcttctgtgggaatcacagtgctgagtctttgtgctctaagtattgacagatatcgagctgttgcttcttggagtcgaattaaaggaattggggttccaaaatggacagcagtagaaattgttttaatttgggtggtctctgtggttctggctgtccccgaagccataggttttgatatgattacgtcggactacaaaggaaagcccctaagggtctgcatgcttaatccctttcagaaaacagccttcatgcagttttacaagacagccaaagattggtggctgttcagtttctacttctgcttgccgctagccatcactgcagtcttttataccctgatgacctgcgaaatgctcaggaagaagagcggtatgcagattgctttgaatgatcacttaaagcagagacgagaagtggccaagacagtcttctgcctggtcctcgtgtttgctctctgttggcttccccttcacctcagccggatcctgaagctcaccctgtatgaccagagcaatccacacaggtgtgagcttctgagctttttgttggttttggactacattggtatcaacatggcttctttgaactcctgcatcaatccaatcgctctgtatttggtgagcaaaagattcaaaaactgctttaagtcatgtttgtgctgctggtgccaaacgtttgaggaaaagcagtccttggaggagaagcagtcctgcctgaagttcaaagccaacgatcacggatatgacaacttccggtccagcaataaatacagctcgtcttga

SEQ ID NO: 1264 - DNA, 2796 bp, Mus musculus
atgtggggcttttggctgctcctcttctggggcttcagtgggatgtacagatgggggatgaccacacttcccaccctgggacaaacacttggtggtgtgaatgagtgtcaagatactaccacttgcccagcttatgccacctgcactgacaccacagacagttattactgcacctgtaaacgaggcttcctgtccagcaatggacaaaccaactttcaaggcccaggagtggaatgtcaagatgttaacgaatgtcttcaaagtgactcaccttgtggtcctaactcagtctgcaccaatatcctggggagagccaagtgcagctgtcttagaggcttctcttcttccactgggaaagactggattctgggaagtttggataattttctctgcgcagatgttgatgagtgtctgacaattgggatctgccctaagtattccaactgctctaactctgtgggaagctacagctgtacctgtcaaccaggctttgtcttgaatggctccatttgtgaagatgaagatgaatgtgtgactcgagacgtttgccctgaacatgcaacctgccacaacactctcggaagctattattgtacgtgcaactcaggacttgaatctagtggaggagggccaatgttccagggcctggacgaatcctgtgaagatgtggatgagtgctccaggaattcaactctctgtggtcccaccttcatttgcatcaacactctgggatcctacagctgctcatgcccagctggattctctttgccaacttttcagatccttggccatccggcagatgggaattgtacagatatcgatgagtgtgatgacacatgtcctttgaattcatcatgtaccaacactattgggagctacttctgcacttgccaccctggctttgcatctagcaatggacagctgaatttcaaagacctagaggtgacatgtgaagatattgatgagtgcacccaagatccattacaatgtggactgaattctgtctgcaccaatgtaccaggctcctacatctgtggctgcctccctgactttcaaatggatccagaaggctcccaaggatatggaaacttcaactgcaaaaggatcctcttcaagtgtaaggaagacttgatactccaaagtgagcagatacagcaatgccaagcagtgcagggcagggatcttggttatgcttccttctgtacacttgtgaatgctaccttcacaatccttgataatacctgtgagaacaaaagtgccccagtgtccttacagagtgcagctacaagtgtctccctcgtgctggagcaagcgaccacatggtttgagctcagcaaggaggagacatccactctgggcaccatcttgctggagactgtggaaagcaccatgttagctgctcttctgataccctctgggaatgccagtcagatgattcagacggagtacctagacatcgaaagcaaagtcatcaatgaagagtgcaaggagaatgagtccattaacttggcagccagaggggacaagatgaatgttggctgtttcataatcaaagaatcagtatctacaggggccccaggagtggcttttgtctcatttgcacacatggaatcagttttaaatgaacgcttctttgaagatggccagtccttccggaagctgaggatgaattcccgtgttgttggtggcactgtgaccggggagaagaaggaggacttctccaagcctattatctataccctccagcacatccagccaaagcagaagtctgagaggcctatctgtgtctcctggaacactgatgtggaggatgggagatggacaccctcgggctgtgagattgtggaagcatccgagacacacacagtctgcagctgtaaccggatggcaaacttggctatcatcatggcttctggggagcttacgatggaattctccttgtatatcatcagccatgtgggtacagtcatctccctggtatgtcttgccttggccatagccaccttcctgctgtgtcgtgctgttcagaaccacaatacctacatgcacctgcatctttgtgtgtgtctcttcttggccaagattctcttcctcaccggtatagacaagactgacaaccagacggcttgtgccatcattgcgggattcctacactatcttttcctcgcctgcttcttctggatgctagtggaggcagtgatgctcttcctgatggtgagaaacctgaaggtggtgaattatttcagctctcgcaacatcaagatgctgcacctctgtgcctttggctatgggcttccagtcctggtggtcataatctctgcttctgtacagccacggggctatgggatgcataatcgctgctggttgaatacagagacggggtttatctggagtttcctggggcctgtctgcatgatcatcacgataaactctgtcctccttgcctggacactgtgggttctgaggcagaagctctgcagtgtcagctcagaagtctctaaactcaaggacacgaggttgctgaccttcaaggccattgcccagattttcatcttgggctgctcctgggtgctgggcattttccagattggccccttggcaagcatcatggcatacctgttcaccattatcaacagtctgcagggggctttcatcttcctcattcactgtctgctcaaccgtcaggtacgggatgaatataagaaactcctcaccaggaagactgaccttagctcccattcccagacttctgggattttactgtcatctatgccatccacttccaagatgggttaa

SEQ ID NO: 1265 - DNA, 2196 bp, Mus musculus
gtgggtttctccactttgctgaattgttcctacacacaaaactgcagcaagacaacgtgtctccccaatgccaagtgcgaagtgcacaatggtgtggaagcctgcttctgcagccaggggtactctgggaatggcgtcacgatttgtgaagatatagatgagtgcagcgagtcttctgtctgcggtgatcatgctgtgtgtgaaaacgtgaacgggggcttcagctgcttctgcagggaaggttatcagaccgctacggggaagtcacagttcacacctaatgatggctcttactgccaagatatagatgagtgcagcgagtcttctgtctgcggtgatcatgctgtgtgtgaaaacgtgaacgggggcttcagctgcttctgcagggaaggttatcagaccgccacggggaagtcacagttcacacctaatgatggctcttactgccaagaaagcatgaattcaaattgccacttagagcatgcctgcatcgctgcaaacattaataaaactttaaaaagaattggacccataacagaacagacaactttactccaagaaatctacagaaattctgaggctgagctctctctgatggatatagtcacatacatagagatcctaactgaatcatcctcactactaggccacccgaacagcaccacttcatacaaggatgcccacttcaactcaactcttactgaatttggggaaaccatcaataattttgttgaaaggagtacacataaaatgtgggaccagttaccgacaaatcacagaagacttcatctcacaaaactgatgcacactgctgagctagtcaccttacagatcgctcagaacacccagaagaattctcagtttgatatgaattctactgacttggctctcaaggtttttgcttttgattcaactcacatgaagcatgctcacccccacatgaatgtggatggaggctatgtgaaaatatccccaaggagaaaggctgcacatggcacaacaggcaatgtagtagttgcattcctctgctataagagcattggtcccttgctatcctcatctgacaacttcttactggacactcaaaatgataattctgaaggaaaggaaaaagtcatttcttcagtgatttctgcctcaattagctcaaatccacccacattatatgaacttgaaaaaattacatttacactaagtcatgtaaagctctcagataagcaccggacccagtgtgccttttggaactactcagttgatgccatgaacaatggcagctggtcaacggagggctgtgagctgacacactcaaacgacacccacacctcctgccgctgtagtcacctgacacactttgcgattttgatgtcctctacttcttccattgggattaaggattataatatcctgacgaggatcactcaactcgggataatcatctccctgatctgcctcgccatctgcatcttcaccttctggttcttcagtgaaatccaaagcaccaggaccacgattcacaagaacctgtgctgcagcctctttcttgcagaacttgtttttcttattgggatcaacataaatacgaataagttggtctgctctatcattgctggcctgctccattacttcttcttagctgcctttgcctggatgtgcatcgaaggcattcacctatacctcatcgttgtcggcgtcatctacaacaaggggtttttacacaagaacttttatatctttggctatctcagcccagctgtagttgttggattctcagcatctttaggatacagatattatggaaccacgaaagtgtgttggctgagcactgaaaacaacttcatttggagctttataggaccagcgtgtctaatcattcttgtgaatctcttggcttttggagttatcatatacaaagttttccgccacactgctggactgaaaccagaagttagttgctatgagaacataaggtcttgtgccagaggtgccctagccctcctcttccttctgggtaccacctggatctttggggttctccatgtagtgcatgcatctgttgtgacagcctacctcttcacagtcagcaatgctttccaagggatgttcattttcttattcctatgcgttttgtctagaaagattcaagaggaatattatagattgttcaaaaatgtcccctgctgctttggatgtttaaga

SEQ ID NO: 1266 - DNA, 3313 bp, Mus musculus
gctactcagaaagaagtaggcgacggcgggcgccgggccgcgcgggcagccttgggacaatggggccccggcgcttgctgatcgtcgccctcggcctcagcctgtgcggtcccttgctgtcttcccgcgtccctatgagccagccagaatcagagaggacagatgctacggtgaacccccgctcattctttctaaggaatcccagtgaaaatacatttgaactggtccccctgggggatgaggaggaggaggagaaaaatgaaagcgtcctgctggagggtagggcagtctacttaaatataagcctccctcctcacacgccgcctcctcccttcatctccgaggacgcctccggatatctgaccagcccctggctgacgctcttcatgccctccgtgtacacgattgtgttcattgtcagccttcctctgaacgtcctggccatcgcagtgttcgtcttgaggatgaaggtcaagaagccggccgtggtgtacatgctgcacctggccatggccgacgtgctcttcgtgtcggtgctccccttcaagatcagctactacttctccggcactgattggcagttcgggtctggaatgtgccgcttcgccaccgcagcgttttacgggaacatgtacgcctccatcatgctcatgacggtcataagcattgaccggttcctggcggtggtgtatccgatccagtccctgtcctggcgcactctgggccgagccaacttcacttgcgtggtcatttgggtgatggccatcatgggggtggtgccccttctcctcaaggagcagaccacccgagttccgggactcaacatcaccacctgccacgacgtcctcagtgagaacctgatgcaaggcttttactcgtactacttctcggccttctccgccatcttctttcttgtgccgttgatcgtttccacggtctgctacacgtccatcatccggtgcctgagctcctccgcggttgccaaccggagcaagaagtcgcgggctttgttcctgtctgccgcggtgttctgcatcttcatcgtctgctttgggcccaccaacgtcctcctgattgtgcactaccttttcctctccgacagtcctggtacagaggcagcctactttgcttacctcctctgcgtctgtgtgagcagcgtgagctgctgcatcgatccgttgatttactactacgcctcctccgagtgccagaggcacctctacagcatcttgtgctgcaaagaaagctctgatcccaacagttgcaacagcaccggccagctgatgccgagtaaaatggatacctgctctagtcacctgaataacagcatatacaaaaagctattagcttagggaaagggttgctggaaggttccatgagaaaaggttggaaagccgacagcggggaatcccattagtccctgcaaagaactgtatttacttcgaaacctaaaaaacaaccaatatccgatatgcacgaatacttctgctatcaagagtctagattggataattaccagcaaggtgacgggaacggaaataaaggtgtccagtgttgctagtgctatgatagtaactggatgtcacttcttatatatctaggtgactttaatatatagatggtatgcacacactcatttgtcatgcaggagggaatctgtgctttgacacatttttgtttattccctggccgttactatggaaataatctgattctctgacttaataaacaaagtctgagttggtgggtgttagcactgggcagctggagatcctaatgatagggtaggagtccgtagtttagacttaacacagcttttgcctatattttttttcaaattatttgataataatggttagtgatggaaggatgagacagtattacctgtgtaggggaagctctaatacttttcatcttgaacataccgtagttttaagaattatcaaggctgttggaaaacccgttttgatatgggtagcatttttttttaacttgcaatttacttactgaatacatggaccaagactgagcataagacccaccaggactgtaataaaccttacaaagcagccaagcctagacacagccatctgcatggaggcctctgagcaccaggtacatcacaccccttcggctatgcctcccagagagcagagatggatgggaagcaccaggcccaccccatcctgctaggattctcattagctgtgagctgactgtgtcttttagaaattggcaaggtaaggtatgccatcttgggaggcagtaactatgaaagactgacgagaggagaaaggtgtgtttacatccagtagctgtcctgcaaggctggcccttgcacagacagacacacccacatgccctggtcacactgttggatagtgggccatagactgactataggagaataaccgagtcctgtccttactcaggcaacgcagagagctgtcatgtggtcagctatgatgcacatagaacttgtcttcagctggatgtgaccaagtgtatttcacataagcaaggcctatcagctaaactgctttgcatatctgagtttctgcttccagtagctatagattaggataaaaacacagtataagatgtatatttttaatacatatgcccttcagcctacaaaattacacactatttatttacaaatgttttttcaaaaattactcaaatcagccaggcattatggtatacacctttaatcccagaacttgggaggcagaggcaggcagatcttaaacaatttttttttttaagaaacaagcaaacacaaaaagttttacttaagtccaattttaagaaatatataggtcagtttggttaaaaataatagtaatgaaaggaaatttcattgattgaaatttattctgtatttttcttgagttattgagattatttgtaaagcatttttaatgccacagtgactaacaagcatataaaatcttcatacctttgacaaaataatttgaaaattaatttaaaacatatcctttttctgatgaaaaaatatgttggcattttaagcaaataagagtagaaaggttgtttatttaagagaacaaagtatttccaaatactgtagagtcgcttccacgaaagtcctatggttgtatggttaacttggttccggtgttggctgatctcaattactgactccctgtcccgtgttctgtctgtgacttaatgtaactgttatcaccgcgcttgtgaccttttacgtcattgttttgtgttcaccctcttttttaaaaaaaaatatattaataaactaaaaccatgcttggaaaaaaaaaaaaaaaaa

SEQ ID NO: 1267 - DNA, 1200 bp, Mus musculus
atgcgaagtctcagcctggcgtggctgctgggaggtatcacccttctggcggcctcggtctcctgcagccggaccgagaaccttgcaccgggacgcaacaacagtaaaggaagaagtcttattggcagattagaaacccagcctccaatcactgggaaaggggttccggtagaaccaggcttttccatcgatgagttctctgcgtccatcctcaccgggaagctgaccacggtctttcttccggtcgtctacattattgtgtttgtgattggtttgcccagtaatggcatggccctctggatcttccttttccgaacgaagaagaaacaccccgccgtgatttacatggccaacctggccttggccgacctcctctctgtcatctggttccccctgaagatctcctaccacctacatggcaacaactgggtctacggggaggccctgtgcaaggtgctcattggctttttctatggtaacatgtattgctccatcctcttcatgacctgcctcagcgtgcagaggtactgggtgatcgtgaaccccatgggacaccccaggaagaaggcaaacatcgccgttggcgtctccttggcaatctggctcctgatttttctggtcaccatccctttgtatgtcatgaagcagaccatctacattccagcattgaacatcaccacctgtcacgatgtgctgcctgaggaggtattggtgggggacatgttcaattacttcctctcactggccattggagtcttcctgttcccggccctccttactgcatctgcctacgtgctcatgatcaagacgctccgctcttctgctatggatgaacactcagagaagaaaaggcagagggctatccgactcatcatcaccgtgctggccatgtacttcatctgctttgctcctagcaaccttctgctcgtagtgcattatttcctaatcaaaacccagaggcagagccacgtctacgccctctaccttgtcgccctctgcctgtcgaccctcaacagctgcatagacccctttgtctattactttgtctcaaaagatttcagggatcacgccagaaacgcgctcctctgccgaagtgtccgcactgtgaatcgcatgcaaatctcgctcagctccaacaagttctccaggaagtccggctcctactcttcaagctcaaccagtgttaaaacctcctactga

SEQ ID NO: 1268 - DNA, 1110 bp, Mus musculus
atgaaaatccttatcttggttgcagctgggctgctgtttctgccagtcactgtttgccaaagtggcataaatgtttcagacaactcagcaaagccaaccttaactattaagagttttaatgggggtccccaaaatacctttgaagaattcccactttctgacatagagggctggacaggagccaccacaactataaaagcggagtgtcccgaggacagtatttcaactctccacgtgaataatgctaccataggatacctgagaagttccttaagtacccaagtgatacctgccatctatatcctgctgtttgtggttggtgtaccatccaacatcgtgaccctgtggaaactctccttaaggaccaaatccatcagtctggtcatctttcacaccaacctggccatcgcagatctccttttctgtgtcacactgccatttaagatcgcctaccatctcaatggcaacaactgggtatttggcgaggtcatgtgccggatcaccacggtcgttttctacggcaacatgtactgcgctatcctgatcctcacttgcatgggcatcaaccgctacctggccacggctcaccctttcacataccagaagctgcccaaacgcagcttctccttgctcatgtgtggcatagtgtgggtcatggttttcttatacatgctgccctttgtcatcctgaagcaggagtaccacctcgtccactcagagatcaccacctgccacgatgtcgtcgacgcgtgcgagtccccatcatccttccgattctactacttcgtctccttagcattctttgggttcctcatcccgtttgtgatcatcatcttctgttacacgactctcatccacaaacttaaatcaaaggatcggatatggctgggctacatcaaggccgtcctcctcatccttgtgattttcacaatttgctttgcccccaccaacatcatactcgtaatccaccatgccaactactactaccacaataccgacagcttgtactttatgtatcttattgctctgtgcctggggagcctgaatagctgcctagatccattcctttactttgtcatgtcgaaagttgtagatcagcttaatccttag

SEQ ID NO: 1269 - DNA, 1191 bp, Mus musculus
atgtgctggccgctgctgtatcctttggtgctggggctcagcatcagcctggcagagggcatccagacccccagcatctacgatgatgtagagagtaccaggggaagccatgaaggccctctgggtcccacagtagaactcaaggagccgaagtcctcagacaagcctaatccacgaggctacccgggcaaattctgtgccaacgacagtgacacgctggagctcccggccagctctcaagcactgctgctggggtgggtatccacaaggctggtacctgccctctatgggcttgtggtggctgtggggctgcctgccaatgggctggcgctgtgggtgctggccacaagggtgccacgcctgccatccaccattctgctcacgaacctggcagtggctgattcgctgttggccctggtgccgccaccacgactggcttaccacttgcgtggccagcgctggccatttggtgaggctgcctgccgggtggccacagctgccctctatggccacatgtatggttcagtgttgctgctggctgcagtcagcttggacagatacctggccctggtgcatcctttgcgggcccgtgcactgcgtggtcaacgcctcactactggactctgtttggtggcctggctctctgcagccaccctggccttgcctctcactctgcatcggcagaccttccgattagctggctccgatcgcatgctgtgtcatgatgcgctgcccctgactgagcagacctcccactggagaccggccttcatctgcctggctgtcctgggctgcttcgtgccactgctggccatgggcctgtgctatggagccacccttcgtgcactggcggccaatggccagcgctacagccatgcactcagactgacagccctggtactgttctcggcagtggcctctttcacacctagcaatgtgctgctggtgctgcactattcaaacccgagccctgaggcctggggcaatctctatggagcctatgtgcccagcctggcactcagcaccctcaacagctgcgtagaccctttcatctactactatgtgtcccatgagttcagggagaaggtacgcgctatgttgtgtcgccagccggaggccagcagctcctctcaggcctccagggaggctggaagccgagggactgccatttgctcctctacacttctgtga

SEQ ID NO: 1270 - DNA, 1008 bp, Mus musculus
atgactgataattttacatgtaacaagacagatggagacaatacagatttccggtacttcatttatgcagtgacatacactgttattcttgtgccaggtcttatagggaacatattagccttatgggtattttacggctatatgaaagaaaccaaaagggctgtggtatttatgataaacctagccattgctgacttattacagattctctctctgccactgaggatcttttactacttgaaccatgactggccatttggtcctggtctctgcatgttttgtttctacctgaaatatgtaaacatgtatgccagcatctacttcttggtctgcatcagtgtgcgaagattttggtttctcatgtacccctttcgtttcaatgactgcaaacagaaatatgacttgtatatcagcattattggctggctgatcatctgccttgcctgcctgctctttcctctcctcagaaccaatgatgatactccaggtaacagaaccaaatgctttgtggatcttcctatcaggaatgttaatctggcccaatctgttgccatgataactatcggagaggtggttgggtttgttactcctcttatgattgttttatactgtacctggaagacagctttgtcattacaaaataaatatcccatttctcaacatcttggagagaaaaagaaagccctgaagatgattctgacctgtgcaggggtgtttctagtttgctttgtaccttatcacttcagctttcctttagatttcctggttaagtccaatgaaattaagagttgctttgccagaagagtgattctaatatttcattctgtggccctgtgtctggcaagcctgaactcctgtcttgacccagttatatattattttaccactaatgagttcagaagacgcctttcaagacaagatttgcctgataacatccaactccatacaaaatcatacaaaattgcaagtaaccatgccacttctaccgtggcagctgaactatgttaa

SEQ ID NO: 1271 - DNA, 1095 bp, Mus musculus
atggacaccaacatgtctctcctcatgaacaagtctgcagtgaacctcatgaatgtatctgggagtactcaatcagtatctgctggctacatcgttctggatgtcttctcatatttgatctttgccgtcacatttgtccttggggttctgggcaacgggctcgtgatctgggtggctggtttccgcatgaaacacactgtcaccaccatctcttacttgaacttggccattgctgacttttgcttcacttccactttgccattttacattgccagcatggtcatgggaggacattggccatttggttggttcatgtgcaaattcatatatactgtaatagacataaacctatttggaagtgtcttcctgattgccctcattgcactggaccgctgtatttgtgttctgcatccagtctgggctcagaaccaccgcactgtgagcctagccaagaaggtaatcatcgtaccctggatttgtgcatttcttcttacattgccagttatcattcgtttgaccacagtccctaatagtagacttggaccagggaaaacagcctgtactttcgacttctccccctggaccaaagatcctgtagagaagaggaaggtggccgtcaccatgctcactgtcagaggaatcatcaggttcatcattgggttcagcactcccatgtccattgttgccatttgctatgggttaataaccactaaaattcacaggcagggcctgatcaaatccagccgtcctttgcgggttctctcctttgttgtggctgcctttttcctctgctggtgcccatttcaagtagtggccctcatatccacaatccaagtccgtgaacggttgaagaacatgactccaggcattgtaactgctttgaaaatcacaagccccttggctttcttcaacagctgcctcaatccaatgctttatgtctttatgggccaggacttcagagaaagactaatccactctttacctgccagcctagagagggccctgactgaggactcagctcagaccagtgatacaggcaccaatttggggaccaactctacttccctttctgaaaacactttaaatgcaatgtaa

SEQ ID NO: 1272 - DNA, 2079 bp, Mus musculus
atggccttgctcctggtctccttgctggcattcttgggctcgggatctggatgtcatcactggctgtgtcattgctctaacagggtcttcctctgccaagatagcaaggtgaccgagattccgcccgacctcccccggaacgccattgaactgagatttgtgctcaccaagcttcgagtcattccaaaaggatcattttctggatttggggacctggagaaaatagagatctctcagaatgatgtcttggaggtaatagaggcagatgtgttctccaacctacccaacttgcatgaaattaggattgaaaaggctaacaatctgctgtacatcaaccctgaggccttccagaatcttcccagtctccgatatctgttaatatccaacacaggcattaaacacttgccagcctttcacaagatccagtctctccaaaaggttttattagacattcaagataacataaacatccacatcattgccaggaactccttcatgggactgagctttgaaagtgtaattctatggctgaataagaatgggattcaagaaatacacaactgtgcattcaacggaacccagctagatgaactgaatctaagcgataacaataatttggaagaattgcctgatgatgttttccagggagcctctgggccagtcgttttagacatctcaaggacaaaggtctattccctgcccaaccatggcttagaaaatctgaagaagttgagggccaggtcaacataccgcttgaaaaagctccctagtctagacaagtttgtcatgctcattgaggccagccttacctaccccagtcactgctgtgcctttgcaaactggaggcggcaaacctctgaacttcatccaatttgcaacaagtctatttcaaggcaagatattgatgatatgactcagcctggggatcagagagtctctctcgtagatgatgaacccagttatggaaaaggatctgacatgttgtatagtgaatttgactatgacttatgcaatgaatttgttgatgtgacctgctcgccaaagccagatgcatttaatccatgtgaagacatcatggggtacaacatcctcagagtcttgatatggtttatcagcatcctggccatcactgggaacaccacagtgctggtggtcctgaccacaagccaatacaaactcactgtgccccggttccttatgtgtaacctcgcctttgctgatctttgcattgggatctacttgctacttatagcctcagttgatatccatactaagagccagtaccacaattacgccattgactggcaaacaggagcaggctgcgatgccgctggctttttcactgtctttgccagtgaactgtcagtctacacattggcagccataaccctagaaagatggcataccatcacacatgccatgcaactggaatgcaaggtacagctctgccatgctgccagcatcatggtgctgggctgggcctttgcctttgcggctgctctcttccccatctttggcatcagtagctacatgaaagtgagcatctgcctgcccatggatatcgacagccctttgtcgcagctgtatgttatggccctcctcgtactcaacgccctggcctttgtggtcatctgtggttgctacacccacatctacctcacagtgaggaatcctaacattgtgtcctcgtcaagagacaccaagattgccaagcgcatggccacactcatcttcacggactttctctgcatggccccaattttattctttgccatttccgcctccctcaaggtgcccctcatcactgtgtccaaggccaagatcctcctagttctgttctaccccatcaattcttgtgccaatcctttcctctatgccattttcaccaagaacttccgcagggacttcttcgtcctgatgagcaagtttggctgttatgaggtgcaagcccagatttacaagacagaaacctcatctattacccacaacttccactccagaaagaatccctgttcctcggctcccagagtcaccaatagttacgtgcttgtccctctaaatcattcagtccagaactaa

SEQ ID NO: 1273 - DNA, 1005 bp, Mus musculus
atggggaactgtctgtatccggtggaaaccctttcactagacaagaatggaactcagtttactttcgacagctggaattattcgtttgaagataactactcctatgaactctcgagtgactacagcctgacaccagctgctccctgctactcctgtaatctgcttgacaggtcttccctgcccttcttcatgctcaccagtgtcctgggcatgctggcaagtggcagcatcctcttcgcgattctcagacctttcttccactggcagatttgccccagctggcccattctggcagagttagcagtgggcagtgccctgttcagcattgcagtgcccatcctggcaccaggcttacacagcgcccacagcacagccctatgcaacctgggctactgggtatggtatacttctgcttttgcccaagctctgttgataggatgctatgcttgcctgaatcccagactgaatattggtcaactccgtggcttcaccttgggactcagtgtgggactttggggagcagctgccctctcagggctgccagtcgccctggccagtgatgtttacaatggcttctgcacctttccatcctccagagacatggaagctttgaagtacactcattatgccatctgttttaccatcttcactgtattgccactgactcttttggcagccaaggggctgaagatagcactgagcaaggggcctggcccctgggttagtgtcttgtggatctggttcattttctggtggcctcatgggatggttctcatatttgatgctttggtgaggtccaaaactgttcttctgtatacatgtcaatcccagaagattcttgatgcaatgctgaatgtgacagaagccctgagtatgctgcactgtgtggctaccccactgctcctggccctgttctgccatcagaccacccgtagatccttgtcctcactctccctccctacaagacaggcttctcaaatggatgcccttgcaggcaagtcctag

SEQ ID NO: 1274 - DNA, 1356 bp, Mus musculus
atgcaacacccgggcccgcgcctgtggctggtgctgcaggtgatgataggctcgtgcacggccatcagctccatggacttagagcgccctggagacggcaagtgccagccggtggagattcccatgtgcaaggacatcggctacaacaccacccgcatgcccaacctgatgggtcacgagaaccagcgcgaggcggccatccaactgcacgagttcgcgccgctcgtggagtacggctgccacagccaccttcgcttcttcctgtgttcgctgtacgcgcccatgtgcaccgagcaggtctccacacccatccctgcttgccgggtcatgtgcgagcaggcccggctcaagtgctcgccgatcatggagcagttcaaattcaggtaccccgaacgtcctatcatcttcctctccatgtgctactgcgtttattcggtgggctatatcatccgcctgttcgcgggcgcggagagcatcgcttgtgaccgggacagtgggcagctgtatgttatccaggaaggactggagagcacgggctgtaccttagtcttcttggtactttactacttcggcatggccagctctttatggtgggtggtcctcaccctcacttggttcctggctgctggaaagaagtggggccatgaggccattgaagccaacagcagctactttcacctggcagcttgggccatcccggctgtgaagactatcttgatcttggtgatgcgcagggtggcaggggatgagctcactggtgtgtgttatgtgggcagcatggatgtcaatgctctgaccggcttcgtgctggtcccgctggcttgctacctagtcatcggcacttccttcatcctgtccggctttgtggctttattccacatccggagggtgatgaaaacgggtggggagaacacggacaagctggagaagctcatggtacgcataggggtcttctccctcctctacactgtgccggccacctgtgtgattgcctgctatttttatgaacgcctcaacatggactactggaagatgctggccacccagcacaagtgtaagatgaacaatcagaccaagacacctgactgcctgatgaccacctccatccctgccgtggaggtcttcatggtcaaagtgtccatgctgctggtggtgggcatcaccagtggggtgtgggtctggacttccaagaccctgcagtcctggcaacacgtatgcagccgggggctaaagagaaaaagccggaggaaaccagccagtgtggtcaccagtgcagggatctacaaaaaagcccagcacccccaaaaacctcaccttgggaagtatgaactgcccgcccagccttcagcctgcgtg

SEQ ID NO: 1275 - DNA, 2112 bp, Mus musculus
aactacttgttctttttgcaggatcccatcgattcgaattcgtcgacccacgcgtccggcggcgagccagcaggcgggtgcgccgccccctcccccgccgcccaatctccccaactctgcggccgcgagcaaagtttgcaaggagacgcgggaggcggccgggcagctaggcggcagcggggaaggcgcgcggtctctgggttgggggcgggggctggggggcgcccaggagccgagtggggggcggcggccagcatgcgggcccgcagcgccctgccccgcagcgccctgccccgcctgctgctgccactgctgctgctgccggccgccggaccggcccagttccacggggagaagggcatctccatcccggaccacggcttctgccagcccatctccatcccgctgtgcacggacatcgcctacaaccagaccatcatgcccaaccttcttggccacacgaaccaggaagacgcgggcctggaggtgcatcagttctacccgctggtgaaggtgcagtgctcgcccgagctgcgcttcttcctgtgctccatgtacgcgccggtgtgcacagtgctggagcaggccatcccgccgtgccgctccatctgcgagcgcgcgcgccaaggctgcgaggcgctcatgaacaagttcggcttccaatggcccgagcgcctccgctgcgagcatttcccgcgtcacggcgcggagcagatctgcgtgggccagaaccactcggaggacggagctcctgcgctactcaccaccgcgccaccttctgggctgcagcccggcgcgggtggcaccccgggcggccctggcggtggtggctcgccaccgcgttacgccactctggagcaccctttccactgtccccgcgtcctcaaggtgccgtcctatctcagctataagtttctgggtgagcgcgattgtgccgcgccctgcgagcccgcacggcccgacggctctatgttcttctcgcaagaggagactcgttttgcccgtctctggatcctcacatggtcggtgttgtgctgcgcttccactttcttcacggtcaccacctatttagtggacatgcagcgatttcgctacccagagcggcccatcatctttctgtccggctgctacaccatggtgtcagtggcctacattgcgggcttcgttctccaggagcgcgtggtatgcaatgagcgcttctcagaggacggttatcgcacggtggtgcagggcactaagaaagaaggctgcactatactcttcatgatgctctacttcttcagcatggccagctccatctggtgggtgattctgtccctcacctggttcctggcagccggaatgaagtggggccacgaggccatcgaggccaattcgcagtacttccacctggccgcctgggccgtgccggccgtcaaaaccatcaccatcttggccatgggccagatcgacggcgacctgctgagcggcgtgtgcttcgtgggcctcaatagcctggacccgctgcggggcttcgtgctggcgccgctcttcgtatacctgttcatcggtacatccttcctgctggccggcttcgtgtcactcttccgcatccgcaccatcatgaagcacgacggcaccaagacggagaagctggagaggctcatggtgcgcattggcgtcttctcggtgctctacacggtaccggccaccatcgtcatcgcctgctacttctatgagcaggccttccgcgagcactgggagcgctcctgggtaagccagcactgcaagagcctagccatcccctgcccggcccactacacgccccgcatgtcgcccgacttcacagtctacatgatcaaatacctcatgacgctcatcgtgggcatcacgtcgggcttctggatctggtccggcaagacactgcactcgtggaggaagttctacactcgtctcaccaacagccggcatggcgagaccactgtgtgaagcggtctcgcctgcctgccgggctttcccctctcccaggtccggactgcaccgtgccctccttcactcaggaggggggagggtgcaccctacggactcctattttatttttttaaataaagaacggtaaaaaaaaaaaaaaaa

SEQ ID NO: 1276 - DNA, 2624 bp, Mus musculus
gaattcggcacgagaagatggaatctgtgatttgggaatgcggttgatggagttgctatgctggccagatgtgcccaatgtaataaaatgaaaagaagatacaagatgatgtcatcttcccatattgtgaaaccaaaaacaaatgccctttgtgagaccaggttaccagttctttgacagtacagggagtttttaaactgaggagcctaacagataaggggtactttcaagctgagacctgcaggcatatactgatctaaaacgcatcttgtgtagatctgatcatccgagcctcattctgatccaggaagaatggctgtgagctggattgtctttgatctttggctcttgactgtgtttctggggcagataggtgggcacagtttgttttcttgtgaacctataaccttgaggatgtgccaagatttgccttacaatactaccttcatgcctaatcttctgaaccattatgaccaacagactgcagctttagcaatggagcccttccaccctatggtgaacctggattgttctcgggattttcggccatttctttgtgcactctatgcccctatttgtatggaatatggacgtgtcacacttccctgccgtaggctgtgtcagcgtgcctatagcgagtgttcaaaactcatggagatgtttggtgtcccgtggcctgaagatatggagtgcagtaggtttccagattgtgatgagccatatccccgacttgtggatttgaatttagttggagatccaactgaaggagccccagttgcagtgcagagggactatggtttttggtgtcccagagagttaaaaattgatcctgatcttggctattcctttctgcacgtgcgagattgttcgccaccatgtcccaatatgtacttcaggagagaagaactgtcatttgctcgctatttcataggcctgatttcaatcatttgcctctctgccacattgtttacttttttaacctttctaattgacgtcacaagattccgttaccctgaaagacctatcatattttatgcagtctgctacatgatggtgtcattaattttcttcattgggtttttgctggaggaccgagtagcctgcaatgcatctagccctgcacagtataaggcttctacagtgacacaaggatctcacaataaggcctgtaccatgctctttatggtactatattttttcactatggctggcagtgtatggtgggtaattcttaccatcacatggtttttagcagctgtgccaaagtggggcagtgaagctattgagaagaaagcattgctgtttcatgccagtgcctggggcatccccggaactctaactatcatccttttagcgatgaataaaattgaaggtgacaatattagtggcgtgtgttttgtcggcctctacgacgttgatgcattaagatatttcgttctcgctcccctctgcctgtatgtggtagttggggtttctctccttttagccggcattatatccctaaacagagttcggattgagatcccattagaaaaggaaaaccaagataagttagtgaagttcatgatccggattggtgttttcagcattctctaccttgtgccactcttggttgtaattggatgttacttttatgagcaagcttaccgcggcatctgggagacaacatggatccaggaacgctgcagagagtatcacattccatgtccgtaccaggttactcagatgagtcgtccagacctgattctctttctgatgaagtatctcatggctctcatagttgggattccctctatattttgggttggaagcaaaaagacatgctttgaatgggccagttttttccatgggcgtaggaaaaaagagatagtgaatgagagccggcaggtgctccaggaacctgactttgctcagtcactcctgagggacccaaatactccaattataagaaaatcaagaggaacttccactcaagggacatccacacatgcttcttcaactcagctggccatggtggatgaccaaagaagcaaagcagggagtgtccacagcaaagtgagcagctaccatggcagcctccacaggtcacgggatggcaggtacactccctgcagttaccgaggaatggaggagagactacctcacggcagcatgtcacggctgacggatcattccaggcacagtagttctcatcggctcaacgagcagtcccgacacagcagcatccgagacctcagtaacaaccccatgactcacattacacatggcaccagcatgaaccgtgttattgaggaggatggaaccagtgcttagtcttgtctaaggtgaaatgtgtgctgttgaaaagcaggttttgccttcgcatggctggctgctgtaactcactgtcgctctgctttcttgggcagagtgtcagcctgggaaagtagatctttgctctttgtatcacatcaaccctggggtgtgaacacatccaaaccctaaggatcatgtcatcacaaaagtaattctttctaggctgtgaagagatgattgtctggtgagcattttttataaacatgcttattttatatctagaaaaatcctctatgtgtggtgactgctttgtagtgaatttcatataa

SEQ ID NO: 1277 - DNA, 2831 bp, Mus musculus
  misc_feature (2407)..(2407): n is a, c, g, or t
  misc_feature (2412)..(2413): n is a, c, g, or t
tcgacctcaacacaaagacctgggtcgtgagacacacgcgtagagtcaggcggcttccccgaaaaccggactcggccggcgccgagtctgggtccccgccttcaaccatgaccctagcaatccatccctcggcccgggctccggacgtctgatattccgcacattctcgtacaactgctggagaggcgactgctgcccccttgtcgcccttggcgccttaccgcattccctatccggagttgggagcagcgcggccaccggcgcccctgtgcaaactgggggtgtctgctagatcagcctctgccgctgctgcccgcagctctggccatggcctggccgggcacagggccgagcagccggggggcgcctggaggcgtcgggctcaggctggggctgctgctgcagttcctcctgctcctgcggccgacactggggttcggggacgaggaggagcggcgctgcgaccccatccgcatcgccatgtgccagaacctcggctacaacgtgaccaagatgcccaacttagtgggacacgagctgcagacagacgccgagctgcagctgacaactttcacgccgctcatccagtacggctgctccagccagctgcagttcttcctttgttcggtttatgtgccaatgtgcacagagaagatcaacatccccatcggcccgtgcggtggcatgtgcctttcagtcaagagacgctgtgaaccagtcctgagagaatttgggtttgcctggcccgacaccctgaactgcagcaagttcccgccccagaacgaccacaaccacatgtgcatggaaggaccaggtgatgaagaggttcccttgccccacaagactcccatccagcccggggaagagtgccactccgtgggaagcaattctgatcagtacatctgggtgaagaggagcctgaactgtgttctcaagtgtggctacgatgctggcttgtacagccgctcagctaaggagttcacggatatttggatggctgtgtgggccagcctctgcttcatctccaccaccttcaccgtgctgaccttcctgattgattcatccaggttttcttaccctgagcgccccatcatatttctcagtatgtgctataatatttatagcattgcttatattgttcggctgactgtaggccgggaaaggatatcctgtgattttgaagaggcggcagagcccgttctcatccaagaaggacttaagaacacaggatgtgcaataattttcttgctgatgtacttttttggaatggccagctccatttggtgggttattctgacactcacttggtttttggcagccggactcaagtggggtcatgaagccattgaaatgcacagttcttatttccacatcgcagcctgggctattcccgcagtgaaaaccattgtcatcttgattatgagactagtggatgccgatgaactgactggcttgtgctatgttgggaaccaaaacctagatgccctcactggctttgtggtggctcctctctttacgtatttggtgattggaacgctgttcattgcggcgggtttggtggccttattcaaaattcggtccaatcttcaaaaagacgggacaaagacagacaagttggaaaggctaatggtcaagatcggggtcttctcagtactgtacacggttcctgcaacctgtgtgattgcctgttatttctatgaaatctcaaactgggcactctttcgatattctgcagatgactcaaacatggcagttgaaatgttgaaaatttttatgtctttgctcgtgggcatcacttcaggcatgtggatttggtctgccaaaactcttcacacgtggcaaaagtgttctaaccgattggtgaattctgggaaggtaaagagagagaagagggggaatggttgggtgaagccaggaaaaggcaacgagactgtggtataagactagccggcttcctcgttcctcattgtgaaggaagtgatgcagggaatctcagtttgaacaaacttagaaacacttcagcccacacacacccacgtcagcccaccaccactcacccaactcagcatcagaagaccaatggcttcactgcagactttggaatggtccaaaatggaaaagccagttaagaggttttcaaagctgtgaaaaatcaaaatgttgatcactttagcaggtcacagcttggagtccgtggaggtcccgcctagattcctgaagcccagggtgatagtgtttgctcctactgggtgggatttcaactgtgagttgataacatgcaaggagaaagattaatttttaaaacccttttaaattttaaatagtaactaaggtcttgcagatagcaaagtgatctataaacactggaaatgctgggttgggagacgtgttgcagagtttttatatngtttnnctggtctaacataaacatcttctggcctacactgtctgctgtttagaactctgtagcgcactcccagaggtggtgtcaaaatccttcagtgccttgtcgtaaaacagaattgtttgagcaaacaaaagtactgtactaacacacgtaaggtatccagtggatttctctctcctgaaatttcaacatccctaattctaggcagcccctgttttcttcactttaaactaatgactcaaaaaaaaaaaggttatttttataggatttttttttgcactgcagcatgcctaatgagaggaaaaggaggtgatcacttctgacaatcacttaattcagagaaaaatgagatttgctaattgacttaccttccgacccctagagaccctattgcattaagcaatgtttaagcaattggggactt

SEQ ID NO: 1278 - DNA, 1734 bp, Mus musculus
atggctcgacccgacccgtctgcgcctccctctcttctgctgctgttgctggcgcagctggtgggccgggcagcggccgcctccaaggccccggtgtgccaggaaatcacggtgcccatgtgccgaggcatcggctacaacctgacgcacatgcccaaccagttcaaccatgacacgcaggacgaagcaggcctggaggtgcaccaattctggccgcttgtggagatccactgctcaccggacctgcgcttcttcctgtgctctatgtacacgcccatctgtttgcctgactaccacaagccgctaccaccgtgccgttccgtgtgcgagcgcgccaaggccggctgctcgccgctcatgcgccagtacggcttcgcctggcccgagcgcatgagctgcgaccgcctccctgtgctgggcggcgacgcggaggttctgtgtatggattataaccgaagcgaaaccaccgcgtcccctaagtccttcccggccaaacctacactcccaggaccacaggggcgccatcttccggggggggagtgctcgggaggtcatcgtgtgcagtcggagcccttcgtgcccatcctgaaggagtcacacccactctacaacaaggtgcgcaccggccaagtgcccaactgcgcggtgccctgctaccagccgtccttcagcccggacgagcgcacattcgccaccttctggattggcctgtggtctgtgctgtgcttcatctccacgtccaccaccgttgccaccttcctcattgacatggaacgattccgctaccctgagcgccccatcatcttcttgtctgcgtgctacctgtgtgtgtcactgggattcttggtgcgcctggtagtgggccatgccagcgtcgcttgcagccgtgagcacagccacattcactatgagactaccggccctgcgctgtgcacggttgtcttcctcttagtctatttctttggcatggccagctccatctggtgggtcatcctgtcgctcacctggttcttggcggctggcatgaagtggggcaatgaagccatcgcaggttatgcacagtacttccaccttgctgcctggctcatccccagtgtcaagtccattacggcgctggcactgagctcggtggacggggacccagtggctggcatctgctatgtgggcaaccaaaacctgaactcactacgaagctttgtcttgggcccactggtgctgtacctgttggtgggcacgctcttccttctggcaggcttcgtgtcactcttccgcatccggagcgtcatcaagcagggtggcactaagacggacaagctagaaaagctcatgatccgcatcggcatcttcaccctgctctacacggtgccagccagcatcgtggtggcctgctacctgtatgaacagcactaccgggaaacctgggaagcacccctcacctgcgcgtgtccgggaacggacgctggccaaccacgccaaaccgaatactgggtgctcatgctcaatacttcatgttcctggtggtgggcatcactcgggatctggactggtccggcaagatctggagtcttggcggcggttcacagccgctgctgctgcagctctcggcggggccacaaagcggtggcgctatggccgcaggagactatgcggaggccagcgccgcgctcaccggcaggaccgggccgcctggccccaccgccgcataccacaagcatgtccctgtcgcacgtatag

SEQ ID NO: 1279 - DNA, 2492 bp, Mus musculus
tcatttcaggcccagctactatcaaaatggtacaaagaatgcaatgaggaatttgtacattttatctctgatttgagaatctttttgatgcggaaaggagcataagaataatccaagccatgtggtaaaatcggagtctggcaagatggaaaggtccccgtttctgttggcgtgcattcttctgcccctcgtaagaggacacagccttttcacctgtgagccaatcaccgttcccagatgtatgaaaatgacttacaacatgacgttcttccctaacctgatgggtcattatgaccaggggatcgctgctgtggaaatggggcactttctgcatcttgcaaatctagaatgttcaccaaacattgaaatgttcctttgccaagcttttataccaacctgcacagagcaaattcatgtagttctaccctgtcggaaattgtgtgagaaaatagtttctgattgcaaaaaactaatggacacttttggcatccgatggcctgaagaacttgaatgtaacagattgccacactgtgatgacactgttcctgtaacttctcatccacacacagagctttctgggccacagaagaaatcagatcaagtcccaagagacattggattttggtgtccaaagcaccttaggacttccggggaccaaggctataggtttctgggaattgaacagtgtgcccctccgtgccccaatatgtattttaaaagtgatgaactagactttgccaaaagtttcataggaatagtttcaatattttgtctttgtgcaactctgttcacgttccttacatttttaattgacgttagacgattcagatacccagagagaccaattatctattactctgtctgctacagcattgtctctctcatgtacttcgtggggtttttgctgggcaatagcacagcttgtaataaggcagacgagaagctggagctcggggacaccgttgtcctagggtcaaagaataaggcttgcagtgtggtatttatgtttctgtatttttttacaatggctggcaccgtgtggtgggtgattctcaccattacgtggttcttagctgccgggagaaaatggagttgcgaagctattgaacaaaaagcagtgtggttccatgccgttgcctggggggcgcccgggttcctgaccgtcatgctgctcgctatgaataaggttgaaggagacaacattagcggcgtttgcttcgttggcctgtatgacctggacgcctctcgctacttcgtccttctgcctctgtgcctctgcgtatttgttgggctgtctctcctcttagccggcatcatctccttgaatcatgtccgacaagtcatacagcatgatggtcggaaccaagagaagctaaagaaattcatgattcgcatcggagtcttcagtggcctgtatcttgtgcccttagtgacacttctcggttgctatgtctatgagctagtgaacaggatcacctgggagatgacatggttctctgatcattgtcaccagtaccgcatcccgtgcccttaccaggcaaatccaaaagctcgaccagaattggctttatttatgataaaatatctgatgacattaattgttggtatctctgcggtcttctgggttggaagcaaaaagacgtgcacagaatgggccgggttctttaagcgaaaccgcaagcgagaccccatcagtgagagccgccgagtgctgcaagagtcctgtgagttcttcctgaagcacaactctaaagtgaagcacaagaagaagcatggcgcaccagggcctcataggctgaaggtcatttccaagtccatgggaactagcacaggagcgaccacaaatcatggcacctctgccatggcaatcgctgaccatgattacttagggcaagaaacttcaacagaagtccacacctccccagaagcatccgtcaaagagggacgagcagaccgagcaaacactcccagcgccaaagatcgggactgtggggaatctgcagggcccagttccaagctctctgggaaccggaacggcagggaaagccgagcgggcggcctgaaggagagaagcaatggatcagagggggctccaagtgaaggaagggtaagtccaaagagcagcgttcctgagactggcctgatagactgcagcacttcacaggccgccagttctccagaaccaaccagcctcaagggctccacatctctgcctgttcactcagcttccagagctaggaaagagcagggtgctggcagccattccgacgcttgaagaaaactgtctcgttcccccagaagcacatgtatgttacactggagatgaccaactgatttgtcttataaaggccactgttgagctgggagagtagcccagtggtacagcgcccacctggaatactgaggacctggggttgtctcccagcactgcaaaaggaaaattcactgttacagtcttccttgcacttaaccagctttgtctatgttttttt

SEQ ID NO: 1280 - DNA, 2260 bp, Mus musculus
  misc_feature (66)..(66): n is a, c, g, or t
tttgaaggtaaccggagaagcttgttgctcgtcgccgcagagaaagccgcaccgttacgtctcggnggggagggtaaggcgacaccccttccctcgtacccccactccaggcccaggagtttgaactccggcggctgcgtgagtgccacgtggaggcggctgcggcgcccctcggctggcggcctcgcccccgctgtgcaggcaccctagcaccctcggctccgcgccgcccacggcggccccggcgccgggaggactctcatgcgccggccgggcggcggcgcctccctgtatccaagcctctccccagcgcctcgtctttttcctccagctgagaacgccgctgcactcgcgaccggcgatgcggggccccggcacggcggcgtcgcactcgcccctgggcctctgcgccctggtgcttgctcttctgggcgcgctgcccacggacacccgggctcagccatatcacggcgagaaaggcatctcggtaccggaccacggcttctgccagcccatctccatcccgttgtgcacggatatcgcctacaaccagaccatcctgcccaacctgctgggccacacgaaccaagaggacgcgggcctcgaggtgcaccagttctaccctctggtaaaggtgcagtgttctcctgagctacgcttcttcttatgctctatgtacgcacccgtgtgcaccgtgctcgaccaagccattcctccgtgccgttccttgtgcgagcgcgcccgacagggctgcgaggcgctcatgaacaagttcggcttccagtggccagagcggttgcgctgcgagaacttcccagtgcacggtgccggcgagatctgcgtggggcagaacacgtccgacggctccgggggcgcgggcggcagtcccaccgcctaccctactgctccctacctgccagacccacctttcactgcgatgtccccctcagatggcagaggccgcttgtctttccccttctcgtgtccgcgccagctcaaggtgcccccctacctgggctaccgcttcctaggtgagcgtgactgcggtgccccgtgtgagccgggccgtgctaacggcctcatgtactttaaagaagaggagagacggttcgcccgcctctgggtgggtgtgtggtcagtgctgtcgtgcgcctcgacgctcttcacggtgctcacctacctagtggacatgcgtcgcttcagctatccagagcgacccatcatcttcctgtcgggttgctacttcatggtggcagtggcgcacgtggcaggcttcctgctagaggaccgtgccgtgtgcgtggagcgcttctcggacgatggctaccgcacggtggcgcagggcaccaagaaggagggctgcaccatcctcttcatggtgctttacttcttcggtatggccagctccatctggtgggtcattctgtccctcacttggttcctggcagctggcatgaagtggggccacgaggccatcgaggccaactcgcagtactttcatctggccgcgtgggctgtgccagcggtcaagacaatcaccattttggccatgggccaggtggatggtgacctactcagtggagtgtgctacgtgggcctgtctagtgtggatgcattgcggggcttcgtgctggcgcccttgttcgtctacctcttcatcgggacgtccttcctgttggccggctttgtgtctctctttcgcatccgcaccatcatgaagcacgacggcaccaagacagagaagctggagaagctgatggtgcgcatcggcgtcttcagcgtgctctacacggtgccggccaccatcgtgttggcctgctacttttatgagcaggccttccgagagcactgggaacgcacctggctcctgcagacttgcaagagctacgctgtgccctgccctccgcgccacttctctcccatgagccccgactttacagtcttcatgatcaagtacctgatgaccatgatcgtgggcatcactacgggcttctggatctggtcgggcaagaccctgcagtcatggcgtcgcttctaccacagactcagccacagcagcaagggggaaactgcggtatgagccccggtccttacccacccttgcctcttctacccttttacaggaggagaggcatggtagggagagaactgctgggtgggggcttgtttccgtaagctacctgccccctccactgagctttaacctggaagtgagaagttatttggaggtgagaagagatttgggggcgagagatggttt

SEQ ID NO: 1281 - DNA, 2058 bp, Mus musculus
atggagtggggttacctgttggaagtgacctcgctcctagccgccttggcggtgctacagcgctctagcggcgctgccgcggcttcggccaaggagctggcgtgccaagagatcacggtgccgttgtgcaaaggcatcggttacaactacacttacatgcccaaccagttcaaccacgacacgcaagatgaggcgggcctagaggtgcaccagttttggccgctggtggagatacagtgctccccggacctcaagttctttctgtgtagcatgtacacgcccatctgcctggaggactacaagaagcctctgccgccttgtcgctctgtgtgtgaacgcgccaaggccggctgcgcgccgctcatgcgccagtacggctttgcttggcctgaccgcatgcgctgcgatcggttgccggagcagggcaacccggacactctgtgcatggactacaaccgcaccgacctcaccacggccgcgcccagcccaccgcgccgcctgcctccgccgcctcctcccggcgagcagccgccctctggcagcggccacagccgcccgccaggggccaggcccccacatcgtggcggcagcagtaggggcagcggggacgcggcggctgcgcccccttcgcgcggcgggaaggcgaggccccctggtggcggcgctgctccctgcgagccggggtgccagtgccgcgcgcccatggtgagcgtgtccagcgaacgccacccgctctacaaccgcgtcaagaccggccagatcgccaactgtgcgctgccctgccacaaccccttctttagccaggatgagcgcgccttcaccgtcttctggatcggcctgtggtcggtgctctgcttcgtctccaccttcgccactgtctctaccttcctcatcgatatggagcgctttaagtacccggaacggcccatcatattcctctccgcctgttacctcttcgtgtctgtcgggtacctggtgcgcctggtggcaggacatgagaaagtggcctgcagcggcggcgctccgggtgctggcggacgtgggggtgcgggcggcgcggcggcggctggcgcaggggcagcgggacggggggcgagcagcccgggcgcgcgcggcgagtacgaggagctgggcgcagttgagcagcatgttcgctatgagaccactggccccgcgctgtgcacggtggtctttctccttgtctacttttttggcatggccagctccatctggtgggtaatcctgtcgctcacgtggttcttggcagctggcatgaagtggggtaacgaggccatagcaggctactcgcagtacttccacctggccgcgtggcttgtgcccagcgtcaagtccatcgcggtgctggcgctcagctccgtagacggcgacccggtggcgggcatctgctacgtgggcaaccagagccttgacaacctacgcggctttgtgctggcgccactggttatctacctcttcattgggactatgtttctgttagctggcttcgtgtcgctgttccgaatccgttcagtcatcaagcagcaaggaggtccaactaagacacacaagctagaaaaactcatgatccgcttgggcctcttcaccgtgctctacacggtgcccgctgccgtcgttgtcgcctgccttttctatgagcagcacaaccgaccgcgctgggaggccacgcacaactgcccatgccttcgggacctgcaaccggaccaggctcgcaggcccgattacgcggtcttcatgctcaagtacttcatgtgcctagtagtgggcatcacatcgggcgtgtgggtctggtccggcaagactctggagtcctggcgcgcgttgtgcactaggtgctgctgggccagcaagggcgctgcagtaggcgcgggcgctggaggcagcggccctgggggcagtggacccgggcccggcggaggtgggggacacggcggaggcgggggatccctctacagcgacgtcagtaccggcctgacgtggcggtctggcacggccagctctgtatcttaccctaagcaaatgccattgtcccaggtctga

SEQ ID NO: 1282 - DNA, 2294 bp, Mus musculus
ggacgccggctctggctggagtggcggcggcatcggcggcggcggcgacggcggtggtagcggttgttcctccgaaggcgccacgcgctccgggacacacgtgggcggccgagagatggcgcgggagccgcgacgtggcgcgcagatcccgggacgcgggatggagcggtgcgagtgagcccgagcggccgcgcccggggcgatggccgtgccaccgctgctccgcggggcgctgctgctgtggcagctgctggcgacgggcggcgcggcgctggagatcggccgcttcgatccggagcgtggccgtggccccgcaccgtgccaagcgatggagatccccatgtgccggggcattggctacaacctgacccgcatgcccaacctactgggccacacgtcgcagggcgaggcggcggcgcactgtgccgagttctcgcccctcgtgcagtacggctgccacagccacctgcgcttcttcttctgctcgctctacgccccaatgtgcaccgaccaggtctccactcccatcccagcctgccggcccatgtgcgagcaggctcgcctgcgctgcgcccccatcatggagcaattcaatttcggctggcccgactcactcgactgtgcccggctccccacgcgcaacgacccgcacgcactctgtatggaggcacccgagaacgctacagcaggccccacagaaccccacaagggcctgggcatgctccctgtggcacctcggcccgcgaggccaccgggagattcagccccaggtcccggcagcggtggcacctgcgacaaccccgagaagttccagtacgtggagaagagtcgctcgtgcgctccgcgctgcgggccaggcgtcgaggtgttctggtctcggcgcgataaggacttcgcgctggtttggatggctgtgtggtccgcgttgtgtttcttctccacggccttcaccgtgttcaccttcctgctggagcctcaccggttccagtacccagagcgcccgattatcttcctttctatgtgctacaatgtctactccttggccttcctgatcagagcggtggcaggtgcacagagtgtggcatgcgaccaggaggcaggggctctgtatgtgatccaggagggtctggaaaacacaggctgcaccctggtcttcctgttgctctattatttcgggatggccagctcactttggtgggtggttttgactctaacctggttcctggctgcaggcaaaaaatggggccacgaggccatcgaggctcacggcagctacttccacatggcagcgtggggcctgccagcactcaaaactatcgtggtcctgactctgcgcaaggtggctggcgatgaactgactgggctctgctatgtagccagcatggacccggcagccctcactggctttgtgttggtacccctatcttgctacctggtactgggtaccagtttcctcctgaccggttttgtggctctcttccatatccgcaaaatcatgaagacgggaggcaccaatacggagaagctggagaagctgatggtcaaaatcggagtcttttccatcctttacacagtgccggccacctgcgtcattgtctgctacgtttatgaacgcctcaacatggacttctggcggcttcgggccacagagcaaccatgtactgctgccaccgtgcctggaggccggagagactgctcgctgccagggggctcggtgcccactgtggctgtcttcatgctcaaaatcttcatgtccttggtggtgggcatcaccagtggagtctgggtatggagttccaagacttttcagacttggcagagcctgtgctaccgaaaaatggcagctggccgagcccgggccaaggcctgccgaaccccagggggctatggccggggtacccactgccactacaaagcccccacggtggtcttgcacatgactaagacagacccctctctggagaaccccacacacccctagaacataggctaggctgtgagttatggttgctccctccttgccctcccctccccccttcagagacagctgactaacagctgcccagctgtcaaggtcagacaagtgagacacagggggctgaggactagggtggggacccagtaaagctcagggccttgaccttctgtctcatgcagggagtggtcctagtccacagagggtcccaggataagaaggggcagaagggggcagggtccagtgcagagttatttaatgatgtaatttattgtggcatttctctggaagctgtgactggaataaaccctcgtgtggc

SEQ ID NO: 1283 - DNA, 1149 bp, Mus musculus
atgagatcagaacctaccaatgcagcaggaaacaccacactgggggttacctccgttcttcagagcacctcagtaccttcttctgagacctgccacgtctcctacgaggagagcagagtggtcctggtggtggtgtacagtgccgtgtgcctgctgggcctaccagccaactgcctgactgcctggctgacgctgctgcaagtcctgcagaggaacgtgctagccgtctacctgttctgcctgtccctctgtgagctgctctacatcagcacggtgccattgtggatcatctacatccagaatcagcacaaatggaacctgggtccgcaggcctgcaaggtgactgcttacatcttcttctgcaacatctacatcagcatcctcttgctctgctgcatttcctgcgaccgctacatggccgtggtctatgcactggagagccgaggccaccgccaccagaggactgctgtcaccatttctgcgtgtgtgattcttcttgttggacttgttaactatccagtgtttgacatgaaggtggagaagagtttctgctttgagcccctgaggatgaacagcaagatagccggctaccactacctgcgtttcacctttggctttgccatccctctcggcatcctggcgttcaccaatcaccagatcttccggagcatcaaactcagtgacagcctgagcgctgcgcagaagaacaaggtgaagcgctccgccatcgcggtcgtcaccatcttcctggtctgctttgctccctaccacgtggtactcctcgtcaaagctgccagcttttccttctaccaaggagacatggatgccgtgtgtgcctttgaaagcagactgtacacagtctctatggtgtttctgtgcctgtctacagtcaacagtgtggctgaccccatcatctacgtgctgggtacagaccactctcggcaagaagtgtccagaatccacacagggtggaaaaagtggtccacaaagacatatgttacatgctcaaaggactctgaggagacacacttgcccacagagctttcaaacacatacaccttccccaatcccgcgcaccctccaggatcacagccagcgaagctaggtttactgtgctcgccagagagactgcctgaggagctctgctaa

SEQ ID NO: 1284 - DNA, 2883 bp, Mus musculus
atgctgctgctgctgctggtgcctctcttcctccgccccctgggcgctggcggggctcagacccccaacgtcacctcggaaggttgccagattatacatccgccctgggaaggtggcatcaggtaccgtggcttgactcgcgaccaggtgaaggccatcaatttcctgcctgtggactatgagattgaatatgtgtgccggggcgaacgcgaggtggtggggcccaaggtgcgcaagtgcctggccaacggctcctggacggatatggacacacccagtcgctgtgtccgaatctgctccaagtcttatttgaccctggaaaatgggaaggttttcctgacgggtggggacctcccagctctggatggagcccgggtggatttccgatgtgaccccgacttccatctggtgggcagctcccggagcatctgtagtcagggccagtggagcacccccaagccccactgccaggtgaatcgaacgccacactcagaacggcgtgcagtatacatcggggcgctgtttcccatgagcgggggctggccggggggccaggcctgccagcctgcggtggagatggcgctggaggacgttaacagccgcagagacatcctgccggactacgagctcaagcttatccaccacgacagcaagtgcgacccagggcaagccaccaagtacttgtatgaactactctacaacgaccccatcaagatcatcctcatgcccggctgcagctctgtgtccacactggtagccgaggctgcccggatgtggaaccttattgtgctctcatatggctccagctcaccagccttgtcaaaccgacagcggtttccaacgttctttcggacacatccatccgccacactccacaatcccacccgggtgaaactcttcgaaaagtggggctggaagaagattgccaccatccagcagactaccgaggtcttcacctcaacactggatgacctggaggagcgagtgaaagaggctgggattgagatcacttttcgacagagtttcttctcagatccagctgtgcctgttaaaaacctgaagcgtcaagatgctcgaatcatcgtgggacttttctatgagaccgaagcccggaaagttttttgtgaggtctataaggaacggctctttgggaagaagtatgtctggtttctcatcgggtggtatgctgacaactggttcaaaacctatgacccgtcaatcaattgtacagtagaagagatgactgaggcggtggagggccatatcaccacggagattgtcatgctgaaccctgccaacacccgaagcatttccaacatgacatcacaggaatttgtggagaaactaaccaagcggctgaaaagacaccctgaggagactggaggcttccaggaggcaccactggcctatgatgctatctgggccttggctttggccttgaacaagacctctggaggaggtggccgttcaggagtgcgcctggaggactttaactacaacaaccagaccattacagaccaaatctaccgggccatgaactcctcctcctttgagggtgtttctggccacgtggtctttgatgccagcggctcccggatggcatggacgcttatcgagcagctacagggcggcagctacaagaagatcggctactacgacagcaccaaggatgatctttcctggtccaaaacagacaagtggatcggagggtctcccccagccgaccagaccttggtcatcaagacattccgtttcctgtcacagaaactctttatctccgtctcagttctctccagcctgggcattgttcttgctgttgtctgtctgtcctttaacatctacaactcccacgttcgttatatccagaactcccagcccaacctgaacaatctgactgctgtgggctgctcactggcactagctgctgtcttcccccttgggctggatggttaccacatagggagaagccagttcccatttgtctgccaggcccgcctttggctcttgggcttaggctttagtctgggctatggctctatgttcaccaagatctggtgggtccacacagtcttcacaaagaaggaggagaagaaggaatggaggaagaccctagagccttggaaactgtacgccactgtaggcctgctggtgggcatggatatcctgactcttgccatctggcagattgtggaccccttgcaccgaaccattgagacttttgccaaggaggaaccaaaggaagacattgatgtctccattctgccccagctggagcactgcagctccaagaagatgaatacatggctcggcattttctatggttacaaagggctgctgctgctgctgggaatctttcttgcttatgagaccaaaagtgtgtccactgaaaagatcaatgaccacagggccgtgggcatggctatctacaatgttccggtcctgtgtctcattaccgctcctgtcaccatgatcctttccagccagcaggacgcagccttcgcctttgcctctctggccattgtgttctcttcctacattactctggttgtgctctttgtgcctaagatgcgcaggttgatcactcgaggtgaatggcagtctgaagcacaggacacaatgaaaacaggatcatccaccaacaacaatgaggaagagaagtcccgactgttggagaaggaaaaccgtgaattggaaaagatcatcgccgagaaagaggagcgtgtctctgaactgcgccatcagctccagtctcggcagcagatccgctcccggcgccaccccccaacacccccagacccctctgggggccttcccaggggaccctcagagccccctgaccggcttagctgtgatgggagtcgagtacatttgctttacaagtga

SEQ ID NO: 1285 - DNA, 1050 bp, Mus musculus
atggaactggctatggtgaacctcagtgaagggaatgggagcgacccagagccgccagccccggagtccaggccgctcttcggcattggcgtggagaacttcattacgctggtagtgtttggcctgattttcgcgatgggcgtgctgggcaacagcctggtgatcaccgtgctggcgcgcagcaaaccaggcaagccgcgcagcaccaccaacctgtttatcctcaatctgagcatcgcagacctggcctacctgctcttctgcatcccttttcaggccaccgtgtatgcactgcccacctgggtgctgggcgccttcatctgcaagtttatacactacttcttcaccgtgtccatgctggtgagcatcttcaccctggccgcgatgtctgtggatcgctacgtggccattgtgcactcgcggcgctcctcctccctcagggtgtcccgcaacgcactgctgggcgtgggcttcatctgggcgctgtccatcgccatggcctcgccggtggcctaccaccagcgtcttttccatcgggacagcaaccagaccttctgctgggagcagtggcccaacaagctccacaagaaggcttacgtggtgtgcactttcgtctttgggtaccttctgcccttactgctcatctgcttttgctatgccaaggtccttaatcatctgcataaaaagctgaaaaacatgtcaaaaaagtctgaagcatccaagaaaaagactgcacagaccgtcctggtggtcgttgtagtatttggcatatcctggctgccccatcatgtcgtccacctctgggctgagtttggagccttcccactgacgccagcttccttcttcttcagaatcaccgcccattgcctggcatacagcaactcctcagtgaaccccatcatatatgcctttctctcagaaaacttccggaaggcgtacaagcaagtgttcaagtgtcatgtttgcgatgaatctccacgcagtgaaactaaggaaaacaagagccggatggacaccccgccatccaccaactgcacccacgtgtgagar

SEQ ID NO: 1286 - DNA, 1116 bp, Mus musculus
atgaatggctcggacagccagggggcggaggactcgagccaggaaggtggcggcggctggcagcccgaggcggtcctcgtacccctatttttcgcgctcatcttcctcgtgggcgctgtgggcaacgcgctggtgctggcggtgctgctgcgcggcggccaggcggtcagcaccacgaacctattcatcctcaacctgggtgtggccgacctgtgtttcatcctgtgctgcgtgcctttccaggccaccatctataccctggacgattgggtgtttggctcactgctctgcaaggccgttcatttcctcatcttcctcactatgcacgccagcagcttcacgctggccgctgtctcgctggacaggtatctggccatccgctacccgatgcactcccgagagttgcgcacacctcgaaacgcgctggcggccatcgggctcatctgggggctagcactgctcttctccgggccctacctgagctactacagtcagtcgcagctggccaatctgacggtgtgccacccagcgtggagcgcaccacgacgtcgcgccatggacctctgcacttttgtctttagctacctgttgccagtgctggtgctcagcctgacctatgcgcgcaccctgcactacctctggcgcacagttgacccagtagctgcaggctcaggttcccagcgcgccaagcgcaaggtgacacggatgatcgtcatcgtggcggtactcttctgcctctgttggatgccccaccacgcgcttatcctctgcgtgtggtttggtcgctttccgctcacgcgtgccacttacgccctgcgcatcctttcacatctagtatcttatgccaactcgtgtgtcaaccccatcgtttatgctctggtctccaagcatttccgcaaaggtttccgcaaaatctgcgcgggcctgctacgccgtgccccgaggagagcttcaggccgagtgtgcatcctggcgcctggaaaccatagtggtggcatgctggaacctgagtccacagacctgacacaggtgagcgaggcagccgggcccctcgtccccgcacccgcacttcccaactgcacaaccttgagtagaaccctcgatccagcctgttaa

SEQ ID NO: 1287 - DNA, 1113 bp, Mus musculus
atggctgacatccagaacatttcgctggacagcccagggagcgtaggggctgtggcagtgccggtggtctttgccctcatcttcctgttgggcatggtgggtaatgggctggtgttggccgtgcttctgcagcctggcccaagtgcctggcaggaaccgggcagtaccacggatctcttcatcctcaacttggcggtggccgacctttgcttcatcctgtgctgcgtgcccttccaggcggccatctacacactggatgcctggctctttggggctttcgtgtgcaagacggtacatctgctcatctacctcaccatgtatgccagcagcttcaccctggcggccgtctcagtggataggtacctggcggtgcgacacccgctgcgctcccgggccctccgcaccccgcgcaacgcgcgcgccgccgtggggctcgtgtggctgctggcggcgctcttttccgcgccctacctaagctactacggcacggtgcgctacggcgcgctcgagctctgcgtgcccgcctgggaggacgcgcggcggcgcgcgctggacgtggccaccttcgccgcaggctacctgctgccggtgaccgtggtgagcctggcctacgggcgcacgctgtgcttcctgtgggccgccgtgggtcccgcgggtgcggcggcggcagaggcacgcagacgggcaaccggccgcgcggggcgcgccatgctggcggtggccgcgctctacgcactctgctggggcccgcaccacgcgctcatcctctgcttctggtacggccgcttcgccttcagcccggccacctacgcctgtcgtctggcttcgcactgcctcgcctacgccaactcctgcctcaacccgctcgtctattcccttgcctcccgccacttccgcgcgcgcttccgccgcctgtggccctgcggccaccgccgccaccgccaccaccaccaccgccttcatcgagccctccgtcgtgtccagccggcgtcttcgggccccgccggctatcccggcgacgccagacctcgcggttggagtatggagcccagaggggatgccttgcgcggtggagagactagactaaccctgtccgccaggggaccgcaataa

SEQ ID NO: 1288 - DNA, 1458 bp, Mus musculus
atgcccctcacccagctccactgtccccacctgctgctgctgctgttggtgctgtcatgtctgccagaggcaccctctgcccaggtaatggactttttgtttgagaagtggaagctctatagtgaccaatgtcaccacaacctaagcctgctgcccccacctactgagctggtctgtaacagaaccttcgacaactactcctgctggcctgacacccctcccaacaccactgccaacatttcctgcccctggtacctaccttggtgccacaaagtgcagcaccgcctagtgttcaagaggtgtgggcccgatgggcagtgggttcgagggccacgggggcagccgtggcgcaacgcctcccaatgtcagttggatgatgaagagatcgaggtccagaagggggtggccaagatgtatagcagccagcaggtgatgtacaccgtgggctacagtctgtccctgggggccttgctccttgcgctggtcatcctgctgggcctcaggaagctgcactgcacccgaaactacatccatgggaacctgtttgcgtcctttgtgctcaaggctggctctgtgttggtcatcgattggctgctgaagacacggtacagccagaagattggcgatgacctcagtgtgagcgtctggctcagtgacggggcgatggccggctgcagagtggccacagtgatcatgcagtacggcatcatacccaactattgctggttgctggtagagggcgtgtacctgtacagcctgctgagccttgccaccttctctgagaggagcttcttttccctctacctgggcattggctggggtgcgcccctgctgtttgtcatcccctgggtggtggtcaagtgtctgtttgagaatgttcagtgctggaccagcaatgacaacatgggattctggtggatcctgcgtattcctgtcttcctggccttactgatcaattttttcatctttgtccacatcattcaacttcttgtggccaagctgcgtgcccatcagatgcactatgctgattacaagttccggctggccaggtccacgctgaccctcatccctctgctgggggtccacgaggtggtctttgcctttgtgactgacgagcatgcccaaggcaccctgcgctccaccaagctcttttttgacctgttcctcagctccttccagggtctgctggtggctgttctctactgtttcctcaacaaggaggtgcaggcagagctgatgcggcgttggaggcaatggcaagaaggcaaagctcttcaggaggaaaggttggccagcagccatggcagccacatggccccagcagggccttgtcatggtgatccctgtgagaaacttcagcttatgagtgcaggcagcagcagtgggactggctgtgtgccctctatggagacctcgctggccagtagtctcccaaggttggctgacagccccacctga

SEQ ID NO: 1289 - DNA, 1320 bp, Mus musculus
ggctgactgcagacaccattgccatggatggcctgatgtgggctacccgtatcctctgcttgctgagcctgtgcggagttacactgggtcacctccacctagaatgtgacttcatcactcagctgagagacgatgagcttgcatgtcttcaggcggcagaggggaccaacaacacctccctgggatgccctgggacctgggatgggctgctgtgctggcccccaacaggctctggccagtgggtctctctcccctgccctgaattcttctctcacttcggctcagacacagggtttgtgaagagggactgcaccatcactggctggtctaatcccttcccaccataccctgtggcttgccctgtgcccttggaactgttaaccaaggagaaatcgtacttctccacggtgaagatcatctacaccacgggccacagcatctccattgtagccctctgcgtggctattgccatcctggttgccctcaggaggctccactgccccaggaactacatccacacgcagctgtttgccaccttcatcctcaaggccagtgctgtgttcttgaaggatgccgccatcttccagggggatagcacggaccactgcagcatgtccactgtcctgtgcaaggtctctgtggccatctcacatttggccaccatgaccaacttcagctggctgttggcagaagctgtctacctgagctgcctgttggcctccacatcccccaggtccaaaccagctttttggtggctggtcctggctggctgggggctccccgtgctatgcactggtacgtgggtgggctgcaaacattcttttgaggacactgagtgctgggacttagacaacagctccccctgctggtggatcatcaaaggacccatagtcctctctgttggggtgaactttgggctgtttctcaatataatttgtatcctgctgaggaagctggagcctgcacaaggcggcctacacacacgggctcagtactggcggctttccaagtcaacacttctccttataccgctgtttggaattcattacatcatcttcaacttcctgcctgacagtgctggccttgacatccgtgtacccctggagctggggttggggtcctttcagggcttcattgttgctgtcctctactgcttcctcaatcaagaggtgaggacagagatttcacgcaaatggtatggccacgaccctgaacttctgccagctcgacggacctgcactgagtggaccacacctccccgatcgagattgaaggtgctgacctctgagtgctaggccagccatcatcacaagggccaag

SEQ ID NO: 1290 - DNA, 1471 bp, Mus musculus
atggccagcaccccaagcctcctgcgcctggcgctcctgctgctcggggcggtgggcagggccggcccccgccctcagggtaccacggtgtccctctcagagacggtgcagaaatggagagaataccggcggcagtgccagcatttcctcacggaagcgccactcctggccacaggcctcttctgcaaccggacctttgatgactatgcctgctggccggatgggcccccaggttccttcgtgaatgtcagctgcccctggtacctgccctgggccagtagtgtgctacaaggccatgtgtaccggttctgcacagctgagggtctctggctacataaggacaactccagcctgccctggagggacctgtcggagtgtgaagagtctaagcgaggggagagaaactttcctgaggaacagctcctgtccctgtacattatctacacagtggggtacgcactttctttctccgccttggtcatcgcttcagccatccttgttggcttcagacacttgcactgcaccaggaactacatccacctgaacctgtttgcatccttcatcctccgagcactgtccgtcttcatcaaagatgctgccctcaagtggatgtatagcacggctgcccagcaacaccagtgggatgggctcctctcctatcaggactctctaggctgccgactggtgttcctgctcatgcagtactgcgtggcagccaactactactggttgctggtggaaggcgtgtatctatacacactgctggccttctcggtgttctcggagcagcgcatcttcaagctgtatctgagcataggctggggagttccgctgctgttcgttatcccatgggggattgtcaagtatctctatgaggacgagggctgctggactaggaactccaatatgaactactggctcatcatccgattgcccattctctttgctatcggcgtcaactttcttatcttcatccgtgtcatctgcatagtggtctccaaactgaaggctaatctcatgtgcaagactgacatcaaatgcaggcttgccaagtccactctgactctcatcccccttctggggacacatgaagtcatctttgcctttgtgatggacgaacacgcccgaggaaccctacgcttcatcaagctgttcacagaactctccttcacttccttccagggcttgatggtggctatcctgtactgctttgtcaacaatgaggtccagatggagtttcggaaatgctgggagcgctggaggctggagcacttgaatatccagagagactgcagcatgaagcccctcaagtgtcccaccagcagcgtcagcagtggggccacagtggcagcagcgtgtatgcagccacctgccagagttcctacagctgagcccgcagtgccggtcctccctgttggtccttcgttctggctgggtggccatcccaggtgggagagatcctggggatagg

SEQ ID NO: 1291 - DNA, 984 bp, Mus musculus
atggctaacaatgcatctcttgagcaggacccaaatcactgctcggccatcaacaacagcatccccttgatacagggcaagctcccgactctaaccgtatctggaaagatccgagtgaccgtgactttcttccttttcctactctctactgccttcaatgcttccttcttgttgaagctgcagaagtggactcagaagaggaagaaaggaaaaaagctctcaaggatcaaggtgcttttaaagcatttgaccttagccaacctgctggagactctgatcgtcatgccactggatgggatgtggaatattactgttcagtggtatgctggggagttcctctgcaaagttctcagctatctgaagctcttctctatgtatgccccagctttcatgatggtggtgattagcctggaccgctccctggccatcactcagccccttgctgtacaaagcaacagcaagcttgaacagtctatgatcagcctggcctggattctcagcattgtctttgcaggaccacagttatatatcttcaggatgatctacctagcagacggctctgggcccacagtcttctcgcaatgtgtgacccactgcagctttccacagtggtggcatcaggccttctacaactttttcaccttcggctgcctcttcatcatccccctcctcatcatgctaatctgcaatgccaaaatcatctttgctctcacgcgagtccttcatcaagacccacgcaaactacagctgaatcagtccaagaataatatcccaagagctcggctgagaacgctaaagatgacagtcgcattcgctacctcctttgtcgtctgctggactccctactatgtcctaggcatttggtactggtttgatccagaaatgttgaacagggtgtcagagccagtgaatcactttttctttctctttgctttcctaaacccgtgcttcgacccactcatatatgggtatttctctttgtag

SEQ ID NO: 1292 - DNA, 1008 bp, Mus musculus
atgacagctctttcttcaaagaactgctctcttcaataccagctccatcagtctccgcagctcctggaggcctcctgtctgttgttcttgatcatcctggggaaagtgttattaaacatcctccttctaagagtgagaaggggagacgcccgctggactttgatggagtacttctgcttctcactcgcacttgtcgatctcctgctgttggtaaacatttccatcctgacctacttcagggactttgtagttctaggtattaggtttaccagataccacatctgtctgctcacacaaattatttccttcacttatggcttcttgcattacccagtctgctcactggcttgtatagactactggtgtaatctgtccagagccagcaagcagtcatctaggtggcagaaattactttatttcttgacagtcattttaacttggatctcagtccttgcttacgttttggttgacccggccatctcagtcagcctaaaggcacacaggggctatgtgtaccagtgccccgcctatgtcagcactcagagtcactggctctcactgtctatgctgatggttttatttgtggcttttctgatttcatggcaggaagttgttgccttgcttcaggctatgaggatagcatcctataagagcaaggccgccctctactttcctttcccactccactgcggttacgccctgagctgcagagaagcactcttgcccaggctcatcgtgtgctttcttgggacctggtttccctttgtagcacttcaggtcctcatcctctccctcagagttcagatcccggcgtacatagaaatgaacgtcccctggctgtactttgtcaacagtttcctcatcgctgcagtttattggtttaactgccacaagcttgatttaagagacagctcgttacctgtggatcctttcatcaactggaaatgctgctttgttccagtccatagacttaagcaagtggagaggcccatgtccatagtcatctgt

SEQ ID NO: 1293 - DNA, 1647 bp, Mus musculus
cagtctcccagcttccccgctgattcagcgcaggcacctttcggggtgtcatttcaaaagtcaaagaaaagctgtttgaggctagaaagggtgcgcagcttaagtgactggaaaagcccttccatttcagtctggagttggaagttatattcaaacaccacgacagcttggctccgcacagaacattaacagatttccttactcttcacctacaagatcatcatggaagtctcaaaggaaatgttatttgaggagttggacaactattcctatgccttagattattactcccaggagtctgacccggaggagaaggtgtacctgggactcgttcactggatctccctgttcttatatgccctagcatttgttctgggcatcccaggaaatgccatcgtcatttggctcatgggattcaagtggaagaagacagtcaccactctttggttcctcaatctggccatcgcagacttcatctttgttctcttcctgcccctgtacatttcctacgtggccttgagtttccactggccctttggcctgtggctctgcaaggttaattccttcattgcccaactgaacatgttttccagtgttttcttcttgacagtgatcagcctggaccgctacatccacttgctccatcctggcttgtctcatcggcaccggactctaaagagctcactggttgttgttatacttgtctggctgttggcttctctgcttggaggtcctaccttatacttccgggacaccatggaggtcaacaaccacatcatttgttataataatttccaggagcatgaactcaccttgatgagacaccatgttctgacctgggtgaagttcctctttggctacctcttccctttgctaaccatgagctcctgctacttgtgcctcatcttcaagatgaaaaagcggaacatcctgatatctagaaagcatctctggatgatcctgtctgtggtcattgccttcttggtttgctggaccccttatcacctgtttagcatctgggagctcagcattcatcacaacagctctttccagaatgtgctgcagggtggaatccccctctcaactggcttagccttcctcaatagctgcttgaatcccatcctttacgtcctaataagcaagacgttccaagcccgcttcagggcctctgttgctgaggtactaaagcgttcgctgtgggaagccagctgctctggtacagtcagtgaacaactcaggagtgctgaaaccaagagcctgtctctcctagaaactgcccagtgagtattgtgttcccagaaaatcagtgcaaagttttcatgtgagcctcataacaaatcctttcagattaggttgcattctgatccacactgatcatgtttttgttcagttatatttttgcttggctataaaagggaggatttcttccctgcaatttaaatcatgtatctttctggctgccctctggtggccgttctgatactgacagcctaaaagtttcttccactattttagcctgcgtctgttaatgtactgcaatgtatgtatcaaattaagtcatttttatagtgtataccacattatattaattatctctattgaaaaaaaaaaaaaaaaaaaaaaaaaaaaaaaaaaaaaaaaaaaaaa

SEQ ID NO: 1294 - DNA, 1110 bp, Mus musculus
atgacctcactgtccactgagaccactggagaccccgatttgtcttctgggctgttgccagctagctcgactccagccaaccagagcgcagaggcctcggagggcaacctgtctgcaacggttccccgagctgcagcagtcacgccgttccagagcctgcagctggtgcaccagctgaaggggttgatcgtgatgctgtacagcatcgtggtggtcgtgggtctggtgggcaactgcctgcttgtgctggtgatcgcgcgcgtgcgccggctgcacaacgtgaccaacttcctcattggcaacctggccttgtccgacgtgctcatgtgtgccgcctgtgtgcctctcacgctagcttatgcctttgaacctcggggctgggtgttcggtggaggcctgtgtcatctggttttcttcctgcagccggtcaccgtctatgtatcggtgttcacactcaccacaatcgccttggaccgctatgtggttctggtgcacccgctacgtcggcgcatttcactgaggctcagcgcctacgcggtgctgggcatctgggctctatctgcagtgctggcgctgccggccgcggtgcacacctaccatgtggagctcaagccccacgacgtgagcctctgcgaggagttctggggctcgcaggagcgccaacgccagatctacgcctgggggctgcttctgggcacctatttgctccccctgctggccatcctcctgtcttacgtacgggtgtcagtgaagctgaggaaccgcgtggtgcctggcagcgtgacccagagtcaagctgactgggaccgagcgcgtcgccgccgcactttctgtctgctggtggtggtggtggtagtgttcgcggtctgctggctgccgctgcacattttcaacctattgcgagacctggacccgcgtgccatcgacccctacgccttcgggctggtgcagctactctgccactggcttgctatgagctccgcctgctacaaccccttcatctatgcatggctgcacgacagctttcgagaggagctgcgcaagatgctgctgtcctggccccgcaagattgtgcctcatggccagaacatgactgtcagcgtggtcatc

SEQ ID NO: 1295 - skipped

SEQ ID NO: 1296 - DNA, 1017 bp, Mus musculus
atgaacaactccaccaccacagaccctccaaaccagccctgctcctggaacaccctgatcacaaagcagatcattcccgtgttgtacggtatggtcttcatcacggggctcctcctcaatgggatatcaggatggatattcttttatgtgcccagctccaagagttttatcatctatctcaagaacatagtggtggctgactttctcatgggcctgactttccctttcaaagtccttggtgactcaggcctcggcccctggcaggtgaatgtgtttgtgtgcagggtctctgccgtcatcttctatgttaatatgtacgtcagcatcgtgttctttgggctcatcagctttgacaggtactataaaattgtgaagccccttctgacgtctattgtgcagtcggtgaactatagcaagctgctttctgtgctcgtgtggatgctcatgcttctccttgctgtcccaaacatcatcctgacaaaccagggtgtcaaggaggtcacgaagatacagtgcatggagctcaaaaacgagctggggcggaagtggcacaaggcgtctaactatatcttcgtgagtatcttctgggtcgtgtttcttctgctaatcgtcttctacacggccatcacgaggaagatcttcaagtctcacctcaagtccaggaagaattccacctccgtcaagaggaagtccagccgcaatatcttcagcatcgtgctcgtttttgtcgtctgctttgtgccttaccacattgccagaatcccctacacaaagagtcagacggaaggtcactacagctgccggacgaaggagaccctgctctatgcgaaagaattcactctgctactctcggctgccaatgtgtgtctggaccccattatttatttcttcttatgccagccatttagagaagtcttaaataagaagttacacatgtcactcaaagtccagaatgacctagaggtttccaaaaccaaaagggaaaatgcgattcatgaaagcacagatactttgtaa

SEQ ID NO: 1297 - DNA, 1005 bp, Mus musculus
atgaacgaagacccgaaggtcaatttaagcgggctgcctcgggactgtatagatgccggtgctccagagaacatctcagccgctgtcccctcccagggctctgttgcggagtcagaacccgagctcgttgtcaacccctgggacattgtcttgtgcagctcaggaaccctcatctgctgtgaaaatgccgttgtggtccttatcatcttccacagccccagcctgcgagcccccatgttcctactgataggcagcctggctcttgcagacctgctggctggcctgggactcatcatcaattttgtttttgcgtacctgcttcagtcagaagccaccaagctggtcaccatcggactcattgtcgcctctttctctgcctctgtctgcagtttgctggctattactgtggaccgctacctctcgctatattacgccctgacgtaccactccgagaggaccgtcacctttacctatgtcatgctagtgatgctctggggaacctccatctgcctggggctgctgcccgtcatgggctggaactgcttgagggacgagtccacctgcagcgtggtcagacctctcactaagaacaacgctgccatcctctccatctccttcctcttcatgtttgctctgatgcttcagctctacatccagatttgtaagattgtgatgaggcacgcccatcagatagccctgcagcaccacttcctggctacatcgcactatgtgactacccggaaaggggtctcgaccctggctctcatcctagggacctttgctgcctgctggatgcctttcaccctctattccttgatcgccgattacacctacccctcgatctatacctatgccaccctcctgcccgccacctacaattccatcatcaaccctgtcatttacgctttcagaaaccaagagatccagaaagccctctgcctcatttgctgtgggtgcatcccttcctcgctgtctcagagagctcggtctcccagcgatgtgtag

SEQ ID NO: 1298 - DNA, 1703 bp, Mus musculus
agcagtggtccttccaccagaagcccagggtgaggacagagatggcgctgagcctggagtctacaagcttccccatgctggccgtgtccagaagcactgcgtctgagcttcctggtggctttaatgtgtcccacaacagttcctggactggcccaacagatcccagctccctgcaagaccttgtggccaccggtgtcatcggggcagtgctctcaaccatgggtgtggtgggcgtggtgggcaatgtgtacactctggtggtcatgtgccgatttctgcgtgcctcggcctccatgtacgtctatgtggtcaacctggccctggctgacctgctgtatctgctgagcattcccttcatcgtagccacctacgtcactaaggactggcacttcggggacgtgggctgccgagttctctttagcctggacttcctgacaatgcatgccagcatcttcaccctgaccataatgagcagtgaacgctatgcagcagtactgaggcccctggacaccgtccagcgctccaagggttaccgtaagctgttggcgctgggcacctggttgctggcactgctgctgaccttacccatgatgcttgccatccggctggtccgtaggggctctaagagcctctgcctgccagcctggggccctcgtgcccaccgtacctacctgacgctgctctttgggaccagcattgtggggcctggcctggtcattgggctgctctatatccgtctggccagggcctattggctatcccagcaagcttccttcaagcagacacggcggctgcccaaccccagggttctctacctcatccttggtatcgtccttctcttctgggcatgctttctgcccttctggctatggcagctgctggcccagtaccaccaggccatgccactgacacccgagactgcacgcatcatcaactacctgactgcctgcctcacttacggcaacagctgcatcaatcccttcctctacactctgctcaccaagaactaccgtgagtacctgcgtggccgccagcggtcactgggtagcagttgccgtggcccagggagtgctggcagcttcctgtccagccgtgtccacctccagcaggactcgggccgctcactgtcctccaacagccaacaggccacagagaccctcgtgctgtctccagttccccctaatggggcctttgtgtgagagtgctttgtgtgaccctgcgggtaggaaaggacccaaaggcaggccactcaggaacccattcccagaatcccctactcaaacctaactcacttgtctgtcttcttgtggaaagtcccctcttctctgttgttctcatcagctctatcagagcctttcctatgatgccaatacattcctgcttcaaaccagtctctgaggggcttcagaagctgtggcccagaccctcttctgaagaccctggtgtgctgagtcatgtaaggcctaattacccagagcagctagtaccaggctgtaacctgacctttgatgtaagcccttccagcctgaggaccctcccccattggttggtaaggggcctgcaggcatctctaccctctctctccccatccattccacggtagcttcttgctcccatatgcacatggaacaataaaccctgttctctgaagtgtgtcctgcctcagtgttgggggtggaagttggggtgggatgggggtcctg

SEQ ID NO: 1299 - DNA, 1083 bp, Mus musculus
atggaaccagcaacagccctgctgattgtggattactatgactacacaagcccagatcctcctttcctggagactccctcccacctgtcctacacatctgtcttcctccctatcttttacacagttgtattcttgactggagtggtggggaatttcatcctcatgatagctctgcatttcaaacgcggcaaccgaagattgatcgacatctttatcatcaacctggctgcctctgacttcattttccttgtcacagtgcctctttggatggataaggaagcctctctaggactatggaggactggctctttcctgtgcaaaggcagctcctatgtgatctccgtgaacatgcactgtagtgtcttcttgctcacatgcatgagcatggaccgttacctggctatcatgcacccagccttagccaagagattacgaaggagaagctctgcatatgcagtgtgtgccgtcgtctggatcatctcatgcgtcctggggttgcccactcttctgtccagggagctcactcacattgaaggcaaaccatactgtgcagagaagaaacccacgtccttaaaactgatgtggggcctggtagccttgattaccacctttttcgtccccctcctgagcattgtgacctgctactgttgcatcacaaggaggctgtgtgctcattaccagcagtcgggaaagcataacaagaaactaaagaagtccataaagatcgttattattgcggtggcggccttcaccgtctcctgggtaccctttaacactttcaagctcctagccattgtttcagggttccagccagaaggcctttttcactccgaggctttgcagctggccatgaatgtgactgggcccttggcctttgccagcagctgtgtcaaccctctcatttactatgtctttgacagctatatccgccgggccattgtacgttgtctgtgcccttgtctgaagacccacaactttgggagcagcactgagacatcggacagtcacctcactaaggctctttccaacttcattcatgcagaggatttcatccggcggaggaagagatctgtgtcactctaa

SEQ ID NO: 1300 - DNA, 993 bp, Mus musculus
atggccaccctgagcaatcacaaccagcttgatctttctaatggctcacacccagaggaatacaaaatcgcagccctagtcttctacagctgcatcttcctgattgggctgtttgttaatgtcactgcgttgtgggttttcagctgtacgaccaagaaaagaaccacagtgaccatctacatgatgaacgttgcactactggacctcgtatttatactcagtctgccctttcggatgttttactatgcaaaaggcgagtggccatttggagagtacttctgccacattcttggggccctggtggtgttttacccaagcctcgctctgtggcttcttgctttcattagtgctgacagatacatggccatcgtacagccaaaatatgccaaggagctgaagaacaccggcaaggccgtgcttgcgtgtgggggggtctgggtaatgaccctgaccaccactgtccccctgctactgctctacgaagacccagacaaggcctcctccccagccacctgcctgaagatctccgacatcacccacttaaaagctgtcaacgtgctcaacttcacgcgactcatatttttcttcctgatccctttgttcatcatgatcgggtgctacgtggtcatcattcacagtctcctccgagggcagacgtctaagctgaagcccaaggtcaaggagaagtccatacggatcatcatgaccctcctgctgcaggtgctcgtctgcttcgtgcccttccacatctgctttgccgtcctgatgctacaaggacaggagaacagctatagcccctggggagccttcaccaccttcctcatgaacctcagcacctgtctcgatgtagtcctctactacatcgtttccaaacagttccaggctcgagtcatcagcgtcatgctgtaccgcaattaccttcgcagtgttcgcagaaaaagtgtccgatcgggcagtttacggtcacttagcaacatgaacagtgagatgctt

SEQ ID NO: 1301 - DNA, 1230 bp, Mus musculus
atggataacgaccagccgcctgtggtgactgccaccctgctggtgccccttcagaacggcagctgcgcggaagcagctgaggccctgctgccccatggcctgatgggattgcatgaggagcacagctggatgagcaacaggacagagcttcagtacgagctgaaccctggagaggtggccaccgccagcatcttctttggcgctttgtggttgttctccatctttggcaattccctggtatgtctggtcatccaccggagccggaggactcagtccaccaccaactacttcgtggtgtccatggcgtgtgctgaccttctcatcagcgtggccagcacgccgtttgtcgtgctgcagttcaccaccgggaggtggaccctgggtagcgccatgtgcaaggtggtccgctacttccagtacctcacccccggcgtgcagatctacgtgctgctctccatctgcatcgaccgcttctataccatcgtctacccgctgagcttcaaggtgtcccgagagaaggccaagaaaatgattgcagcctcctggatcttggacgcggccttcgtgacgcctgtcttctttttctacggctctaactgggatagtcactgtaactacttcctccctccctcctgggagggaactgcctataccgtcatccacttcttggtgggcttcgtgattccctccatcctcataatcctgttttaccagaaggtcataaagtatatctggagaataggcacggacgggcggacgctgagaaggacgatgaacattgtccccaggacaaaggtgaaaacggtcaagatgttcctgctcttgaacctagtgttcctgttctcctggctacctttccatgtggctcagctctggcatccccatgagcaagactacaagaagagctcccttgtcttcacggcagtcacgtgggtatctttcagctcttcagcctcgaaacccactctgtactctatttataatgccaattttcggagagggatgaaagagacattctgcatgtcctcgatgaaatgctaccgcagcaatgcctacaccatcacgaccagctcgcggatggccaaaagaaactatgtgggcatttcggaaatccctcccgtgagcaggaccataaccaaagactccatctatgactcatttgaccgggaggccagggagaagaagctcgcctggcccatcaactcaaaccctccaaacacttttgtctga

SEQ ID NO: 1302 - DNA, 1089 bp, Mus musculus
atggggaccaagcccacagagcaggtctcctggggactttactccgggtacgatgaggaggcctattcggttgggccgctgccagagctctgttacaaggctgatgtccaggctttcagtcgggccttccaacccagtgtctccctgatggtggctgtactgggtctggctggcaatggcctagtcttggccacccatctggcagccagacgaactacccgatctcccacctccgttcacctgctccagttggccctggctgaccttttattggccctgactttgccttttgctgcagcaggggctcttcagggctggaatctaggaagtaccacctgccgtgccatctcaggcctctactcggcctctttccacgctggcttcctcttcctagcctgtatcagcgccgaccgctatgtggccatcgcacgagctctcccagccgggcagcggccctcaacgcctagccgagcgcacttggtttcagtcttcgtgtggctgttgtcgctgtttctggctctacctgcgctccttttcagccgggacgggccacgtgaaggccaacgacgctgtcggctcatttttcccgaaagcctcacgcagactgtgaaaggggcaagcgcagtggcgcaggtggtcctcggcttcgcgctccctctgggcgtcatggcagcctgttatgcgctcctgggccgcacgcttctggccgccagggggccagagcggcggcgtgcactgcgcgtcgtggtggctttggtggtggccttcgtggtgctgcagttgccctacagccttgccctgctgctggatacagccgatctactggcagcccgcgagcggagctgctcctccagcaagcgcaaggatctagctttgctggtcaccggcggcttgaccctggtccgttgcagcctcaatccggtgctttatgcctttttgggcctgcgtttccgccgggacctgcggaggctgctccagggcggaggatgcagcccgaagcccaaccctcgtggccgctgcccccgtcgactccgcctttcttcctgctctgctcctactgagacccacagtctctcttgggacaactag

SEQ ID NO: 1303 - DNA, 1296 bp, Mus musculus
atgtgtttttctcctgttctggaaatcaacatgcagtctgaatcaaacgtcacggtgcgagatgacattgatgacatcgacaccaatatgtaccaaccactgtcatacccactaagctttcaagtgtctctcactggatttctcatgttagagatcgtgctggggcttggcagcaaccttaccgtcctggtactttactgcatgaaatccaacttaatcaactctgtcagtaacattattacaatgaacctccatgtacttgatgtcataatttgtgtgggatgcattcctctaactatagtgatccttctgctctcactggagagtaacactgctctcatctgctgtttccacgaagcttgtgtttcctttgcaagtgtttcgacagcaatcaacgtttttgctattactctggacagatatgacatctctgtaaaacctgcaaacagaattctgacaatgggcagagctgtaatgctaatgacatccatttggattttttctttcttctcattcctgattcccttcattgaagtaaattttttcagtcttcaaagtggaaatacatgggcaaacaagacactgctgtgtgtcagtacaagtgaatactatactgagctcgggatgtactatcaccttttggtgcagatccccatcttcttcttcacagttatagtcatgttgatcacatacactaagatactccaggctcttaacatccgcataggcactagattctcaacaggacagaagaagaaagcccgaaagaaaaagacaatctctctagctacacatgagaccacagacatgtcacaaagcagtggtgggaggaatgtcgtgtttggtgtgagaacttcagtttctgtaataattgccctccggcgagccgtgaaacgccaccgggaacgacgagaacggcagaaaagagtcttcaaaatgtcgttattgattatttctacatttcttctctgttggacaccaatttctgttttaaataccaccattctatgtttaggcccaagtgaccttttagtaaaattaagattgtgttttctagtcatggcttatggaacaacgatattccaccctctcttgtatgcattcaccagacaaaagtttcaaaaggtcttaaagagtaagatgaaaaagcgagttgtttccatagttgaagctgatcccatgcctaataacgctgtaatacacaactcatggatagatcctaaaagaaacaaaaaggttacctatgaagacagtgaaataagagagaaatgtttagtacctcaggttgtcacagac

SEQ ID NO: 1304 - DNA, 1062 bp, Mus musculus
atggatctgcaagcctcgttgctgtccactggccccaatgccagcaacatctccgatggccaggataatttcacattggcggggccacctcctcgcacaaggagtgtctcctacatcaacatcatcatgccttcagtgtttggtaccatctgtctcctgggcattgtgggaaactccacagtcatttttgccgtggtgaagaaatccaagctgcactggtgcagcaacgtccctgacatcttcatcatcaacctctctgtggtggatctgcttttcctgctgggcatgcctttcatgatccaccagctcatgggtaatggtgtctggcactttggggaaaccatgtgcaccctcatcacagccatggacgccaacagtcagttcaccagcacctacatcctgactgctatggccattgaccgctacttggccaccgtccatcccatctcctccaccaagttccggaagccctccatggccaccctggtgatctgcctcctgtgggctctctcgttcattagcatcactcctgtgtggctctatgccaggcttatccccttcccagggggtgctgtgggctgtggcatccgcctaccaaacccagatactgatctttactggttcactctgtatcagtttttcctggccttcgcccttccgtttgtggtcatcactgctgcgtacgtgaaaatactacagcgcatgacgtcttcggtggccccagcctctcaacgcagcatccggcttcggacaaagagggtgacccgcacagccattgccatctgtctggtcttctttgtgtgctgggcgccctactacgtgctgcagctgacccagttgtccatcagccgcccgaccctcacattcgtctacctgtacaatgcggctatcagcttgggctatgccaacagctgcctcaatccctttgtgtacatagtactctgtgagacctttcgaaaacgcttggtgctgtcggtgaagcccgcggcccaggggcagcttcgcacggtcagcaatgctcagacagctgacgaggagaggacagaaagcaaaggcacctga

SEQ ID NO: 1305 - DNA, 1140 bp, Mus musculus
atggcgaacgctagtgagccgggcggcggcggcagcggcggaggggccgaggctgccgcgctgggccttaggctggccacgctcagcctgctgctgtgcgtgagcctggcgggcaacgtgctgttcgcgctgctcatcgtgcgggagcgcagcctgcaccgcgcgccgtactacctgctgctcgacctgtgcctggccgacgggctgcgcgcgctcgcctgcctcccggccgtcatgctggcggcgcggcgcgcggcggccgcggcggggacgccgccgggcgcgctgggctgcaagctgctggccttcctggccgcactcttctgcttccacgcggccttcctgctgctgggcgtgggcgtcacccgctacctggccatcgcgcaccaccgcttctacgccgagcgcctggccggctggccgtgcgccgcgatgctggtgtgcgccgcctgggcgctggctttggccgcggccttcccgccggtgctggacggcggtggcgcggacgacgaggacgcgccgtgcgccctggagcagcgacccgacggcgccccgggtgcgctaggcttcctgctgctcctggccgcggtggtgggcgccacgcacctcgtctacctccgcctgctcttcttcatccacgaccgccgcaagatgcgacccgcgcgcctggtgcccgccgtcagccacgactggaccttccacggcccgggcgccaccggtcaggcggccgccaactggacggcgggcttcggccgcgggcccacgccacctgcgctcgtgggcatcaggcctgcaggcccgggccgcggcgcccggcgcctcctggtgctggaggagttcaagacggagaagaggctgtgcaagatgttctacgccatcacgctgctcttcctgctcctctggggcccctatgtggtggccagttacctgcgcgtcctggtgcgcccgggagctgtcccgcaggcctacctgacagcctcggtgtggctgacattcgcgcaggccggcatcaaccccgtggtgtgtttcctcttcaaccgggagctgagggactgtttccgagcccagtttccctgctgccagagcccccaggccacgcaggccaccctcccctgcgacctgaaaggcattggtttgtga

SEQ ID NO: 1306 - DNA, 993 bp, Mus musculus
atgatgtggggagcaggaagctctatggcctggttctcagctggctcaggcagtgtgaacgtgagcagcgtggacccagtagaggaacccacaggcccagctacactgctgccctctcccagggcctgggatgtggtgctgtgcatctcaggcaccctggtgtcctgcgagaacgcgctggtggtggccatcattgtgggcactcctgccttccgcgcccccatgttcctgctggtgggtagcttggccgtagcagacctgctggcaggcctgggcctggtcctgcactttgcggctgacttctgcattggctcaccagagatgagcttgatgctggtcggcgtgctagcaatggccttcactgccagcatcggcagcctgctggccattaccgttgaccgctacctttccctgtacaatgctctcacttactactcagagacaacggtaactcggacttatgtgatgctggccttggtgtgggtgggtgccctgggcctggggctggttcccgtgctggcctggaactgccgggatggcctgaccacgtgtggtgtggtctatccactctccaagaaccatctggtggttctggccatcgccttcttcatggtgtttggcatcatgttgcagctctatgcccagatctgccgcatcgtctgccgccatgcccagcagatcgccctccaacgacacctgctgcctgcctctcactacgtggccacccgcaagggcatcgccacattggctgtggtgcttggcgcctttgctgcctgttggttgcccttcactgtctactgcctcctgggagatgccgactctccccgtctctacacctatcttaccctgctcccagccacctacaactccatgatcaaccctgtcatctacgcctttcgcaaccaagatgtgcagaaggtgctgtgggccatctgctgctgctgttccacttccaagattccattccggtcccggtcccctagtgatgtctag

SEQ ID NO: 1307 - DNA, 1128 bp, Mus musculus
atggatgcgactactccagcccaaactgttggggtggagatctacctaggtcccgtgtggccagccccttccaacagcacccctctggccctcaacttgtccctggcactgcgggaagatgccccggggaacctcactggggacctctctgagcatcagcagtacgtgattgccctcttcctctcctgcctctacaccatcttcctctttcctattggctttgtgggcaacatcctcatcctggtggtgaacatcagcttccgggagaagatgaccatcccagacctgtacttcatcaacctggcggcggccgacctcatcctggtggctgactccctgattgaggtgttcaacctggacgagcagtactacgacatcgcagtgctctgcaccttcatgtccctcttcctgcagatcaacatgtacagcagcgtcttcttcctcacctggatgagcttcgacaggtacctagcgctggccaaggccatgcgctgtggcctcttccgcaccaagcaccacgcacggctcagctgtggcctcatctggatggcctcagtgtccgccacgctggtgcccttcacagcggtgcacctgcggcacacggaggaggcctgcttctgctttgctgatgtcagggaggtgcagtggctggaggtcacactgggcttcatcatgcccttcgccatcattggcctctgctactccctcatcgtgcgagccctcatccgggcccacaggcaccgcggcctgcgcccacgcaggcagaaagccctgaggatgatcttcgcagtggtccttgttttcttcatctgctggctgccggagaacgtcttcatcagtgtccacctactgcagtggacgcagccaggggacactccctgcaagcagtctttccgtcacgcctaccccttgacaggccacatagtcaaccttgcagccttctccaacagctgcctgaatcccctcatctacagcttcctgggagagaccttcagggacaagctcaggctctatgtggagcagaagacgagcctgccggctctgaaccgcttctgccatgccacgctcaaggccgtcattccagacagcacagagcagtcagagatcaggttcagcagtgctgtgtga

SEQ ID NO: 1308 - DNA, 1128 bp, Mus musculus
atgactactacttcagttgacagctggctttgctcctctcatggaatgcactttataactaattatagtgaccaagcctcacaaaatttctcaggagtgccaaatgtcactagctgtccaatggatgaaaaattactatctactgtgttaacaaccttctactctgttatattcctcgtgggactggttggaaacatcattgccctctatgtatttctgggcattcaccgtaaaagaaattccattcaaatttatctacttaatgtggctgttgcagaccttctactcatcttctgcctccctttccgcataatgtatcacatcaaccaaaacaagtggacactaggtgtgattctttgtaaagttgtggggacactattttacatgaacatgtacattagcattattttgcttgggtttatcagtttggatcgctatataaaaatcaatcggtctatacaacaaagaagggcaataaccaccaagcaaagtatttatgtttgctgtatagtatggacggttgctcttgctggatttctaactatgatcattttgacactgaagaagggaggtcataattccacaatgtgtttccattacagagacagacataatgcaaagggagaagcaatttttaactttgttcttgtagtaatgttctggcttattttcctactgataatcctctcatatattaagattggcaagaatctactgaggatttctaaacggaggtcaaaatttccaaactctggcaaatatgctacaacagcccggaactcctttattgtactgatcatttttactatatgctttgtgccttaccatgcctttcggttcatttacatttcttcacagctaaatgtgtcctcttgttattggaaggaaatcattcacaaaactaacgagatcatgctggttttctcctctttcaacagttgcctggatcctgtcatgtatttcctgatgtccagtaatattcgcaaaatcatgtgtcaacttctttttagaaggtttcaaagtgaagcaagcagaagtgaaagcacttcagaatttaagccaggacattccttgcatgatctgtccgtgacagtcaaaatgccccagtacagcactaagggtaattga

SEQ ID NO: 1309 - DNA, 924 bp, Mus musculus
atgaatagtacaacctgtaacagcaccctcacgtggcctgcttccgtcaacaacttcttcatcatctactcagccttgctgctggtgctgggcctgctgctcaacagcgtggcactctgggtattctgctatcgcatgcaccagtggacagagacccgcatctatatgaccaacctggctgtggccgacctctgcctgctctgctccttgccatttgtgctgtactccctgaaatatagttcttcagacacacccgtctgccagctctcacagggcatctacctggccaacagatacatgagcataagcctggtcactgccattgctgtggaccgctatgtggcagtgcggcatcccctgcgtgcgcgtgagctgcggtccccgagacaggctgcagcagtgtgtgtggccctttgggtgatagtggtcacctccctggtagtgcgctggcgcctggggatgcaggagggtggcttctgcttcagcagccaaacccggcgcaatttcagcaccactgccttctcactgctgggattctacctgccgctggccatcgtggtcttctgctctttgcaggtagtgactgtgctatcgagaaggccagccgctgatgtggggcaggcagaggccacccaaaaggccacccacatggtctgggccaacttggctgtgtttgtcatctgcttcctgcccttgcatgtggtcctgaccgtgcaggtctccctgaacctcaatacctgtgctgcccgagacaccttcagccgtgccctgtccatcacaggtaaactctcagacaccaactgctgcctggatgccatctgttactactacatggccagagagttccaggaagcgtccaagccagccacgtcttccaacacaccccacaagagccaagattcccagatcctgagcctcacctag

SEQ ID NO: 1310 - DNA, 1803 bp, Mus musculus
atgccagcccggggcgcgcctctctcgcgcacatcgcggctgctgctccttctgctgtttaaggtttctgtctctgctgccctgagctttgtccctgagcccaggaatggaacttgtctgggggagagctgttccccactgatccaacgccgcagcagggatgcccgtggacctgggaattcggcaaaagacgctctgcgagtccatgtgcccagagagaaactggaagcagaggtgagaggggcgacctcttgggacctcccaccacccaggggcggtgacacaggtgtgattgaagaagcggcggctgctgggcccttgggacctccaaccaagccaccaagtgcctggagatggaaaagtgcccagggtaaagaaccatccgggcatttgaggagaagggaccccacggatccccaactcttctttccgacatcggaggggggagagatgagttccaagcgcgatgggattccccagagcaggcaggagcacagtgtgaaaacggaacccagagatcttttttactggccacgaagaactggacaactccaggattcccaacacaggccttcagcagtacacgaaggaaggacccttgctcctccaggcagggcactaccgcaaaacgggtctgcagatgactgggttcctgaccaagggggtccaccccgtggaaaccccacgcggcgcgtgagattgaagaaccccttctacccattgacccaagaatcctacggagcctatgcggtcatgtgcttatctgtggtgatctttgggaccggcattattggcaacttggcagtgatgtgcatcgtgtgtcacaattactacatgaggagcatctccaattctctcttggccaacctggctttctgggactttctcatcatcttcttctgcctccccctggtcatcttccatgagttgactaagaagtggcttttggaagatttctcctgcaagatcgtgccctatatcgaggtggcttctctgggtgtcactaccttcaccttatgtgcactgtgcatagatcgcttccgggctgccaccaacgtccagatgtactatgaaatgattgaaaattgctcttccaccactgccaaacttgccgttatctgggttggagctctgcttttggcccttccggaagttgtcctccgccagctgagcaaggaagatttgggctttagtggccaggctcctgcagaacggtgtgtcataaagatctctcctgatttaccggacacaatctatgttttggctctcacctatgatggtgcaaggctttggtggtattttggctgctacttttgtctgcccacacttttcaccatcacctgctctctagtgactgctcggaagatccgcaaagcggagaaggccagtacccgtggaaacaagcggcagatccatctagagagccagatgaactgcacagtggtggctctgaccattttatatgggttttgcatcatccctgaaaatatctgcaacattgtcactgcctacatggccacgggcgtctctcagcagaccatggacctgctcaacatcatcagccagttccttttgtttttcaagtcctgtgtcacccccgtgctcctcttctgcctctgcagacccttcagcagggccttcatggagtgctgctgctgctgctgtgaggagtgtatccagaagtcttccactgtgaccagtgacgacaacgacaacgagtacaccacagagctggagctgtcgcccttcagtactatccgcagggagatgtccacttttgcttctgtggggactcattgctga

SEQ ID NO: 1311 - DNA, 1819 bp, Mus musculus
ggatccgaactcaggtctcctggaagagcagcaagctctctctaactgccgagtcatccctcaaggcagcccctgatttctctggtgagggttctttccttttgaaggggtacagaaactctggtcacagagtaagggacaagcagtgaactcggggtctctgtcgccccatacagcctggttctgacttccctctgctccttattccccagagtctctgggatcagacatcgttgccttggttctggaaccttctttctcttcctgttacacccagtcgttatcttcatcctaagagcggtactgtggaggagcagctggggactgaaagcttggaatccttgatgctgacccgagttcggttgctctccggcggccatttccttctgtgggccttggcatcctcagtgactctaggactggcttctggtgctctgggcaggaggaacgccagttgtgacattcttttctctgcagatgagctgagtacaagtgaacaggaggaacagtggcgaccaacacccactcggcctcatggacctgcccccacagttctccttcgctctctatgtatctgcctttgcgctgggctttccattgaacttgttagccatccgaggcgcagtgtcccacgctaaactgcgactcactcccagcttggtctacactctccatctgggctgctctgatctcctactggccatcactctgcccctgaaggctgtggaggccctggcttctggagcctggcccctgccgctccccttctgcccagtctttgccttggcccactttgctcccctctacgcaggcggaggcttcctagctgctctcagcgctggccgctacctgggggctgccttccccttcgggtaccaagccatccggaggccccgctattcctggggtgtgtgtgtggctatatgggcccttgtcctctgccacctggggctggcccttggcttggagacttccggaagctggctggacaacagtaccagttccctgggcatcaacatacccgtgaatggctccccggtctgcctggaagcctgggatcccgactctgcccgccctgcccgtctcagtttctccattctgctcttctttctgcccttggtcatcactgccttctgctatgtgggctgcctccgggccctggtgcgctcaggcctgagccacaaacggaagctcagggcagcttgggtggccggaggcgctctcctcacactcctgctctgcctggggccctataatgcctccaatgtggctagtttcataaacccggacctaggaggctcctggaggaagttgggactcatcacaggggcctggagtgtggtactcaacccactggtcactggctacttgggaacaggtcctggacggggaacaatatgtgtgacgaggactcaaagaggaacaattcagaagtagcagccacctctgggggcaaggggcactgcgtggaattggatgactctgactctgccaggctcccaagagggcagatccaccacaactcagaggcctggcccaaagccatcgcagaaaccactcatgggaaagggttccacctggagaggacaagcgtcctttgtacgaaaaaaagtggaggcaaagtgctggacaacaagaaaacagtacgttttggcttaacaccttaagctgcttccaactgcttctggcctgtattgtcctaactggcttgccgtaagcgtgcgcaatcctcttcttgggggggaacgggaaacttaaattctgatctggaggaaaaccccccttcattgaaccaagttttggagggggttccttgaaa

SEQ ID NO: 1312 - DNA, 1914 bp, Mus musculus
atggggacaagcttctttcttggcaattactggcttttcttttccgtctacctgttggtgttcctcgtgggactccccctcaacgtgatggccctggtggtcttcgtgggcaagctgcgccgacgcccagtggctgtggacttacttttgctaaacctgaccatttcggacctgctcctgctcctcttcctgccgtttcgcatggtggaggcagcatgtggcatgagatggcttctgcccttcatcttctgccccctttctgggttccttttcttcaccactatttacctcacctccctcttcctgacggcggtgagcatcgaacgttttctgagcgtggcctatccactgtggtacaaaacccggccccggctggcccaggctggtctggtcagtgtagtctgttggttcctggcatcggctcactgtagtgtggtttacatcactgaatactggggaaatgcaacctacagccaggggaccaatggaacctgctacctggaattccgggaggaccagctggccatcctcctgcctgtacgactagagatggctgtggtccttttcatggtgcccctgtgtatcacgagttactgctacagtcgcctggtgtggatactgagccggggggccagccggcgccggcgcaagaggataatggggcttcttgcagccacactgctcatcttcttcgtctgcttcggcccctataatatgtcccatgtggtgggctatgtcagccgtgagagtccgtcctggcggagctacgtgctcctcctcagcaccctcaactcttgtatcgaccccctggttttctacttttcttcctccaagttccaagccgactttcatcaactcctggggaggctgctcagaacttgtgtgccttggactcagcaagtcagcctggaactgaaggtaaagaatggagaagagccatccaaggagtgtccgagcatggggacaagcttctttcttggcaattactggcttttcttttccgtctacctgttggtgttcctcgtgggactccccctcaacgtgatggccctggtggtcttcgtgggcaagctgcgccgacgcccagtggctgtggacttacttttgctaaacctgaccatttcggacctgctcctgctcctcttcctgccgtttcgcatggtggaggcagcatgtggcatgagatggcttctgcccttcatcttctgccccctttctgggttccttttcttcaccactatttacctcacctccctcttcctgacggcggtgagcatcgaacgttttctgagcgtggcctatccactgtggtacaaaacccggccccggctggcccaggctggtctggtcagtgtagtctgttggttcctggcatcggctcactgtagtgtggtttacatcactgaatactggggaaatgcaacctacagccaggggaccaatggaacctgctacctggaattccgggaggaccagctggccatcctcctgcctgtacgactagagatggctgtggtccttttcatggtgcccctgtgtatcacgagttactgctacagtcgcctggtgtggatactgagccggggggccagccggcgccggcgcaagaggataatggggcttcttgcagccacactgctcatcttcttcgtctgcttcggcccctataatatgtcccatgtggtgggctatgtcagccgtgagagtccgtcctggcggagctacgtgctcctcctcagcaccctcaactcttgtatcgaccccctggttttctacttttcttcctccaagttccaagccgactttcatcaactcctggggaggctgctcagaacttgtgtgccttggactcagcaagtcagcctggaactgaaggtaaagaatggagaagagccatccaaggagtgtccgagc

SEQ ID NO: 1313 - DNA, 990 bp, Mus musculus
atgaccccagactggcacagttccttgatcctcacggcctacatcctcatctttcttactgggctccctgccaacctgctggccctgcgggccttcatgggccgggttcgccagcctcagcctgcccctgtgcacatcctcctgcttaatctgaccctggcggacttgctcctgttgctgctgctgcccttccggatcgtggaagcagcatccaacttccgctggtacctaccaaagatcgtgtgcgcgctgacaggcttcggcttctacagcagcatctactgcagcacgtggctgctggcgggcatcagcatggaacgctacctgggagtggccttcccggtgcagtacaagttatcccgccggccactgtatggagtgatcgctgctctggtggcctggatcatgtcctttggccactgcaccatcgtcatcatcgttcagtacctgaactcaactgagcaggtgggcactgagaaccaaataacctgctacgagaacttcacccaagagcagctggatgtggtactgcccgtacgactggagctgtgcctggtcctgtttttcgttcccatggcagtcaccatcttctgttattggcgcttcgtgtggatcatgctcacgcagccccacgttggggctcagaggcgacgccgggcagtgggcctggctgttgtgacgcttcttaatttcctggtgtgctttggaccctacaacatgtcccacctggtggggttctacctgaggcagagcccctcgtggcgggtggaggctgtggtgttcagttccctcaatgccagcctggatccattattgttctacttctcctcctccgtggtgcgcagagcttttgggaaaggtttgctactgatccgcaatcctgcctcctctatgctgggcaggggagccaaagagacagtggaggggaccaagatggacaggggtggaagtcaagcagaaggggtacagagttctgaatttgtcaccgag

SEQ ID NO: 1314 - DNA, 1149 bp, Mus musculus
atggccaacgtcacactgaagccgctctgtccactcttggaggagatggtccagcttccaaaccacagcaactctagcctccgctacatcgaccacgtgtcggtgctgttgcacgggctggcctcgctgctgggcctggtggaaaacggactcatcctgtttgtggtgggctgtcgcatgcgccagacagtggtcaccacctgggtgctgcacctggcgctatccgacttgttagccgccgcctccctgcctttcttcacctacttcctggcagtgggccactcgtgggagctgggcactaccttctgcaagctacattcctcggtcttcttcctcaacatgtttgccagcggcttcctgctcagtgccattagcctggaccgctgcctgcaggtggtgaggccagtgtgggcacagaaccaccgcacggtggcggtcgcgcacagagtctgcctgatgctctgggctctggcggtgctcaacacaataccatatttcgtgttcagagacaccatcccgcggcttgatggccgcatcatgtgctactacaacttgctgctctggaatccagggcctgaccgcgacaccacgtgcgactaccgccagaaggccctggcggtcagcaaattcctgctggccttcatggtacctctggccataattgcctcgagccacgtagccgtgagcctgcgactgcaccaccgtggtcgccagaggacaggccgctttgtgcgcctggtggcggccatcgtggttgccttcgtgctctgctgggggccctaccacatcttcagtctgctggaggcgcgtgcccattctgtcaccacgctacggcagctcgcgtcacgtgggctgccctttgtcaccagcctggccttcttcaacagcgtggtcaacccactgctctatgtgttcacatgccccgacatgttgtacaaactgcggcgctcgctacgcgcggtgcttgaaagcgtgctggtagaagacagcgaccagagtggtgggctccgcaatcgccgtcgccgcgcctcctccaccgccaccccagcctctaccctcctgctggctgaccgaattccccaactgcgtccaacccgcttgatcggctggatgaggcgtggcagtgcagaggtcccacagagggtctga

SEQ ID NO: 1315 - DNA, 1122 bp, Mus musculus
atggcctgtaacagcacacccatggggacttacgaacatctgctgctgaatgtgagcaacactttggaccctggggacaccccactgtctgcaccgctcaggatctcgctggcaataatgatgctgctgatgatcgtggtaggattccttggcaacacggtggtctgcatcatcgtgtaccagaggccagccatgcgttcagctatcaacctgctgctggccaccttggccttctccgacatcatgctgtctttatgctgcatgccattcacggccatcaccctcatcactgttcgctggcatttcggggaccacttttgtcggctttcagctactctctattggttttttgtcctagagggcgtggccatcctgctcatcattagcgtggaccggtttctcatcatcgtgcagcgtcaggacaagctgaacccacgcagggctaagatgatcatcgcggcctcctgggtgctgtctttctgcatctctgcgccctccttcactggctggacgttcatggaggtgcctgctcgagccccacagtgcgtgctaggctacactgagttcccagctgaacgcgcctatgtagtgacactggtggtggcagtgttctttgctcccttcggcgtcatgttgtgctcctatctgtgcatcctcaatacggtgcggaagaacgctgtccgtgtgcacaaccagtcggacagcctggacctcagacagctgaccggagctggcctgagacgtctcagacggcagcagcagcaggccagcctggacctgagtttcaaaaccaaggccttcaccaccatcctcatcctcttcgtgggcttttcactctgctggctgccacactcagtctacagcctgctgtctgcgttcagccggcggttctattacagcgcctccttctacaccaccagcacatgcgtcctgtggctcagttacctcaagtctgttttcaaccccatcgtctactgctggaggatcaagaaattccgcgaggcctgcatagagttgcttccccacactttccaaatcctccctaaagtgcctgagcggatccagaggaaaatccagccaagcaccatctatgtgtgcaacgaaaaccaatccgctgtctag

SEQ ID NO: 1316 - DNA, 2724 bp, Mus musculus
atggacacctcctgcgtccacatgctcctgtccttgctggcgctgctgcagttggtggccgccggcagctcaccgggaccagatgcgataccgcggggctgcccatcacactgtcactgtgagctggatggcaggatgctgctcagggtggactgctcggacctggggctctcggagctgccctccaacctcagcgtcttcacctcctacctggacctcagtatgaacaacatcagtcagctacccgccagtctcctacatcgcctctgcttcctagaagagttacgtcttgctggaaatgctttgacacacattcccaagggagcgttcacgggccttcacagcctcaaagtgcttatgctgcagaacaaccagctgagaaaggttccggaggaagcgctacagaatttgagaagccttcaatccctgcgcctagatgccaaccacatcagctacgtgccacccagctgtttcagcggcctgcactccctgaggcacctgtggctagatgacaatgctctcacagacgtccctgtccaggctttcagaagtttatcagccctgcaagccatgaccttggccctgaacaaaatacaccacatagcagactacgcctttggaaacctctccagcctcgtggttctgcatctccataataatagaatccactccctgggaaagaaatgctttgatggactccacagcctggagactttagatttaaattataataaccttgatgaattccccactgcaatcaagacactctccaaccttaaggaactaggattccacagcaacaacatcaggtcaataccggagcgagcgttcgtaggcaacccttctcttatcacaatacacttctatgacaaccccatccaatttgttggagtatctgcttttcagcatttgcctgaactaagaacactgactttgaatggtgcctcgcacattactgaatttcctcacttgacaggaactgccaccctggagagtctgactttaactggagcaaagatctcatctcttccccaggccgtctgtgatcagttacctaatctccaagtgctagatttgtcttacaacctactcgaagacttacccagtttgtcaggctgccaaaaacttcagaaaattgacctgaggcataacgagatctatgaaattaagggcagcacttttcagcagttgtttaacctccgatctctgaacttagcatggaataaaattgctatcattcaccccaatgcgttttctacgttgccgtctctaataaagttggacctatcatccaatctcctgtcgtccttccctgtgactgggttacatggtttaactcacttaaaattaacagggaaccgagccttacagagcctgataccatctgcaaacttcccagagctcaagattatagaaatgccatctgcttaccagtgttgtgcatttggggggtgtgagaatgtctataaaatttctaaccaatggaataaagacgacggcaacagtgtggacgaccttcataagaaagacgctgggttatttcaagttcaagatgagcgggaccttgaagatttcctacttgactttgaggaagacctgaatgcccttcactcggtgcagtgctcgccttccccaggtcccttcaagccctgtgagcacctatttggtagctggctgatccgaatcggggtgtggaccacggcagtactgacgctttcctgcaatgccttggtggctttgaccgtgttcagaactcccctgtacatctcttccataaagctgctaattggggtaatcgcggtagtggacattctcatgggggtctccagtgctgtgctggctgccgtggatgcattcacttttggccgttttgctcagcacggtgcgtggtgggaagacggaatcggctgccaaatcgttggcttcctgtccatttttgcttccgaatcgtcgatcttcctgctcactctggcagcgctggaacgaggtttttctgtcaagtgctcttcgaagtttgaagtgaaagctcccctttttagcctgagagcgatcgttttgctatgtgtcctgttggccctgaccattgccacaatccccttgctaggaggcagtaagtacaatgcctctcccctctgcctgcccttgccctttggggagcccagcaccacgggctacatggtggctctcgtgttgctcaactctctctgtttcctcataatgaccattgcctacacaaagctctactgcagtttggagaaaggagagctggagaatctttgggattgttcgatggtgaagcacattgctctgttgctcttcgccaactgcatcctttactgccccgtggctttcttatccttctcctctttgctaaacctcacctttatcagtcctgacgtcattaaatttatacttctcgtgatcgtcccacttccttcctgtctcaacccacttctctacattgtcttcaatccccattttaaggaggatatgggcagcctgggaaagcatacccgtttctggatgagatcaaaacacgcgagtctgctgtccattaactcggacgatgttgagaaacggtcctgtgagtcaacccaagccttagtatcctttacccacgccagcatagcctatgacttgccttccacttccggggcatcaccagcttaccccatgactgaaagctgtcatctctcttcagttgcatttgtcccatgtctctag

SEQ ID NO: 1317 - DNA, 1776 bp, Mus musculus
atggccacggtccccaagagcaacatgggacctacaaaggcggttcccaccccattcggctgcattggctgtaagctgccaaagcccgactacccgccagctctaatcatcttcatgttctgcgcaatggtcatcacagtcgtcgtagacctgatcgggaactccatggtcattttggctgtgaccaagaacaagaagctccgaaattctggcaacatctttgtggccagcctctctgtggcagacatgctggtggccatctacccctaccctttgatgctgtatgccatgtcagttgggggctgggatctgagtcagctccagtgccagatggtcgggttggtcacaggactgagcgtagtcggttccatcttcaacattactgccattgccatcaaccgttactgctacatctgccacagcctccaatacaagcggatcttcagcctgcgcaacacttgcatctatctggtcgttacctgggtcatgactgtcctggctgtcctgcctaacatgtacattggcaccattgagtatgaccctcgcacctacacctgcatcttcaactatgtgaacaatcctgcctttaccgtgaccattgtctgcatccacttcgtcctccctctcatcatagttggttattgctacacgaaaatctggatcaaagtgctggcagcccgtgacccagctggacagaatcctgacaaccagtttgctgaggttcgaaattttctaaccatgtttgtgatcttcctcctttttgcagtgtgctggtgccctgtcaatgtgctcactgtgttggtggctgtcattccaaaggaaatggcaggcaagatccccaactggctttatcttgcagcctactgcatagcctacttcaacagctgcctcaacgccatcatctacggtatcctcaatgagagtttccgaagagaatactggaccatcttccatgctatgcggcaccctatcctgttcatctctcacctcatcagtgatattcgggagacttgggagacccgagctctcactcgtgcccgtgtccgtgcccgtgatcaagtccgagagcaagagcgtgctcgtgcctgtgtcgctgtggaggggaccccaaggaacgtccggaatgttctactgcctggtgatgcatcagcaccccactctgatcgtgcctctgtccgtcccaagccccaaaccaggtctacttctgtctaccgcaaacctgcctctatccaccacaagtctatttctggccaccccaagtctgcctctgtttaccctaagccagcctcctctgtccattgcaagcctgcctctgtccatttcaaacccgcctctgttcatttcaagggtgactctgtctatttcaagggagacactgtccattacagggctgcttccaaacttgtcaccagtcaccgtatctctgctggcccttccaccagtcaccctacatccatggctggctacattaaatctggtaccagccaccctgccaccaccactgttgactatctcgaacctgccaccaccagccactctgtgctcactgctgtcgacctccctgaggtctcagcctcccattgccttgagatgaccagcactggccacctcagagctgacatttctgcctctgtccttccttctgtacccttcgagcttgctgccacccctcctgataccactgcaatccccattgcctctggtgattaccgcaaggtcgtgcttattgatgatgattctgatgattctgattgctctgatgagatggctgtgtga

SEQ ID NO: 1318 - DNA, 1191 bp, Mus musculus
atggccaccgaggcgacattggctcccaatgtgacctggtgggctccgtccaacgcttcaggatgcccaggctgcggtgtcaacgcctcggatgacccaggctctgcgccaaggcccctggatgcctggctggttcccctgtttttcgctacactcatgttgcttgggctggtcggaaactcattggtcatctacgttatctgccgccacaagcacatgcagacagttaccaacttctacatcgctaacctggctgccacagacgtcactttcctactgtgctgcgtgcccttcaccgcactcctctacccgctgcccgcctgggtgctgggagacttcatgtgcaaattcgtcaactacatccagcaggtctcggtgcaagccacatgtgccactctgacggccatgagtgtggaccgctggtatgtgactgtgttcccgctgcgtgcacttcaccgccgcactccgcgcctggccctggctgtcagcctcagcatctgggtggggtcagcagctgtgtccgccccggtgctggccctgcaccgcctgtcgccagggcctcgcacctactgcagcgaggcgtttcccagccgcgccctggagcgcgccttcgcgctctacaacctgctggctctatatctgctgccgctgctcgccacctgcgcctgctacggcgccatgctgcgccacctgggccgtgcggctgtacgccccgcacccactgacggcgccctgcagggacagctgctagcacagcgcgccggagcagtgcgcaccaaggtctcccggctggtggccgctgtcgtcctgctcttcgccgcctgctggggcccgatccagctgttcctggtgcttcaagccctgggcccctcgggggcctggcaccctcgaagctatgccgcctacgcggtcaagatctgggctcactgcatgtcctacagcaactcggcgctcaatccgctgctctatgccttcctgggttcacacttcagacaggccttctgccgcgtgtgcccctgctgccggcaacgccagcgccggccccacacgtcagcgcactcggaccgagctgcaactcacactgtgccgcacagccgtgctgcgcaccctgtgcggatcaggagcccggagcctgggaaccctgtggtgcgctcgccctgcgctcagagtgaacgcactgcctcactctga

SEQ ID NO: 1319 - DNA, 1962 bp, Mus musculus
atgagccagccagagcgtgacaactgctcattcgattccgtggataagcttaccagaaccttgcagctggcagtccatatccccaccttcctccttggcctggttctcaacctactggccatccgaggcttcagtgccttcctaaagaagaggaagctggactatatcgccacttctatctacatgatcaacttggctgttttcgatttactgctggtgctctccctcccattcaagatggtcctgccacaagtggagtcccccttgccgtccttctgcactctggtggagtgcctctacttcatcagcatgtatgggagtgtcttcaccatctgcttcatcagcctggacaggttcctggccatccagtacccgatcctggctagccatctccggtcgcccaggaagacctttgggatctgctgcatcatctggatgctggtctggatcggaagcatccccatctacaccttccacagggaagtggagagatacaagtgctttcacaacatgtcggatgtcacctggagtgccagtgtcttcttccccctggagatctttggcttcctccttcccatgggcatcatgggcttctgttcctataggagtattcacatcctgctgcgccgtccagacagcactgaggactgggtccaacagagagacactaagggctgggtacaaaagagagcctgcatctggaccattgctaccaatcttgtcatctttgtggtctcctttctcccagtgcacttgggcttcttcctgcagtatctggtgaggaaccgctttatcttggactgcagaatgaagcagggcatcagcttgttcctgcagttgtctctgtgtttctccaacatcaactgctgccttgatgttttttgctactactttgtcatcaaagaatttcgcatgcgcatcaaggcccaccggccctccacaatcaagctggtcaaccaggataccatggtctccaggggcatgagccagccagagcgtgacaactgctcattcgattccgtggataagcttaccagaaccttgcagctggcagtccatatccccaccttcctccttggcctggttctcaacctactggccatccgaggcttcagtgccttcctaaagaagaggaagctggactatatcgccacttctatctacatgatcaacttggctgttttcgatttactgctggtgctctccctcccattcaagatggtcctgccacaagtggagtcccccttgccgtccttctgcactctggtggagtgcctctacttcatcagcatgtatgggagtgtcttcaccatctgcttcatcagcctggacaggttcctggccatccagtacccgatcctggctagccatctccggtcgcccaggaagacctttgggatctgctgcatcatctggatgctggtctggatcggaagcatccccatctacaccttccacagggaagtggagagatacaagtgctttcacaacatgtcggatgtcacctggagtgccagtgtcttcttccccctggagatctttggcttcctccttcccatgggcatcatgggcttctgttcctataggagtattcacatcctgctgcgccgtccagacagcactgaggactgggtccaacagagagacactaagggctgggtacaaaagagagcctgcatctggaccattgctaccaatcttgtcatctttgtggtctcctttctcccagtgcacttgggcttcttcctgcagtatctggtgaggaaccgctttatcttggactgcagaatgaagcagggcatcagcttgttcctgcagttgtctctgtgtttctccaacatcaactgctgccttgatgttttttgctactactttgtcatcaaagaatttcgcatgcgcatcaaggcccaccggccctccacaatcaagctggtcaaccaggataccatggtctccaggggc

SEQ ID NO: 1320 - DNA, 2064 bp, Mus musculus
atggctgtccaggtgctgcggcagatggtctacttcctactgagtctgttttctctggtgcaaggtgcacacagtggcagcccccgagaagacttccgcttctgtggccagcggaaccagacccaacagagcaccctccactatgatcaatcttcagagcctcacatctttgtgtggaacacagaggagaccctcacaattcgtgcccccttcctggcagccccagatattccccgcttcttcccagagcctagagggctctatcacttctgcctctactggagtcgccacactgggagactccacttgcgctatggcaagcatgactacctgcttagtagccaagcctccagactcctctgcttccagaaacaggagcagagcctgaagcagggagccccgctgatcgccacctctgtcagctcctggcagattccccagaacaccagcctgcctggggctccgagcttcatcttctccttccacaatgccccacacaaggtctcccacaatgcatctgtggacatgtgtgatctcaagaaggaattgcagcagcttagcaggtacctgcagcaccctcaaaaggctgccaagcggcccaccgcagcgttcatcagccagcagttacagagcctggagtcaaagctgacctctgtgagcttcctgggagacacattatcctttgaggaggaccgggtcaatgctacagtgtggaagctgccacccacagccggtctagaggatctgcatatccactcccagaaggaggaggagcagagtgaggtccaggcatactcgctgttgcttccccgggccgtattccagcagaccagaggccgtcgccgggatgacgccaagaggctcctggtagtagacttcagcagccaagctttgttccaggacaagaattctagccaagtcctgggtgagaaggtcttgggtattgtcgtgcagaacaccaaagtcaccaacctctcagatccggtggtactcaccttccagcaccagcctcagccaaaaaatgtgactctgcagtgcgtgttctgggttgaagacccggcatcaagcagcacagggagctggagcagtgcaggctgcgagacagtgagcagagacacacagacatcctgcctgtgcaaccacctgacctactttgcagtgctgatggtgtcatccacagaggtagaagccactcacaaacactacctcacgctcctgtcctacgtgggctgtgtcatctctgctctggcttgtgtcttcactatcgctgcctacctctgctccaggaggaagtcacgtgactacaccatcaaagtccacatgaacctgctgtccgctgtcttcctgctggacgtgagcttcctgctcagcgagcctgtggcactgacgggctccgaagcagcctgtcgcaccagtgccatgttcctgcacttctccctgcttgcctgcctctcctggatgggcctcgagggctacaatctctaccgactggtggtggaggtcttcggtacctatgtgcccggctatctgctcaagctgagcatcgtgggctggggttttcctgtcttcctggtcactctggtggcgttggtggatgtgaataactacggccccattatcctagctgtgcgccggactccggaacgtgtcacctacccctctatgtgctggatccgggactccctggtgagctatgtcaccaacctgggcctcttcagtctggtgttcctgttcaacctggctatgctggccaccatggtggtgcagatcctgcggcttcgcccgcacagccagaactggccccacgtgctgaccctgctgggcctcagcctggtccttggcctcccctgggccttggtcttcttttcctttgcttccggcaccttccagcttgtcatcctctacctcttcagcatcataacttcctaccaaggcttcctcatcttcctgtggtactggtccatgcggttccaggcccaaggcggcccctcccctctgaagaacaactcagacagcgccaaactccccatcagctccggcagcacctcctccagccgcatctaa

SEQ ID NO: 1321 - DNA, 1029 bp, Mus musculus
atggatctaatatacattcccgaagacttatccagctgtccaaaatttggaaataaatcctgccctcccaccaatcgctctttccgtgtccgcatgataatgtacctgtttatgactggagccatggttatcaccatctttggaaacttagtgataatcatttccatatcgcatttcaaacagctacattctcccaccaactttctgatcctctccatggcaaccacggacttcctgctgggttttgtcatcatgccttacagtatggtgagatcagtggagagctgctggtatttcggagacagcttttgcaaattccacgcgagcttcgacatgatgctaagcctgacgtccatattccacctgtgctccatcgcgatcgaccggttttatgcagtgtgtgaccctttgcactacaccaccaccatgacggtatccatgatcaagagactgctggctttttgctgggcagccccagctctcttttcgtttggtttagttctgtcagaggccaatgtttctggtatgcagagctacgagattcttgttgcttgcttcaatttctgtgcgcttacgttcaacaagttttgggggaccatactgttcactacctgcttcttcactcctggctccatcatggttggtatttatggtaaaatttttattgtttctagacgacatgctcgagccctcagcgatatgcctgcgaacacaaaaggagcagtagggaaaaacctgtctaagaaaaaggacaggaaagcagctaagaccctgggcatcgtcatgggggtgtttctagcgtgctggctgccttgcttcctggctgttttgattgatccatatttagactactccacgcccatcatagtgctggatcttctggtatggctcgggtacttcaactctacttgcaaccccctcatccatggctttttttacccgtggtttcggaaagctcttcagtttatagtgtcaggaaaaatatttcgctctaattcagacactgcaaatctttttcctgaagcacat

SEQ ID NO: 1322 - DNA, 1089 bp, Mus musculus
atgaacgctagcgccgccgcgctcaacgagtcccaagtggtggcagtagcggccgagggagcggcagctgcggctacagcagcaggggcaccggacaccggcgaatggggacccccagcagcatccgcagcgctgggaggcggcggcggacctaacgggtcactggagctgtcttctcagctgccagcagggccctcgggactactgctttcggcagtgaatccctgggatgtgctgctgtgcgtgtcgggaactgtgatcgcaggcgaaaatgcgctggtggtggcgctcatcgcgtccactcccgcgctgcgcacgcccatgtttgtgctcgtgggtagtctggccactgctgacctgttggcgggctgtggcctcatcttacacttcgtgttccagtacgtggtgccctcggagactgtgagcctgctcatggtgggcttcctggtggcgtcctttgccgcctcagtcagcagcctgcttgctatcacagttgaccgttacctgtctttgtacaacgcgctcacctactactcgcgccggaccctgttgggcgtgcacctcttgctagcagccacctggacagtgtccctcgggttggggttgctgcctgttctaggctggaactgcttggccgaccgcacgtcctgcagcgtggtgcgccccctgacacgcagccatgtggcgttgctctctacttccttcttcgtggtctttggcatcatgctgcacttgtacgtgcgcatctgccaggtggtctggcgccacgcccaccagatcgctttgcaacagcattgcctagcaccgccccacttagcagccaccagaaagggagtgggaactttggccgtggtgctaggcacttttggggccagctggctgcccttcgccatctattgtgtggtgggtagccaagaggacccggccatctacacttatgccaccctgttgcctgccacctataactccatgatcaatcccatcatctatgccttccgcaaccaggagatccagcgtgccttgtggctcctgttctgtggctgtttccaatccaaagtgcccttccgctccaggtcccccagtgaggtc

SEQ ID NO: 1323 - DNA, 1347 bp, Mus musculus
atggagtcctcacccatcccccagtcatcaggaaactcgtccactttgggaagggcccttcaaaccccaggtccctctactgccagcggggtcccagagttgggattacgggacgtggcttcagaatctgtggccctcttcttcatgctcctgttggatctcactgctgtggctggcaatgctgctgtgatggctgttattgccaagacacccgccctccgaaaatttgtttttgtcttccatctttgtctggtggacctgctggctgccctgaccctcatgccgcttgccatgctctccagctctgccctctttgaccacgccctctttggggaggtggcctgccgcctctacctgttcctgagcgtttgctttgtcagcctggccatcctttcggtgtctgccattaatgtggagcgctactattatgtggtccacccaatgcgctacgaggtgcgcatgacactagggctggtggcctccgtgctggtgggcgtgtgggtaaaggccctagccatggcttctgtgccagtgttgggaagggtctactgggaggaaggagctcccagtgttaaccccggctgttctctccaatggagccatagtgcctactgccagctttttgtggtggtctttgctgttctgtacttcttgctgcccttgatcctgatctttgtggtctactgcagcatgtttcgagtggctcgcgtggctgccatgcaacacgggccgctgcccacgtggatggagacgccccggcaacgctctgagtctctcagtagccgctctactatggttaccagctccggggctcaccagaccaccccacaccggacgtttgggggtgggaaggcagcagtggtcctcctggctgtagggggacagttcttgctttgttggttgccctacttctctttccatctctatgttgccctgagcgcacagcccatttcagcaggacaggtggagaacgtggtaacctggattggctacttttgcttcacttccaacccctttttctacggatgtctcaaccgtcagatccggggcgagcttagcaaacagtttgtctgcttcttcaaggcagctccagaggaggagctgaggctgcctagtcgtgagggctccattgaggagaatttcctgcagttcctccaggggacctctgagaactgggtttctcggcccctacccagtcctaagcgggagccaccccctgttgttgactttcgaatcccaggccagattgctgaggagacctcagagttcctggagcagcaactcaccagcgacatcatcatgtccgacagctacctccgtcccgccccctcaccaaggctggagtca

SEQ ID NO: 1324 - DNA, 1278 bp, Mus musculus
atggttgtctcaggagtgttgactgctccggcagtgttgactgcgccccattctggaacatccaacacgacgtttgtagtctttgaaaactcccacgtgaatattacggctccgctaccatttcagcatcctagcgctggtccgctgcttagatacagccttgaaaccatgactagccctggatttagctccttggcagtgaacagcacagctgtgactccagcaccagcagtttttaagagcctaaacttagcggttcagattatcctttcagccataatgatatttattctctttgtgtctttccttggaaacttggttgtttgcctcatggtgtaccaaaaagctgccatgcgttctgcaattaacatcctccttgccagcctggcgtttgcagacatgctgcttgcagtactgaacatgccctttgctctggtaactattcttactaccagatggatatttgggaaattcttctgccggttgtcggctatgtttttctggttgtttgtgatagagggagtagccatcctgctcattattagtatcgataggtttctgattatagttcagaggcaagataagctaaatccctatagggctaaggtcctcattgcagtctcctgggcaactgctttttctgtagcttttcctttggccgtgggaaaccctgatctgcagataccttccagagccccacagtgcgtgtttggatacacaaccaattctggataccaggcttatgtgattttgatttcactcatttccttctttatacctttcctggtcatattatattcatttatgggcatcctcaatacccttcggcataatgccttgaggattcatagctaccccgaagggatatgcctcagccaggccagcaaactcggtctcatgagtctacagagacccttccaaatgagcatcgacatgggctttaaaacacgtgcctttaccaccattctgatcctctttgccgttttcattgtctgctgggccccattcaccacctacagccttgtggctaccttcagtaagcacttctactatcagcacaacttctttgagattagcacctggctactctggctctgctacctcaagtctgcattgaacccactgatatactactggaggattaagaagttccacgatgcctgcttagatatgatgcccaagtctttcaagttcttgccacggctccctggtcacacaagtcgacggattcgccctagtgccgtctacgtgtgtggggaacatcggacggtgttgtga

SEQ ID NO: 1325 - DNA, 1014 bp, Mus musculus
atggcgatgaacagcatgtgcattgaagagcagcgccacctcgaacactatttgttcccggtggtctacataattgtgtttatagtcagcgtcccagccaacatcggatctttatgcgtatcctttctgcaagcgaagaaggaaaatgagctagggatttacctcttcagtctgtccctgtcagacctgctgtatgcgctgactctgcccctctggatcaattacacttggaataaagacaactggactttctctcccaccttgtgcaaaggaagcgttttcttcacctacatgaacttttacagcagcacggcgttcctcacttgcattgccctggaccgctatttagcagtcgtctaccctctgaagttttccttcctaagaacgagaagattcgcgtttattaccagcctctccatctggatattagagtccttctttaactctatgcttctgtggaaagatgaaacgagtgttgaatattgtgactcggacaaatctaatttcactctctgctatgacaaataccctctggagaaatggcagataaacctcaacctgtttcggacgtgcatgggctacgcaatacccttgatcaccatcatgatctgcaaccataaagtctaccgagctgtgcggcacaaccaagccacggaaaacagcgagaagagaaggatcataaagttgcttgctagcatcacgttgactttcgtcctatgctttacccccttccacgtgatggtgctcatccgctgcgttttagagcgcgacatgaacgtcaatgacaagtctggatggcagacgtttacggtgtacagagtcacagtagccctgacgagtctaaactgtgttgccgatcccattctgtactgctttgtgactgagacggggagagctgatatgtggaacatattaaaattgtgtactaggaaacacaatagacaccaagggaaaaaaagggacatactttctgtgtccacaagagatgctgtagaattagagattatagactaa

SEQ ID NO: 1326 - DNA, 1218 bp, Mus musculus
ctggtctgcaatatcagtgagttcaagtggccctatcaacctgaggatctgaaccttaccgatgaggccctgaggctgaagtatttggggccacagcagatgaaacagtttgtccccatctgtgtcacgtacctgctgatcttcgtggtgggcactctgggcaacgggctgacctgcaccgtcatcctgcgcaacaagactatgcgcacgcccaccaacttctacctcttcagcctcgctgtgtccgatatgctggtgctcctggtgggcttgcctctggagctttatgagatgcagcaaaattacccgttccagctgggtgcgagtgcctgctacttccgaatactgctcttagagaccgtctgcctagcttcagtgctcaatgtcacagccctgagtgtggagcgttatgtggccgtggtgcgcccactccaagccaagtctgtgatgacacgggcccatgtgcgccgcatggtgggggccatctgggtcctcgctactctcttctctctgcccaacaccagcctgcatggcctcagtcaactaactgtgccctgccgggggccggtgcccgactcagctatatgttcgctggtgggtcccatggacttctacaagttggtggtactgactaccgcactgctcttcttctgtctgcccatggtcaccatcagtgtgctgtatctgctcattgggctgcggctgcggagggagaggatgttgctccaagtggaggtcaagggcaggaaaaccgcagcaacccaggagacctcccacagaaggattcagctgcaagataggggacggagacaggtgaccaagatgctgtttgcactggttgtggtattcggcatctgctgggctccattccatgctgaccgtatcatgtggagcctggtgtatggacactcaacggaaggcctgcacctggcctaccagtgtgtccacattgcctctggcatcttcttctatctcggctcagcagccaacccggtgctctacagcctcatgtctactcgcttccgagagaccttcctgcaagccctgggccttggaacccagtgctgtcatcgccgccaaccctatcatggctcccataaccacatcaggttgaccacaggcagcaccctgtgtgacgtgggccacaggaacagcagggacgaacctctggctgtgaatgaggatccagggtgtcagcaagagacagacccctcctga

SEQ ID NO: 1327 - DNA, 987 bp, Mus musculus
atgcataacttaacgcttttcgagtctggaggggacaacgtgtcttgcggcggctcatctttgggctgtcccaacgggtccagcctggctcctctgccgctgccgcagccactggcggtagcagtgcctgtcgtctacggggtaatttgcgccgtgggactggctggcaactctgcggtgctgtacgtactgctgcgcacgccgcgcatgaagactgtcaccaacgtgttcatcctcaacctggctatcgccgatgagctcttcaccctcgtgctgcccatcaacatcgcggacttcctgctgaggcgctggcccttcggggaggtcatgtgcaagctcattgtagccgtcgaccagtacaacactttctctagcctctacttcctcgccgtcatgagcgccgaccgatacctggtggttctggccacagcagagtcgcgccgggtgtccgggcgcacttacggtgcagcgcgtgctgtcagtctggcggtgtgggcgctggtgacgctggtcgtgctgccctttgcggtattcgctcggctggacgaggagcagggtcggcgccagtgcgtgctggtcttcccgcagcccgaggccttctggtggcgtgccagccgtctctacacactagtattgggctttgccatcccggtgaccaccatctgtgctctctataccactctgctctgccgactgcgtgctatccagctagatagccacgccaaggccctggatcgtgccaagaagcgcgtgaccttgttggtggcggcgattctggctgtgtgcctcctctgctggacgccttatcacctgagtaccatagtggccctcaccaccgacctcccgcaaacgccgctggtcatcggcatctcttacttcatcaccagcctgagctatgctaacagctgcctcaaccctttcctctatgccttcctggacgacagcttccgcagaagcctccggcaattggtgtcatgccgttcagcc

SEQ ID NO: 1328 - DNA, 1182 bp, Mus musculus
atggagaccactgtcggggctctgggtgagaataccacagacaccttcaccgacttcttttctgcactcgatggccatgaagcccaaaccggctcgttaccattcactttcagctacggtgactatgacatgcccctggatgaagaggaagatgtgaccaattctcggactttctttgctgccaagattgtcattggcatggctttggtgggtatcatgctagtgtgtggcatcggcaacttcatctttatcactgccctggcccgctacaaaaagctccgcaacctcaccaacctgcttatcgccaacctggccatttcagacttcctcgtggccatcgtgtgctgcccctttgagatggactactatgtggtgcgccagctctcctgggagcatggtcatgtcctgtgcgcctctgtcaactacttgcgtaccgtctccctctacgtctccactaacgccctactggccattgccattgacaggtatctggccattgtgcacccgctgagaccgcggatgaagtgtcaaacagccgccggcctgatcttcctggtgtggtcagtatccatcctcatcgccattccagctgcctacttcaccactgagaccgtgctggtcatcgtggagagacaggagaagatcttctgtggtcagatctggccggtggatcagcagttctactacaggtcctatttccttttggttttcggcctcgagttcgtgggccccgtagtcgccatgaccttgtgctatgccagggtgtcccgggagctctggttcaaggcggtgccaggcttccagacagagcagatccgccggacggtgcgctgccgccgcaggacggtgctggggctcgtgtgcgtcctctctgcctatgtgctgtgctgggctcccttctatggcttcactatcgtgcgtgacttcttcccctccgtgtttgtgaaggagaagcactacctcaccgccttctatgtggtggagtgcatcgccatgagcaacagcatgatcaatacgctctgctttgtgactgtcaggaataacaccagtaagtacctcaagaggatcctgcggcttcagtggagggcctctcccagcgggagcaaggccagcgctgacctcgacctcaggaccacgggaatacctgccaccgaggaggtggactgcatccgactgaaataa

SEQ ID NO: 1329 - DNA, 2325 bp, Mus musculus
atgggaccccagaacagaaacactagctttgcaccagacttgaatccaccccaagaccatgtctccttaaactacagttatggtgattatgacctccccctgggtgaggatgaggatgtgaccaagacacagaccttctttgcagccaaaattgtcattggcgtggcactggcaggcatcatgctggtctgcggcattggcaactttgtcttcattgctgccctcgcccgctacaagaagctgcgcaaccttaccaacctcctcattgctaacctggccatctctgacttcctggtggcgatcgtctgctgcccctttgagatggactattatgtagtacggcagctttcctgggcgcatggtcacgtgctttgtgcctccgtcaactaccttcgtacggtctccctgtacgtctccaccaacgctctgctggccatcgctattgacagatacctcgctattgtccaccctttgaaaccacggatgaattatcagaccgcttccttcctgatcgctttggtctggatggtctccatcctcatcgctgtcccatctgcctacttcaccacagaaaccatcctcgttatcgtcaagaatcaagaaaaaatcttctgtggtcagatctggtcggtggaccagcagctctactacaaatcctacttcctcttcgtcttcgggcttgagttcgtgggtcccgtggtcactatgaccctgtgctatgccaggatctcccaagagctctggttcaaggctgtacctggcttccagacggagcaaatccgcaagcggctgcgttgccgccgcaagacagtgctactgctcatgggcatcctcacagcctacgtgctgtgctgggcgccgttctatggctttaccatagtgcgagacttcttccccacggtagttgtgaaggagaagcactacctcaccgccttctacgtcgtggagtgcattgccatgagcaacagcatgatcaatactatatgcttcgtgacggtcaagaacaacaccatgaaatacttcaagaagatgctgcggctccactggcggccctctcactacgggagtaagtccagcgctgacctcgacctcaaaaccagcggggtgcctgccactgaagaggtggattgtatcagactaaagtagccttcaggtgttgcccaaggaaaaatttaacattcggtactcagtaaatcacacaccatcaaccactcacaagctacatggaaagatacggctgtattcacgttctcctgctctaatgtatcaggacgcttctatgtaataacatacagcacaactgatgtctgcataacatcttagaaggcagacacaaatagtaacaagtgatgtggactgaatgcttctgtctgcaaaccacaccaaccaattattcaaggacaagagctgacatgtgagaattacctgctatgtgcaaaaacaagttacccccccaaaaaatgatagaagctatttggagttattcagctctatctatctatctatctatccatccatccatccatccatccaggtcactagaaagaagtcacaaatgactagccagagtcatgctacatattctttcattctgtatcttttctgcacagaactgtcaaaggcaatagaataaagcacctagacatactagaaatgtaaggataactccatcaatagggagaccaaggcctcataggaagagggtccatatagtatactgactttccccactccacaccagttatctccttagatattctgtacttatctgcaatgttgtaatttcaaatgaggaaaaataaggggacaggctttaccacagatgtatcaaatctcatcaagcccatagggcaaagatgggaggctcctgacacaagaaatgtatccagttctggataactttaatgccaagcatttcagggctctggggtcttggaggaagaggacacagaaagagccgaggtttccagtggcaatgagtataatctgtccatttgctatgatttggacaattttctagaacatactccgacttacaaaaggaactctacttgagatccaaagatccgggtaaaagtcctaaccccaggactcatctctgtgtgtctccactgtaatgaaatggaaataatgaaaacggatcattaggaacatcagcccggcgaagtcatggtgtggatgtgattttcacctcttcctttgtgaagaatgaggtcgtgaaaagctcattagagggagtttggaatggagaaacagctccacacttttcatccctcttctttgaatcggagaccactaaacgcatctttgaagtagcgtatctat

SEQ ID NO: 1330 - DNA, 1254 bp, Mus musculus
atgagcgagaaatgggactcaaactcttcagagagctggaatcacatctggagtggcaatgatacacagcatcactggtattcagatatcaacattacctatgtgaactactatctccaccagccccaagtggcagctgtcttcatcagctcctacctcctgatctttgtcttgtgcatggtgggaaatactgtcgtttgctttattgtgataaggaatagacacatgcacacagtcactaatttcttcatcttaaaccttgccacaagtgatttactggttggaatattctgtatgcctatcacattgctggacaacatcatagcaggatggccattcggaagcagcatgtgcaagatcagtgggctggtgcaagggatatcagttgcggcttccgtcttcaccttggttgcaatagctgtggacagattccgctgtgtggtctacccctttaagccaaagctcactgtcaagacagcctttgtcacgattgtgatcatctggggcctggccatcgccattatgactccatctgcaataatgttacatgtacaagaagaaaaatactaccgtgtgagactcagctcccacaataaaaccagcacagtctactggtgtcgggaggactggccaagacacgaaatgaggaggatctataccacggtgctatttgccaccatctatcttgctcctctctcactcattgttatcatgtatgcaaggattggggcttccctcttcaagacggcagcacactgcacaggcaagcagcgtccagagcagtggcatgtatccaagaagaaacagaaggtcatcaagatgctgctgactgtggccctccttttcatcctttcctggcttcccctgtggaccctgatgatgctctcagactatactgacctgtctcctaacaaactgcgtatcatcaacatctacatctaccctttcgcccactggctcgccttctgcaacagcagtgtcaaccctattatttatggattctttaatgaaaattttcgcaatggtttccaagatgctttccagatctgccaaaagaaagccaagccccaggaagcctattccctgagagcgaaacgcaacatggtcataaacacatcgggcctgctggtgcaggaaccggtgtctcaaaacccaggtggggaaaatttgggatgtggaaaaagtgcagacaatcccacacaggaatccttgatagaggaaatgggagaagctactaacagtactgtggcttaa

SEQ ID NO: 1331 - DNA, 1620 bp, Mus musculus
atgaacacaagtgccccgcttcagaatgtccccaatgccaccttgctaaacatgcctcccctgcacgggggaaatagcacttctctccaggaaggtcttcgagattttatccacacagccaccttggtgacctgcacttttctgcttgccatcatcttctgtctaggctcttatggaaattttattgtcttcttgtctttctttgacccatccttcaggaagttcagaaccaactttgatttcatgatcttgaacctgtctttctgtgatctgttcatctgtggggtcacagcccccatgttcaccttcgtgctgttcttcagctcagccagtagcatcccagatagcttctgcttcaccttccaccttaccagctcaggcttcgtcatcatgtccctcaagatggtggctgtgattgctctgcaccggctccggatggtgatggggaagcagcctaattgtacagcctccttttcctgcatcttgctccttacccttcttctctgggcgaccagctttacacttgccaccttggctacactgagaaccaataagtcccacctgtgtctccccatgtccagtcttatggatggggaagggaaagccattctgtctctgtatgttgttgactttaccttctgtgttgctgtggtgtctgtctcttatattatgattgctcaaacccttcggaaaaatgctcaagtaaaaaagtgccccccggtgatcacagttgatgcttccagaccacagccattcatgggggcctctgtgaagggaaatggagatcccatccagtgcaccatgccagctctgtataggaaccagaattataacaaactgcagcacagtcaaactcatggatacactaagaatatcaaccagatgccaatcccctcagccagtcgactccagctggtatcagccatcaacttctctactgccaaggattccaaagccgtggtcacctgtgtggtcatcgtgttgtcagtcctggtgtgctgtcttcctcttgggatttccctggtgcaaatggttctgtctgacaatggcagttttatcctttaccagtttgaactgtttggatttactctgatatttttcaagtcaggattaaatccttttatatattctcggaacagtgctgggctgagaaggaaagtactctggtgcctgagatacactggcctgggctttctctgctgcaaacagaaaactcgacttcgggccatgggaaaagggaaccttgaaatcaatagaaacaaatcttctcatcatgagacaaactctgcctacatgctgtctccaaaaccacagagaaaatttgtggaccaggcttgtggcccaagtcactcaaaggaaagtgcagcgagtcccaaagtttctgctggacatcaaccctgtggtcaaagcagttccacacccatcaacactaggattgaaccttactatagcatctataacagcagcccttcccagcaggagagcggtccggcaaacttgcctccagtgaactcttttgggtttgccagttcctacatcgccatgcactattacaccaccaatgatttgatgcaggaatatgacagcacgtcagcaaaacaaattcctatcccctctgtt

SEQ ID NO: 1332 - DNA, 1032 bp, Mus musculus
atgatgaaccacaccaccagcgagtattatgactatgagtatgaccatgaacactacagtgaccttccggacgtgcccgtagactgcccagctggcacctgcttcactagtgatgtctacctgatagtcctgcttgtgctgtatgcagccgtcttcctggtgggtgtgccaggcaacaccctggtggcgtgggtgacctggaaagagtcccgccacaggcttggggcctcttggttcctgcacctgaccatggccgacttgctttgttgtgtgtctctgcccttcctggctgtgcccatcgcccaaaagggccactggccatacggggcggcaggctgctggctgttgtcctccatcaccattctgtctatgtatgccagtgtgctgctcctgaccggcctcagcggagacctcttcctactggctttcaggccctcctggaagggtgcagatcatcgaacatttggggtgcgtgtggtccaggcctcctcctggatgctgggcctcttgctgactgtgccttctgctgtctaccgtaggctgcttcaggagcactatcctccccgacttgtgtgtggcatagactatgggggatcggtcagcgccgaggttgccatcaccactgttcgattcctctttggcttcctggggccattggtgttcatggccggttgtcacggcatcctccaacggcagatggcccgccgccattggcccctgggcacagctgtcgtggtggggtttttcatttgctggaccccttatcacgtcctgcgggtaatcattgcagcggctcctccgcactccttgctcctcgcccgggtcctggaggcggagcctctgtttaatggcctggccctggctcacagtgctctcaatcccataatgtttttgtatttcggaagaaaacaactctgcaagtcactccaggctgcatgccactgggccctgagggatccacaggatgaggaaagtgcggtgaccaaggtatccatatccaccagccacgaaatggtgtctgagatgccggtg

SEQ ID NO: 1333 - DNA, 1011 bp, Mus musculus
atgattgagccactggacagtccagccagtgattcggatttcctggattacccaagtgctctgggaaactgcaccgacgagcaaatctcattcaagatgcagtaccttcccgtcatctatagcatcatcttcctcgtgggcttcccggggaacacagtggccatctccatctacattttcaagatgcggccgtggaggggcagtacagtcatcatgctgaacctggccttgacggacttgctgtatctgaccagcctcccgttcctcatccattactatgccagtggtgaaaactggatctttggagatttcatgtgcaagttcatccgcttcggcttccacttcaacctctacagcagcattctcttcctcacctgcttcagtctcttccgttacgttgtgatcattcacccgatgagctgcttttctattcagaaaactcgctgggcagtggtagcttgtgccggggtgtgggtcatttctttggtagctgtcatgcccatgactttcctgatcacatcaaccacccggaccaataggtctgcttgccttgacctcaccagttcagatgacctcactactatcaagtggtacaatctcattttgacagccaccactttctgcctgccattggtgatagtgacactttgctacacgacaattatcagtaccctgactcacgggcctcggacccacagctgctttaagcagaaggctcggagactgactattctgctcctccttgttttctatatatgtttcttacccttccacatcttgagggtcattcggatcgaatctcgcctgctttcaatcagctgctccatcgagagtcacatccacgaagcttacattgtttctagaccattagctgctctcaacacctttggcaacctgctgttatatgttgtggtcagcaataacttccagcaggcattctgctctatagtgagatgcaaagccagtggggaccttgaacaaggaaagaaagacagttgctcaaacaaccct

SEQ ID NO: 1334 - DNA, 1029 bp, Mus musculus
atggacaacgggtcgtgctgtctcatcgagggggagcccatctcccaagtgatgcctcctctactcatcctggtcttcgtgcttggcgccctgggcaacggcatagccctgtgcggcttctgctttcacatgaagacctggaagtcaagcactatttaccttttcaacttggctgtggccgattttctcctcatgatctgcttaccccttcggacagactactacctcagacgcagacactggatttttggagatatcgcctgtcgcctggtcctcttcaagctggccatgaatagggccgggagcattgtcttcctcactgtggtggctgtggataggtatttcaaagtggtccacccccaccatatggtgaatgccatctccaaccggactgccgccgccaccgcctgtgtcctctggactttggtcatcttggggactgtgtatcttctgatggagagtcacctgtgtgtgcaggggacactgtcgtcctgtgagagcttcatcatggagtcagccaacgggtggcacgatgtcatgttccagctggagttcttcctgcccctgacaatcatcttgttctgctcggtcaacgttgtttggagcctgagacggaggcagcagctgaccagacaggctcggatgaggagggccacccggttcatcatggtggtggcttctgtgttcatcacgtgttacctgcccagcgtgctggctaggctctacttcctctggacggtgcccactagtgcctgtgacccctctgtccacacagccctccacgtcaccctgagcttcacctacctgaacagtatgctggatccccttgtatattacttctcaagcccctcgctccccaaattctacaccaagctcacaatctgcagcctgaagcccaaacgcccaggacgcacgaagacgcggaggtcagaagagatgccaatttcgaacctctgcagtaagagctccatcgatggggcaaatcgttcccagaggccatctgacgggcagtgggatctccaagtgtgt

SEQ ID NO: 1335 - DNA, 1272 bp, Mus musculus
atgaaggttcctcctgtcctgcttctctttcttctgtcctcagtgcgagctactgagcaaccgcaggtcgtcactgagcatcccagcatggaggcagccctgaccgggcccaacgcctcctcgcacttctgggccaactacactttctctgactggcagaacttcgtgggcaggagacgttatggggccgagtcccagaaccccacggtgaaagcactgctcatcgtggcctactcattcaccatcgtcttctcgctcttcggtaatgtcctggtctgtcatgtcatcttcaagaaccagcgcatgcactcggccaccagcctcttcattgtcaacctggcagtggcggacatcatgatcacattgctcaacacgcccttcactttggtccgctttgtgaacagcacatgggtgtttgggaagggcatgtgtcatgtcagtcgctttgctcagtactgttctctacatgtctcagcactgactctgacagctatcgcagtggaccgccaccaggtcatcatgcatccactgaagcctcggatctccatcaccaagggtgtcatatatattgctgtcatctgggtcatggctaccttcttctctctgccacatgccatctgccagaaactgtttaccttcaagtacagtgaggacattgtgcgctccctctgcctgccggacttcccggagccagctgacctcttctggaagtatctggacctggccaccttcatcctgctctacctacttccactcttcattatctcagtggcctatgctcgtgtggccaagaagctgtggctctgtaacaccattggcgacgtgaccacagagcagtacctcgccctgcgacgcaagaagaagaccaccgtgaagatgctggtgcttgtggtagtcctctttgccctctgctggttccctctcaactgctatgtcctcctcttgtccagcaaggccatccacaccaacaatgccctctactttgccttccactggtttgccatgagcagtacttgttataaccccttcatctactgctggctcaatgagaactttagggttgagcttaaggcattgctgagcatgtgccaaaggccacccaagccgcaggaagacaggctaccctccccagttccttccttcagggtggcatggacagagaagagccatggtcggagggctccactacctaatcaccacttgccctcttcccagatccagtctgggaagacagatctgtcatctgtggaacccgttgtggccatgagttag

SEQ ID NO: 1336 - DNA, 1191 bp, Mus musculus
atgtggaacagctcagatgccaacttctcctgctaccatgagtctgtgttgggctatcgatactttgcaattatctggggcgtggcagtggctgtgacaggcacggtgggcaatgtgctcactctgctggccttggccattcgtcccaagctccgaacccgcttcaacctgctcattgccaacctcaccctggctgatctactctactgcacgctcctgcagcctttctccgtggacacatacctccacctccattggcgtaccggcgcggtcttctgtagaatatttggactcctcctctttacttccaattctgtctccatcctcaccctctgtctcattgctctaggacgctacctcctcattgcccaccctaagctctttccccaggttttcagtgccaaggggatcgtgctggcactggtgggcagctgggttgtgggggtgaccagctttgcccccctctggaatgtttttgtcttggtgccagttgtctgcacttgcagctttgaccgcatgcgaggccggccttacaccaccatcctcatgggcatctactttgtgcttgggctcagcagcgtgggcgtcttctactgcctcatccaccggcaagtgaagcgtgcggctcgagcactggaccaatacgggctgcatcaggccagcatccgctctcatcaggtggctgggacacaagaagccatgcctggccacttccaggagctagacagcggggttgcctcaagagggcccagcgaggggatttcatctgagccagtcagtgctgcgaccacgcagaccctggaaggtgattcgtcagaagctgggggccagggcattagaaaggcagctcaacagatcgcagagagaagccttccagaagtgcatcgcaagccccgggaaactgcaggagctcgcagagccacagatgccccatcagagttcgggaaggtgacccgtatgtgcttcgcagtgttcctctgcttcgccctcagctacatccccttcctgttgctcaacattctggacgccaggggccgtgctccacgagtagtgcacatggtggctgccaacctcacctggctcaacagctgcatcaaccctgtgctctatgcagccatgaaccgccagtttcgccacgcgtatggctccatcctgaaacgcgggccacagagtttccgccggttccattaa

SEQ ID NO: 1337 - DNA, 1482 bp, Mus musculus
aattcaaacggaaggcaagaggaagcatggccacagatcggatctgatctctttgtggattacattttcagtaaaatgtatggatctatcttttccttgttcttatatctagatcatgagacttgactgaggctgtttccttatcctccatccatctatggcgaactatagccatgcagccgacaacattttgcaaaatctctcgcctctaacagcctttctgaaactgacttccctgggtttcataataggagtcagcgttgtgggcaaccttctgatctccattttgctagtgaaagataagaccttgcatagagctccttactacttcctgctggatctgtgctgctcagacatcctcagatctgcaatttgttttccatttgtattcaactctgtcaaaaatggctccacctggacttacgggactctgacttgcaaagtgattgccttcctgggggttttgtcctgtttccacactgccttcatgctcttctgcatcagcgtcaccagatacttagccatcgcccatcaccgcttctatacaaagaggctgaccttttggacgtgtttggctgtgatctgcatggtgtggactctgtccgtggccatggcattccccccagttttagatgtaggcacctactccttcattagggaggaggatcaatgcaccttccaacaccgctccttcagggctaacgattccctaggatttatgctgctccttgctctcatcctcctagccacacagcttgtctacctcaagctgatattttttgtccacgatcgaaggaaaatgaagccagtccagtttgtagcagcagtgagtcagaactggacctttcatggccctggagctagcggccaggcagctgccaattggctagcaggatttggaaggggtcccacaccacccaccttgctgggcatcaggcaaaatgcgaataccacaggcagaaggcggctattggtcttggatgagttcaaaatggagaaaagaatcagcagaatgttttatataatgactttcctcttcctaaccttgtggggtccctacctggtggcctgctattggagagtttttgcacgagggcctgtagtaccagggggatttctaacagccgctgtctggatgagtttcgcccaagcaggaatcaatccctttgtctgcattttctccaacagggagctgaggcgctgtttcagcacaacccttctttactgcagaaaatccaggttaccaagggaaccttactgtgttatatgagggagcatctgtaaatctttagccttgtgaaacactaaccctctctgctaagcaattgtggcctgtagccatgtctggagaagaaaaccaaggatgggaatcagcagtgacaaggatttgggcaacattctgcagtctttgcaatagttcacctataatcatattttaaatttcggagtgatcctgctgactgctggcgaaggtttgtaatt

SEQ ID NO: 1338 - DNA, 1014 bp, Mus musculus
atgctcgggacaatcaacaccactgggatgcagggcttcaacaagtctgagcggtgccccagggacactcggatgacacagctgctgttcccggttctctatactgtggtcttcctggcaggcatcctgctgaacaccgtggccctctgggtgttcgtccacatccccagcaattccacctttatcgtctacctcaagaacactctggtggcagacttgataatggcactcatgctgcctttcaaaatcctttccgactcacaccttgcgccctggcagctccgaggatttgtgtgcacgctctcctccgtggtcttctatgagacgatgtatgtgggtatcatgatgctgggcctcatcgctttcgacaggttcctcaagatcatcatgccgttcaggaaaacctttgtcaaaaagacggctttcgcaaaaacagtctccatttccgtctggtccctgatgttcttcatctccctgccaaacatgatcttgaacaaggaggcaacgccatcatccgtgaagaagtgtgcatctttgaagagtccccttgggctgtggtggcatcaggtggtcagtcacacctgccagttaattttctgggctgtgtttattctgatgcttctgttttatgcggtgattaccaaaaaggtgtacaactcctataggaagtttaggagtaaggacagcaggcacaagcggctggaggtgaaggtatttatcgtcatggctgtcttctttgtctgctttgccccactgcattttgtcagaataccatacacttacagtcaaaccaccaataagactgactgtaggttagaaaaccagctgtttattgctaaagaagcaactctctttctggcaacaactaacatttgtatggaccccttaatatacataattttatgcaagaagttcacacaaaaggtgccatgtgtgagatggggaaaggcaagaacagcaggatcaagcgaagaccaccacagtagtcagacagacaacatcaccctagcctga

SEQ ID NO: 1339 - DNA, 1080 bp, Mus musculus
atggctgtccctaatgtgaatgtttctacttttgcaggtaatgagctgtacagccaagcaagtcacactgcaaacagcacaagtgagggacatgggaagaactctaccctgcacaacaaatttgacaccatcatcctgccagtgctttacctagttatctttgtggcaagcatcctgctgaacggtctggccgtgtggatcttcttccacattcggaataaaaccagcttcatattttatctcaaaaatatagtggtagctgacctcatcatgaccctgacattcccattccgaatagtccgtgatgcaggattcggaccttggtacttcgagtttatcctctgcagatacacctcagttttgttctatgcaaacatgtatacatctatcgtgtttcttgggctgatcagtgttgatcggtatctaaaggtggtaaagccctttggtgactctcgcatgtacagcataaccttcaccaaagttttatcagtttgtgtttgggtgatcatggctattctgtccttgccaaacatcatactgactaatgggcagccaactaaggaaaatattcatgactgcatgaaactcaaaagtccgctgggagccaagtggcatatggctgtcacctatgtggacagctgtttgtttgtggccgtgctggtgatcctgattggatgctacatagccatctccagatacatccacaaatccagcaggcaattcataagccaatcgagccggaagcgaaagcacaaccagagcatccgcgtggtcgtggctgtgttttttacctgcttcctcccgtatcacttgtgcagaatcccctttaccttcagtaacttagacaggcttctggatgaatcagcacataaaatcctctactattgcaaagaaatgacacttttcttgtctgcgtgcaacgtgtgcctggatccgataatttattttttcatgtgtaagtcattttcaagaaggttattcaagaaatcaaacataagaaccaggagcgaaagcatcaggtcgctgcaaagcgtccgaagatcagaagtgcgcatctattatgactacactgatgtgtaa

SEQ ID NO: 1340 - DNA, 1155 bp, Mus musculus
atgaccaactcctcctccacttcgacctccaccactaccgggggatcgctgctgctgctctgcgaggaagaagaatcgtgggcgggccggcggatcccggtgtctctcctgtactcgggcctggccatcgggggcacgctggccaacggtatggtcatctatctcgtgtcgtccttccgaaagctgcagaccaccagcaacgccttcatcgtgaatggctgcgccgcggatctcagcgtctgcgccctctggatgccacaggaggcggtgctggggctcctgccctcgggctccgcggagcccccgggggactgggacggtggcggaggcagctaccgcctgctccggggcgggttgttgggcctcgggctcactgtgtcccttctgtcccattgcctcgtggcgctgaaccgctacctgctcatcaccagggcgcctgccacctaccaggtgctctaccaacggcgccacacggtgggcatgctggcactgtcctgggcgctcgccttgggtctggtgctgctgctcccgccctgggctcctaagcccggagccgagccaccgcaagtccactaccccgcgctcctggcggcgggagcgctgcttgcgcagacggcgctgctgttgcactgctacctgggcatcgtgcgccgcgtgcgcgtcagcgtcaagcgggtcagcgtgctcaacttccacctgctgcaccagctacccggctgcgccgccgccgccgccgccttccccgccgccccgcacgcgccgggtccgggaggcgccgcgcatcccgcgcagcctcaacccctgccggccgctctgcagcctcgccgggcgcagcggcgtctcagcggcttgtcggtgctgctgctctgctgcgtcttcctgctggccacgcagccgctggtgtgggtgagcctggccagtggcttctccctcccggtgccctggggcgtgcaggcggccagctggctcctgtgctgcgccctgtcggcgctcaacccgctgctctacacgtggaggaacgaggagttccgcagatccgtgcgatctgtcctgccgggcgtcggggacgcggctgcggccgccgcggccgccaccgcggtgccagccatgtcccaggcgcaactgggtacccgggcggctggccagcactggtaa

SEQ ID NO: 1341 - DNA, 1104 bp, Mus musculus
atgtaccttgaggttagtgaacgtcaagtgctagatgcctcggactttgcctttcttctggaaaacagcacctctccctacgattatggggaaaacgagagcgacttctctgactccccgccctgcccacaggatttcagcctgaactttgacagaaccttcctgccagccctctacagcctcctcttcttgctggggctgctaggcaatggggcggtggctgctgtgctactgagtcagcgcactgccctgagcagcacggacaccttcctgctccacctggctgtagccgatgttctgctggtgttaactcttccattgtgggcagtggatgctgctgtccagtgggttttcggccctggcctctgcaaagtggcaggcgccttgttcaacatcaacttctatgcaggggccttcctgctggcttgtataagcttcgacagatatctgagcatagtgcacgccacccagatctaccgcagggacccccgggtacgtgtagccctcacctgcatagttgtatggggtctctgtctgctctttgccctcccagatttcatctacctatcagccaactacgatcagcgcctcaatgccacccattgccagtacaacttcccacaggtgggtcgcactgctctgcgtgtactgcagctagtggctggtttcctgctgccccttctggtcatggcctactgctatgcccatatcctagctgttctgctggtctccagaggccagaggcgttttcgagctatgaggctagtggtagtggtggtggcagcctttgctgtctgctggaccccctatcacctggtggtgctagtggatatcctcatggatgtgggagttttggcccgcaactgtggtcgaaaaagccacgtggatgtggccaagtcagtcacctcgggcatggggtacatgcactgctgcctcaatccgctgctctatgcctttgtgggagtgaagttcagagagaaaatgtggatgttgttcacgcgcctgggccgctctgaccagagagggccccagcggcagccgtcatcttcacggagagaatcatcctggtctgagacaactgaggcctcctacctgggcttgtaa

SEQ ID NO: 1342 - DNA, 954 bp, Mus musculus
atggcacagaatttatcttgtgagaattggttggcaacagaggctatcttgaataagtactacctctctgcattttatgcaatcgagttcatttttggactgcttgggaatgtcactgtggtgtttggctacctcttctgcatgaagaactggaacagcagcaatgtctatctttttaacctttccatctctgactttgctttcctgtgcacccttcccatcctgataaagagttatgccaatgataaggggacctatggagatgttctctgtataagcaaccgatatgtgcttcacaccaacctctacaccagcatgctcttgctcactgtcattagcatggaccgatatctgctcatgaagtaccctttccgagaacactttctacaaaagaaggaatttgccattttaatctcgctggctgtctgggccttagtgaccttagaagttctacccatgctcactttcatcaattctgtcccaaaagaagagggcagtaactgcatcgactatgcaagttctggaaaccctgaacacaatctcatttacagcctctgcctgactttgttgggcttcctaattcctctctctgtgatgtgcttcttctactacaagatggtagtcttcttaaagaggaggagccagcagcaagcaactgccctgccactggacaaaccccaacgcctggtggtcctggcagttgtgatcttctctatactcttcacaccctatcatatcatgcgcaatttgaggatcgcctcacgcctggatagttggccacaaggatgtacacagaaggccatcaaatctatatacacactgacacggcctctggcctttctgaacagtgccatcaatcccatcttctacttcctcatgggagaccattacagagagatgctgattagtaagttcagacaatacttcaagtcccttacatccttcaggacatga

SEQ ID NO: 1343 - DNA, 4488 bp, Mus musculus
gcggacgcgtggggcgggctcggctggcgggcgtgcgcggagcgggggccgcgggcgcgctgcagagatgtgacttgggcccagggccagcaggagcgtcggcgctgcggggacgcgagggtcgaatgttcctggtgttagagagaaagatgagaacccatcaagtgtttcccttgcccctgctcctggtgattgcctccgtggcttcagagaacgccagcacgtcccggggctgtggactggaccttcttcctcagtacgtgtccctgtgcgacctggacgccatctggggcatcgtggtggaggcagtggccggggcgggggccctgatcacactgcttctgatgctcattctcctagtgagactacccttcatcaaggacaaggaaaggaagcggcctgtgtgcctccatttcctcttcctgctggggaccctgggcctctttggcctgacgtttgccttcatcatccagatggacgagacaatctgctccatccgacgcttcctctggggtgtcctcttcgcgctctgcttttcctgcctgctgagccaggcgtggcgggtgcggaggctggtgcgccaaggcacaagcccggccagctggcagctggtgagcctggcactgtgcctgatgctggtgcaggtcatcattgccactgagtggctggtgctgactgtgctgcgtgacacgaagccagcctgcgcctacgagcccatggattttgtgatggcgctcatctacgacatggtgctgctggccatcaccctggcccagtccctcttcacgctgtgtggcaagttcaaacggtggaaggtgaacggagccttcatcctcgtcactaccttcctctctgcgctcatctgggtggtctggatgaccatgtacctcttcggcaactcattaattaagcagggagatgcctggagcgaccccaccttggccattacactggcagccagcggatgggtctttgtcatcttccatgccattccggagatccactacacccttctcccacccctgcaggagaacccacccaactacttcgacacttcacagcccaggatgcgggagacagcatttgatgaggaaatgcacctgcctcgggcctacatggagaacaaggccttctcaatggatgaacataacgcagctctccgatcagcagtgggcttttccaatggaagcttggagcaaagatctagcagcctgggaaagaagcccagcagcttgggaaaccggcccagtgcaccgttcagaagcaatgtgtatcagccgaccgagatggccgtcgtgctcaatggagggactatcccaactgctccgccatctcacacgggaagacaccattggtgaaagaccttaagttccagagaataagaatatttcttaccgattttattccctggctgtgtctttcttgagggcgaaatcactaaccatggcagagacaggccacccggaagccaggagatctgagaagtcccaccaaggggatttcgtgtaaatgtgacatatggatgaactggaaagctaacagtgaccgccctcccctcccctgccacacatgcaaacacggaatcgtcctgcaaactaaatcagagctaactgccaatagtcttagactcactcagaagcgtggctgggaaactgagtcattcagcagggggcaggacagagaagaagtcacagctgctgtaccagactatcttggcttattatgtgaggggttggagccagcctgtcacccccaccctcctcaccaaatgctggtccccagagccatcttttggagagaactgtgcccttgaggttaactcatggatcattctccctggcttttgcttgcctggtggcccatgcagttcaggagactttaagaggttgtggctatgattctcaaggcccagctggatggtcagggagctgtgtagccagtaggaatggaggaaccatagaacgtgccaaagaagagaaggtactctggactttgaagtgaccatcacatgtagacagaggtgaccaaccgttgttccttctgtgggcctcttgctctaccaagcaccccacctaccccaacctcccctacagagtgatagaaatatccctcctccttcctcttgcaggtgctcctccatgccttcccccaaccctagcccaccctcaccctccaccccctaacccccaagttcattaccatcttcatttcagaagctcaagtagggtcgccagcttgaagcttcaggggaggcaggctgaaaggcaggcgccatggcgccttttcgtaatgatgtcctatggctgggttccccaggggtgacctctaggatcgagagatggcatcctgttgcccagctgccagtggcttctgggatatttccccttcatgtgggtagaagtccaggatacaatgagctccatgaaggtttctggctgcttttggagggtatggagaacgtcttgattctggttttccgatggctctatggatgtggcccccttcacaactgtcatttgtcatggcttccatctgtcctgagcaagtcattcctttgttgctaggcatctccagcatccctgccattaaaagccctgcgttctctgcactgtttggccagcataatctctagcaacctttccatgctgagtttgaacctgaccatatggactgtataaacaaagggttgcagcctctgcatacactcgaatcgctacattgctttttctataaaaactacccataagcctttaacctttaatgcaaatttttaaaaggttagtgtttgggggtgggggtggggactgacctcgtcttaagccagtacatctgagctgagtgttttaataaatctgatatttctcaaggccccagtctctgctgtgtcccctccctgccctggcctatccttgtagagccttagggaggtgtggccaatctggccagcgcttggctctcctgcaagttttccttacagctagcacatcaccatgcatgggaaccagaaagcatggcacccaaaggccaccccttcccaacctcctgagatgcctcacccccatccagagcacgcgcttgctttgaatcagtgcttaaggtccatcaagtggtgggcttagaacttagaggcctgaggaggtgtgggaaggaaagaaagctagggctgtgtggggctggggctggggctgttgcatgcactaccctgcccttctgcaaagatatctccgagcacctggggccagtccggtgacaaacgtaagcgctccgcattcttgtgccaggaagtggctgtccacccccgctctctggagtcctttggagctttctgatgtcaccaataactcggtctgcaaaacccccccttgcagaagggagaagctgacatgattgacggttttctctctaagctctttgttgtccacgtataaggtgagcaccccaccgtgcagacggctgtgcagaaagcagcttgtttctgcactgtgaacacagaaccacgctgagccacaggaaaacccatcgcttagtgaggcctttcagttttgctttttttcctttccaatcctgataggttattacgctgctgggctttgttttatcttggctttaagattcagggtgggctgaatgttttgacatggagggcggaagtaggagcaaaagaagtagggccacatctactactattctgagttcgagttcacctggagaggaccacgaggcaactccacccagagactgtggcagccagcttctgacagagcaaggctgaagtgcagaagcccacagcacctgtttaacagttgatagacccgaggcttggttggggaaatggtctagaaagtcacctgggaataaccccaagctgcgagcacaacttggcacgccaccatattgggactataacagccactctgtcctctcctgagagaagactccacagaggtctggagtcagttgccaaggtagcgggacaatggcagaggggaggggctccaatgtgccagctgtttcagaagttaagatctggttattgctccacccccctcagatgagatcaaggacagccaacaagtgtagacgggtgggggaggggttgtcttttgaatttgccaaatggcagagtagaagaggacactggcatttacacatccaaggatgcagcgaccatgtgagctgatgagagcccttggcaggtgctttattcataaagagctatggctcgttttttgatagataatatatatttattaaatgtattaatgtgtattttataatgtaccctcactcttccccttatcctggctgacttgcatacttataaacaaaaattgtttgagaaatttcaagacaatcagtatgtacagggctgtatataaaatatcacagactttaaaggttgttaagcatgggcagataggttttattttcaaaatgctgttcttaacaagaaaataaaggctttactatttaaaaaaaaaaaaaaaa

SEQ ID NO: 1344 - DNA, 1320 bp, Mus musculus
atggccactcacagaaccttgctgatgtgcctaggactgcctctcttcttcccaggagccttggcccagaatcatgccccacctggttgcagcccagatctggatcccctctactacaacctctgtgaccgctcgggggcctggggcattgtcttggaggcagtggctggagcaggcatcatcacgacatttgtgttaaccatcatccttgtggctagccttccatttgtgcaggacactaagaagcggagcctcttggggacccaggtgttcttcctgctgggcaccctgggtctcttctgcctcgtgtttgcctgtgtggtgaagccggacttctctacctgtgcctctcgacgcttcctctttggggtcctgtttgccatctgcttctcctgtctggtagctcacgtcctttccctcaacttcctaacccggaagaaccatgggccccgaggctgggtgatcttcaccgtggcgctgctgctcacccttgtggaggtcatcattaacaccgagtggcttatcatcaccctggtacggggaggtggccaggttagccccctgggcaatgtcagtgccgactcgaccatgacctctccgtgtgccatcgccaacatggactttgtcatggctctcatctacgtaatgctgttgctgctgacggccttcctaggagcctggcccaccttgtgtggccgcttcaagcgctggcggaaacacggggtctttgtgttgctcaccactgtcatctccatcgccatctgggtggtatggattgtcatgtacacctacggcaacgagcagcaccatagccccacctgggatgaccccacgttggccattgccctcgctgccaatgcctggacctttgtcctcttctatgtcatccctgaggtctcacaggtgaccaaacctagcccagaacagagctaccagggggacatgtacccgacccgaggggtgggctatgagaccatcctgaaggagcagacgggccagagcatgtttgtggagaacaaggcattttctatggacgaaccagcctcagcaaagagaccagtgtcaccttacagtggctacaatggacagctgctgaccagcgtgtaccagcccaccgagatggccctgatgcacaaaggcccgtctgaaggtgcatacgacgtcatcctcccacgggccaccgccaacagccaggtgatgggcagtgccaactcaaccctgcgggccgaagacatgtacatggtccagagccaccaggtggccacgccaccaaaagacggcaagatctctcaggtctttagaaatccctacgtgtgggac

SEQ ID NO: 1345 - DNA, 903 bp, Mus musculus
atgtatgaggactgcgtgaagtccacagaagactattacctcttctgtgacaacgaggggccatgggccattgttctggagtccttggcagtgattggcatagtggttaccatattgctactcctggcatttctgttcctcatgcggaaggttcaggactgcagccagtggaacgtgcttcccactcagttcctcttcctgctggctgtgctcgggctcttcggacttacttttgccttcatcatccaactcaaccatcaaactgcccctgttcgctacttcctctttggggttctctttgctatctgcttctcctgcctcctggctcatgcctccaacctggtgaagctggtccggggtagagtctccttctgctggacaacaattctgttcattgctatcggtgtcagcctgttgcagaccatcattgcgatagagtatgtgaccctcatcatgaccagaggcttgatgttcgagcatatgacaccgtatcagctcaatgtggactttgtctgtctcctgatctatgtcctcttcctgatggccctcactttcttcgtctccaaggccaccttctgtggcccatgtgagaactggaaacagcacggaaggctcatatttgctactgtgctggtctctatcattatctgggtggtgtggatctccatgctcttgagaggcaacccccagctccagcgacagccccactgggacgatgcagtcatctgcattggcctggtcaccaacgcttgggtcttcctgctgatctacatcatccctgagctgagcatactctacaggtcatgtaggcaggagtgtcctacacaaggcaacgtctgccaggtccctgtctaccaacgcagcttcaggatggatacccaggaacccaccagagagtgctga

SEQ ID NO: 1346 - DNA, 2856 bp, Mus musculus
catgaactgagcaaatgagacagaaagatggccctattgattacagtagttacttgcttcatgattattcttgatacctcccagtcttgtcataccccagatgacttcgtggctatcacttctcctggacatatcatgattggtggcttgtttgccattcatgaaaaaatgttgtcctcagatgaccatcccagacgaccacaaatccagaaatgtgctggctttgaaatatcagtgtttcttcaaactctggctatgatacacagcattgagatgatcaataattcaacactgttatccggagtcaagctgggatatgaaatctatgacacttgtaccgaagtcacagcagcaatggctgccactctgaggttcctctcaaaattcaactgctctagagaaactgtggtctttcagtgtgactattccagctacatgccaagggtcaaggctgtcataggtgctggctactctgaaacatccatcgcggtctcaaggatgctgaacttacagctcatgccacaggtgagttatgaatccactgcagaaatcctgagtgacaagatccgctttccttcatttttacggactgtgcctagtgacttctaccaaactaaagcaatggcccacctgatccgacaatcgggatggaactggattggtgccataacaaccgatgatgattatggaagactagctctcaacacatttgcaatacaggctgctgaaaacaatgtgtgcattgccttcaaagaggttctgccagccttcctctcagataataccattgaagtgagaattaaccagactctggagaagatcattgcagaagcccaggttaatgtcattgtggtgtttctgagaaaattccatgttttcaatctcttcacgaaagccattgaaaggaaaataagtaagatctggattgctagtgataattggtcaaccgctaccaagattatcaccatccctaatgttaagaagcttggcaaagtggtggggtttgcctttaggagaggaaatacgtcttctttccattcttttcttcaaactctgcatatgtaccccaatgacaataacaaacccctacatgaatttgccatgctcgtttctgcctgtaaatacatcaaagacggtgatttgagccaatgcatatccaactattctcaggcaactttgacctatgacactaccaagaccattgaaaaccacttattcaagagaaatgatttcctctggcattatactgagccgggactcatttatagcattcagcttgcagtgttcgcccttggtcatgccatccgggatctgtgccaagctcgagactgcaagaaacccaacgcctttcagccatgggagctacttgccgtgctgaaaaacgtgacattcactgatggaaggaattcatttcactttgatgcccacggggatttaaatactggttatgacgtggtgctctggaaggagaccaatggcctcatgactgtcacaaagatggcagaatatgacctgcagcgtgacgtcttcatcaccacaaaccaagaaacaaaacatgaattcaggaaacttaagcaaattctatctaaatgctccaaggaatgcagccctggtcaaatgaagaaagccacaggaagccaacacagctgttgctatgaatgtgtgagctgcccagaaaaccactacagtaatgagacagatatggatcactgccttttatgcaacaatgaaacccactgggccccagtaaggagcactacctgctttgaaaaggaagtggagtatctggactgggatgactccttggctctcctcctcattgccctctccctacttggaatcgcctttgttctggccattggcataatatttacaagaaacctgaagacacctgtcgtgaaatcatctggaggattagtggtctgctacgtgatgctcatctgccacgcccttaactttgccagcacaggcttttttattggagaaccacaagactttgcgtgcaagaccaggcagaccttatttggtgtgagctttactctctgtgtctcctgtattttgaccaagtccctgaaaattttgctagctttcagttttgaccccaagctgacaatgttcctgaagtgcctttataggcctgttcccattgttcttacctgcacgggcattcaagtggtcatttgcactctttggctggtgctggcagcacctagtgtggaagagaatatctccttgcctagagtcattatcctggaatgtgaggaggggtcagcactggcatttggtaccatgctgggctacatcacagttctggccttcatttgctttgtatttgcattcaaggggaggaaacttcctgagaattacaacgaagccaagttcctgacctttgggatgctgatttacttcatagcttggatcacattcatccctgtctatactaccacattcggcaagtatttgcccgccgtggagattatagtcattctgatatccaattatgggattctctgctgtatattcttccccaagtgctacattattctttgcaagcagaagactaacaccaaatcagccttcctccagatggtttacaactactctgctcacagtgtggacagccttgccttgagtcatgtttccctggactccaccagctacgatactgcaacaaccaatcagagccctggtaacaagatgacagcctgtcagaacgacaaccatcttcctgcacaagtgctcccacacacaggcacggcaaagactatcaaagcgtctaaaactttgcgtcagaaaagaagttcaagtatatgattgagttcctaggagacgctgtgatccccagtgagatgtttc

SEQ ID NO: 1347 - DNA, 1767 bp, Mus musculus
atggctcggggagggttgggggcagaagaggcctccctacgctcaaacgcattgtcctggctggcctgtgggctcctggccctgctggccaacgcttggatcatccttagcatctcagccaaacagcagaaacacaagccactggagttactgctctgcttcctggccggtactcatatactcatggcggctgtgccccttaccacctttgctgtggtgcagctccggcgccaggcttcctctgactatgactggaacgagagcatctgcaaggtctttgtgtccacctactacacgctggccctggccacctgcttcacggtcgcctcgctctcctaccatcgcatgtggatggtgcgatggcccgttaactaccgcctcagcaacgccaagaagcaggcgctgcatgccgtcatgggcatctggatggtcagcttcatcctctccacgctgccctccatcggctggcacaacaacggggagcgctactatgcccgaggctgccagttcatagtctccaagatcggcctcggttttggtgtctgcttcagcctcctgcttcttgggggcattgtcatggggttggtctgtgtggctatcacattctatcagacactgtgggcccggccccggagggctcggcaggcccggagagcggggggcagtgtgggcaccaaagcaggggggctgggggggttgggtacccggccagcttttgaggtgccagccattgtggtggaggatactcgagggaagcggcggtcctcgctggatggctctgaatctgccaagacatccttgcaggtcaccaacttggtcagcgccatcgtctttctctatgactcactcacgggggtgcccattttggtggtgagcttcttctccttgaagtcagactcagctccgccatggatggtgttggcagtgctgtggtgctccatggcacagacactgctcctgccctccttcatctggtcctgtgagcgctaccgtgcagatgtgcgcacagtgtgggagcagtgtgtggcgatcatgtccgaggatgacggtgatgacgatggcacctgtgacgactacacagatggccgagtgtgcaaaattcgctttgatgctaacggggccacagggtcagggagtcgggaccccacccaggtgaagctgctgcctgggcggcacatgctcttcccaccgctggagagagtacactacttacaggtccctttgtcccgacgattatcccacgatgagaccaacatcttttctactcctcgggcaccaggctccttcctgcacaagtggtcctcatcggatgatatccggatcctcccagcccagagccgagccctcggaggccctccagaatacctgggacagagacacaggctggaggatgaggaggatgaggaagaggctgaaggcgggggcttggccagccttcgacagtttctagaaagtggggttctggggtcgggtgggggacccccacgaggtcccggttttttccgggaggagatcaccaccttcatcgatgagacacctctgccttctccaactgcgtcaccaggaccctctcctcgtaggcctagaccactgggtttttcacctcgacggctctcccttgggtctccggatagccgagccgttggacttcctttggggttaagtgcaggaagacgctgttccctgaccgggagcgaagggagttcaagggcttggggaagaccctgggggccaggtaaccccatcttcccccagttgaccctgtga

SEQ ID NO: 1348 - DNA, 3600 bp, Mus musculus
atggtccggctcctcttgattttcttcccaatgatctttttggagatgtccattttgcccaggatgcctgacagaaaagtactgctggcaggtgcctcgtcccagcgctctgtggcgagaatggacggagatgtcatcatcggagccctcttctcagtccatcaccagcctccagccgaaaaggtaccggaaaggaagtgtggggagatcagagaacagtatggtatccagagagtggaggccatgttccacacattagataagattaatgcggacccggtgctcctgcccaacatcactctgggcagtgagatccgggactcctgctggcactcttctgtggctctggaacagagcattgagttcatcagagactccctgatttccatccgagatgagaaggatggactgaaccgctgcctgcctgatggccagaccctacccccaggcaggactaagaagcctattgctggagtgatcggccctggctccagctctgtggccattcaagtccagaatcttctgcagctgttcgacatcccacaaatcgcctattctgccacgagcatagacctgagcgacaaaactttgtacaaatacttcctgagggtggtcccttctgacactttgcaggcaagggcgatgcttgatatcgtcaagcggtacaactggacctatgtctctgcagtccacacagaagggaattacggcgagagtggaatggatgctttcaaagagttggctgcccaggaaggactctgcatcgcacactcggacaaaatctacagcaatgctggcgagaagagctttgatcggcttctgcgcaagctccgagagcggcttcccaaggccagggttgtggtctgcttctgcgagggcatgacagtgcgggggttactgagtgccatgcgccgccttggcgtcgtgggagagttctcactcattggaagtgatggatgggcagacagagatgaagtcatcgaaggctatgaggtggaagccaatgggggaatcacaataaagctgcagtctccagaggtcaggtcgtttgatgactactttctgaagctgaggctggacaccaacacgaggaatccttggttccctgagttctggcaacatcgcttccagtgtcgcctacctggacacctcttggaaaaccccaactttaaaaaagtctgcacaggaaatgaaagcttggaagaaaattatgtccaggacagcaaaatgggatttgtcatcaacgccatctatgccatggcacacggcctacagaacatgcaccatgctctatgtcctggctacgtgggcctttgtgatgccatgaagcccattgacggcaggaagctcctggatttcctcatcaaatcctcttttgttggagtgtctggagaggaggtctggttcgatgagaagggggatgcacctggaaggtatgacattatgaatctgcagtacacagaggctaatcgctatgactatgtccatgtgggaacctggcatgaaggtgtgctgaatatcgatgattacaaaatccagatgaacaaaagcggaatggtacgatctgtgtgcagcgagccttgcttaaagggtcagattaaggtcatacggaaaggggaagtgagctgctgctggatctgcacagcctgcaaagagaatgagtttgtgcaagatgagtttacctgcagagcctgtgacctggggtggtggcccaatgcagagctcacaggctgtgagcccattactatccgttacctcgagtggagtgacatagaatccatcatagccatcgccttttcttgcctgggcatcctcgtgacgctatttgtcaccctcatctttgtgctgtaccgggacacacctgtggtcaaatcctccagtagagagctctgctatatcattctggctggtattttcctcggctacgtatgccctttcaccctcatcgccaaacctactaccacatcctgctacctccagcgcctcctagttggcctctcttctgccatgtgctactctgctcttgtgaccaaaaccaatcgtattgcacgcatcctggctggcagcaagaagaagatctgtacccggaagcccaggttcatgagcgcttgggcccaagtgatcatagcctccattctgattagtgtacagctgacactagtggtgaccttgatcatcatggagcctcccatgcccattttgtcctacccgagcatcaaggaagtctatcttatctgcaataccagcaacctgggtgtagtggcacctgtgggttacaacggacttctcatcatgagctgtacctactatgccttcaagacccgcaacgtgccggccaatttcaatgaggctaaatacatcgccttcactatgtacaccacctgcatcatctggctggcttttgttcccatttactttgggagcaactacaagattatcactacctgcttcgcagtgagcctcagtgtgacggtggccctgggctgcatgttcactcccaagatgtacatcattattgccaaacccgagaggaatgtccgcagtgccttcaccacctctgatgtagtgcgcatgcacgtcggtgacggcaagctgccatgccgctccaacaccttcctcaacattttccggagaaagaagcctggggcagggaacgccaattctaacggcaagtctgtgtcatggtctgaaccaggtggaagacaggcgcccaagggacagcatgtgtggcagcgcctctctgtgcacgtgaagaccaatgagacggcctgtaaccaaacagccgtaattaaacccctcactaaaagttaccaaggctctggcaagagtctgaccttttcagacgccagcaccaagaccctttacaacgtggaggaagaggacaataccccttcaactcacttcagccctcccagcagcccttccatggtggtgcaccgacgcgggccacccgtggccaccacgccacctctgccaccccaccttagcgcagaagagacgcccttgttcctggctgattctgtcatccccaagggcttgcctcctcctctcccgcagcagcaacagcagccgccccctcagccgcctccgcagcagcccaaatccctgatggaccagctgcaaggcgtggtcaccaactttggctctgggattccagacttccacgcggtgctggcaggcccggggacaccagggaacgggctgcgctccctgtacccgcccccgcctccaccgcaacacctgcagatgttgcccctgcagctgagcaccttccgagaggagcccatctcccctccgggggaggacgacgatgatgacagcagcgagaggttcaagctcctgcaggagttcgtgtatgagcgtgaagggaacacggaggaagacgatctggaagaggaggaggacctgcctgcagccagcaagctgacgcctgaggattcgcctgccctgacgcccccttctcctttccgagattccgtggcctctggcagctcagtgcccagttccccagtgtctgagtcagtgctctgcacccctccaaatgtgacctatgcctctgtcattctgagggactacaagcaaagctcttccactctgtag

SEQ ID NO: 1349 - DNA, 2640 bp, Mus musculus
atgaagatgttgacaagactacaagttcttatgttagctttgttttcaaagggatttttagtctctttaggagatcacaactttatgaggagagaaattaaaatagaaggagaccttgttttagggggcttatttcctattaatgaaaaaggcactggaactgaagagtgtggacgaatcaatgaagacagaggtatccaacgcctggaggccatgttgtttgccattgatgaaatcaacaaagacaattacttgcttccaggagtgaagctgggggttcacattttggatacatgttcaagagacacctatgcattagagcagtcactggagtttgtcagagcatcgttgactaaagtggatgaagctgaatatatgtgtcctgatggatcatatgctattcaagaaaacatcccactactcattgcaggagtcattggcggttcgtacagcagtgtttccatacaggtggcaaacctgctgaggctcttccagatccctcagataagctacgcctccaccagtgccaaactcagcgacaaatcgcgctatgattattttgccaggaccgtgccccctgacttctaccaggccaaagccatggccgagatcttgcgctactttaactggacctatgtgtccactgttgcctctgaaggtgactatggggagacagggattgaggccttcgagcaggaagcaaggctacgcaacatctgcatcgccactgctgaaaaggtggggcgctccaacatccgcaagtcctacgacagcgtgatccgtgagctcctgcagaaacctaacgcgcgagttgtggtcctgttcatgcgcagtgatgactcacgagagttgatcgctgcagccagccgcgtgaatgcttccttcacctgggtggccagcgatggctggggtgcacaggagagcattgtcaagggcagtgagcacgtcgcctatggagccatcaccctggagctggcgtcccaccctgttcgtcagtttgatcgctacttccagagcctcaacccctacaacaatcatcgtaacccctggttccgagacttctgggagcagaagttccagtgcagcctccagaacaagagaaaccacagacagatttgtgacaagcacctggccattgacagcagcaactatgaacaagaatccaagatcatgtttgtggtgaatgcagtgtatgccatggcgcatgcgctgcacaaaatgcaacgcaccctctgtcccaacaccaccaagctctgtgatgcaatgaagatcctggatggaaagaagttgtacaaagattatttgctgaaaatcaacttcacagctccattcaacccaaataaaggagcagacagcattgtgaagtttgacacttacggagacgggatgggaagatacaacgtgttcaacttccagcatataggtggaaagtattcctacttaaaagttggccactgggcagaaactttatatctagatgtggactctattcattggtcccggaactcagtccccacttcccagtgcagtgatccctgtgcccccaatgaaatgaaaaacatgcagccaggagatgtttgctgctggatctgcatcccatgtgagccctatgaatacctggttgatgagttcacctgcatggattgtggccctggccagtggcccactgcagacctatctggatgctacaaccttccagaggattacatcaggtgggaagatgcctgggcaataggcccagtcactattgcctgcctgggttttatgtgtacatgcatagtcataactgtttttatcaagcacaacaacacacccttggtcaaagcatcaggccgagaactctgctacatcttgttatttggagttagcctgtcctattgcatgacattcttcttcattgctaagccatcgcctgtcatctgtgcattgcgccgacttgggcttgggacctcctttgccatctgttattcagctctcctgaccaagacaaactgcatcgctcgcatctttgatggggtcaagaatggcgctcagaggccaaaattcatcagccccagttctcaggtttttatctgcctgggtttgatactggtgcaaattgtgatggtgtctgtgtggcttatcttggagactccaggtactagaagatacaccctgccagagaagcgggaaacagtcatcctaaaatgcaatgtcaaagattccagcatgttgatctctctgacctatgacgtggttctggtgattctatgcactgtgtatgccttcaaaacaaggaagtgtcctgaaaacttcaatgaagccaagttcataggcttcaccatgtacaccacctgcatcatctggttggcattcctccctatattttatgtgacatcaagtgactacagagtgcagacgacaacaatgtgcatctccgttagcttgagtggtttcgtggtcttgggctgtttgtttgcccccaaggtgcacattgtcctgttccaaccccagaagaatgtggtcacacacagacttcacctcaacaggttcagtgtcagtggaactgcgaccacatattctcagtcctctgcaagcacatatgtcccgacagtgtgcaacggaagggaagtcctggactccaccacctcatctctgtga

SEQ ID NO: 1350 - DNA, 2727 bp, Mus musculus
atggtttgtgagggaaagcgctcaacctcttgcccttgtttcttccttttgactgccaagttctactggatcctcacaatgatgcaaagaactcacagccaggagtatgcccattccatccgcctggatggggacatcattttggggggtctttttcctgttcatgccaagggagaaagaggggtgccttgtggggacctgaagaaggaaaagggcatccacagacttgaggccatgctttatgcaatcgaccagactaataaggaccccgatctcctctccaatatcactctgggtgtccggatccttgacacatgttccagggacacctatgctttggagcagtcactaaccttcgtgcaggcactgatagagaaagacgcgtctgacgtgaagtgtgctaatggagacccacccatattcaccaagcccgacaagatttctggtgtcataggtgctgcagcaagctccgtgtccatcatggtggctaacattttaagactttttaagatacctcagattagctatgcatctacagccccagagctaagtgacaacaccaggtatgatttcttttctcgggtggtcccgcctgactcctaccaagcccaagccatggtggacattgtgacagccctgggatggaattatgtgtcaacactggcttccgaggggaactatggagagagtggtgttgaggccttcactcagatctcaagggagattggtggtgtttgcattgctcaatcacagaaaatcccacgtgaaccaagacctggagaattcgaaaaaattatcaaacgcctgctggagacacccaacgctcgcgcagtgattatgtttgccaatgaggatgacatcagggggatattggaagcagcaaaaaaattaaaccagagtgggcattttctatggattggctcagatagttggggatccaaaatagcacctgtctatcagcaggaggagatcgccgaaggagctgtgacaattttgcccaaaagagcatcaattgatgggtttgaccgatactttagaagccgaactcttgccaataatcgaagaaatgtgtggtttgcagaattttcggaggggaattttggatgcaaatcaggatcacatgggaagaggaacagtcatataaagaaatgcacagggctggagcgaattgcacgggattcatcttacgaacaagaaggaaaggttcaatttgtaattgatgcagtgtattccatggcttatgcactgcacaacatgcacaaagaactctgccctggttacataggcctttgcccaaggatggttaccatcgatgggaaagagctactgggttacatcagggccgtgaattttaatggcagcgctggtacacctgtcacttttaatgagaatggagatgctccgggacgctacgatatcttccaatatcagataaacaacaaaagtacagaatacaaaatcatcggccactggaccaatcaacttcacctaaaagtggaagacatgcagtgggctaatagagagcacacgcacccagcatctgtctgcagcctgccgtgcaagcctggggagaggaagaaaaccgtgaaaggggtcccttgctgctggcactgtggacgctgcgagggttataactaccaggtggacgaactctcctgtgaactctgccctttggatcagagaccaaacatcaaccgcactggctgccagaggatccccatcatcaagttggagtggcattcaccctgggccgtggtacctgtgctcatagcaatattgggaatcattgccaccacctttgtgattgtgacctttgtccgctataatgacacaccaatcgtgagagcttctgggcgggaacttagttatgtgctcctaacggggatttttctctgttactcaatcacttttttgatgattgcggcacctgacacaatcatctgctctttccgaaggatcttcctgggacttggtatgtgtttcagctatgcagcacttttgaccaaaacaaaccgtatccaccgaatattcgagcaagggaagaaatctgtcacagcacctaagttcatcagcccagcatcccagctggtgatcaccttcagcctcatctccgtacagctccttggagtgtttgtgtggtttgtcgtggatcccccccacaccatcattgactatggagaacagcgaacactggatcccgagaacgccaggggagtgctcaagtgtgacatttccgatctgtcactcatttgttcactgggatacagtatcctcctgatggtcacttgtactgtttatgccattaaaaccagaggggttccagaaacgttcaatgaagccaaacctattggatttaccatgtacaccacgtgcatcatttggttagctttcattcccatcttttttggtacagcccagtcagcagaaaagatgtacatccagacaacaacacttactgtctccatgagtttaagtgcttcagtgtctctgggaatgctctatatgcccaaagtttatattataatttttcatccagagcagaacgttcaaaaacgcaagagaagcttcaaggctgtggtcacggccgctaccatgcaaagcaaactgatccaaaagggaaatgacagaccaaacggcgaggtgaaaagtgaactctgtgagagtcttgaaaccaacacttcttctaccaagacaacatacatcagctacagtgatcattcaatctga

SEQ ID NO: 1351 - DNA, 1155 bp, Mus musculus
atggctccaaataattgttcccacctgaacttggacgtggaccctttcctgtcctgcaacgacaccttcaatcaaagtctgagtccccccaagatggacaactggtttcacccgggcttcatctatgtcatccctgcagtttatgggcttatcatcgtgataggtcttattggcaacatcacgctcatcaagatcttctgcacggtcaagtccatgcgaaacgtgccaaacctgttcatctctagcctggctttgggagacctgctgctgctggtgacatgcgcccctgtggatgccagcaagtacctggctgacaggtggctatttggcagaattggctgcaaactgatcccctttatacaacttacttcagtgggggtgtctgtcttcacacttacggcactgtcagctgacaggtacaaagccattgtacggccaatggatatccaggcatcccatgccctgatgaagatctgtctcaaagctgctttgatctggattgtctctatgttgttggccatcccagaggctgtgttttctgacctccaccccttccatgtgaaagataccaaccaaaccttcattagttgtgccccctacccacactccaatgagctacaccctaaaatccattccatggcttcctttctggttttctacgttatcccactggcgatcatctctgtctactactacttcattgcccgaaatctgattcagagtgcctacaatcttcccgtggaaggcaatatacatgtcaagaagcagatcgaatcccggaagcggcttgccaagacagtactggtgtttgtgggcctctttgccttctgctggctccccaaccatgtcatctacctgtaccgttcctaccactactctgaagtggacacctccatgctccactttgtcaccagcatctgtgcccgcctcctggccttcaccaactcctgtgtgaacccctttgctctttatctgctgagcaagagcttcaggaagcagttcaacactcaacttctctgctgccagcctggcctgatgaacaggtcccacagcacaggcagaagtaccacctgcatgacctccttcaagagcactaacccctcggctacctttagcctcatcaacagaaatatctgtcatgaggggtatgtctag

SEQ ID NO: 1352 - DNA, 957 bp, Mus musculus
atgacaaacagttcaacgttctgtccggtttacagagatctggaaccatttacctattttttttatttagttttcctcattggaattattggaagttgttttgccacgtgggcttttatacagaaaaccacaaatcacagatgtgtcagcatatacttaattaatttgcttacagctgatttcctgctcaccctggcattaccagtaaaaatcattgttgacttgggtgtggcaccctggaagctaaggatattccactgccaagtgacagcctgcctcatctacatcaatatgtacttatctattatcttcttagcctttgtcagcatcgatcgctgtcttcagttaatacacagctgcaagatataccgaatacaagaacctgggtttgccaaaatgatatcagctgtcgtgtggctcatggtcctgctgatcatggtgccgaacatggtgattcccatcaaggacatcaaagaaaagtcaaatgtaggttgcatggagtttaaaaaggagtttggaagaaactggcatttgctaacaaacttcatctgtgtggcaatatttttaaatttctcagtcatcattttgatatccaacttccttgcaatcagacaactctatagaaatagagacaacacaaactatccaagtgtgaaatcagctctgctccacattctcttggtgacagctagttacatcatatgctttgttccctaccacgctgtcaggatcccatacaccctcagccagacagaggtcatatctgattgctcaactaggatcgcactcttcaaagccaaagaggccacactgctgctggcggtgtctaatttgtgttttgatccaatcctgtactatcatctgtcaaaagcctttcgactaaaggtcaccgagactttcgcctcacctaaaaagagcaagcctctggaagaaagattgagaagtgagaatgatgtg

SEQ ID NO: 1353 - DNA, 1242 bp, Mus musculus
atggccacatccaattcttctgcctctctgcccaccctcttctgggtcaatggctctggagacagcgtgctgagcactgacggtgctgccatgcctgtccagttccttgttctgaggatcatggttgcactggcctatggacttgtaggtatcattggcttgctgggaaatttggccgtactgtgggttctaggtaactgtggtcagcgtgtgcccggcctgtcttctgatacctttgtcttcagcctggctctagcagacttggggctggcccttactctccctttctgggcaaccgagtcagcaatggacttccactggcctttcggaagtgccctctgcaaggtagtcctgaccaccaccgtcctcagcatctatgccagcaccttcctaatcacagcactgagtatcgcgcgatactgggtggtagccatggctgtgggaccaggtagtcacctctcagtcttttgggcccgtgtggtcaccctggcagtgtgggtggcagctgccctggtgactgtgcccacagcaatctttggggctgaagttgagttgtggggcgtgtgcctctgtcttctgcgtttccccagcagatactggctgggagcttaccagctacagagggtagttctggccttcatcgtgcccttgggagtcattaccaccagttacctgctgctgttggcctttctagagcggcagcaaagatgcaggccacgacaatggcaggacagccgagtggtagcccgctctgtccgtgtcctggtggcttccttcgccctctgctgggttcccaaccatgtagtcactctctgggaaattctggtaaggtttgacctggtgccctgggacagtactttctacacctttcatacttacatccttcccatcaccacctgcttggcccacagcaacagctgcctcaaccctgtgatctattgtctcctgcggcgggagccccagcaggttcttgtcagctccttcagagctctctggtcaagactgtggcctcaaaggaaggcctgcatggaacaaatggccctcaaggaggtaggcgggagaacggtagccagcacccaggagagtggctcttctaggacacacacaaacacaatggaacacctggatgaaggatgcagcctgaacactctcctttctgagacctatcaggggcagagcccacagattctagggaggagcagctgctctctcagtcaggctgctgtgtccccaggagaagtc

SEQ ID NO: 1354 - DNA, 987 bp, Mus musculus
atgacacccaacagcactgagctgtcggccattcccatgggggttctggggctttccttggccctggcaagcctcatcgtcatcgccaacctgctcctggccctaggcatcgccctggaccgccacttgcgcagcccacctgctggctgcttcttcctaagcctactactagccgggctgctcacagggctggcactgcccatgctgcctgggctatggagccggaaccatcagggctactggtcctgcctccttctccacttgacccccaacttttgtttcctttccctgcttgccaatctgctgctggtgcatggggaacgctacatggcagtgttgcagccactccggccccatggaagtgtgcggctagccctgttcctcacctgggtcagctccctgttctttgccagcctgcctgctctgggctggaaccattggagccctgatgccaactgcagctcccaagctgtcttcccagccccctacctctacctggaagtttatggcctcctgttgcctgccgtgggggccactgcccttctctctgtccgcgtgttggccactgcccaccgccagctgtgtgagatccgccgactggagcgggcagtgtgccgcgatgtaccctcaaccctggctagggctctcacctggaggcaggctagggcacaggcaggagccacactgctcttcttgctgtgttgggggccctatgtggccacattgctcctgtcagtcttggcctatgagcgtcgcccaccactagggcctggaactctgttatcgctcatctcattgggcagcaccagtgctgccgctgtgcctgtggccatggggctgggtgatcagcgctacacagccccctggaggacagctgcccaaaggtgtctacgagtgcttcgaggaagagccaagagggacaatccaggccccagcactgcctaccacaccagtagccaatgcagcattgacctggacttgaattag

SEQ ID NO: 1355 - DNA, 1008 bp, Mus musculus
atggagtcatccttctcatttggagtgatccttgctgtcctaaccatcctcatcattgctgttaatgcactggtagttgtggctatgctgctatcaatctacaagaatgatggtgttggcctttgcttcaccttgaatctggccgtggctgataccttgattggcgtggctatttctggtctagttacagaccagctctccagctctgctcagcatacacagaagaccttgtgtagccttcggatggcatttgtcacttcttctgcagctgcctctgtcctcaccgtcatgctgattgcctttgacagataccttgccattaagcagcccctccgttacttccagatcatgaatgggcttgtggctggagcatgcattgcaggactgtggttggtatcttaccttatcggcttcctcccactcggagtctccatattccagcagaccacctaccatggaccctgcagcttctttgctgtgtttcacccaaggtttgtgctgaccctctcctgtgctggcttcttcccagctgtgctcctctttgtcttcttctactgtgacatgctcaagattgcctctgtgcacagccagcagatccggaagatggaacatgcaggagccatggccggagcttatcggcccccacggtctgtcaatgacttcaaggctgttcgtactatagctgttcttattgggagcttcactctgtcctggtctccctttctcataactagcattgtgcaggtggcctgccacaaatgctgcctttaccaagtgctggaaaagtacctgtggctccttggagttggcaactccctactcaacccactcatctatgcctattggcagagggaggttcggcagcagctctaccacatggccctgggagtgaaaaagttcttcacttcaatcctcctccttctcccagccaggaatcgtggtccagagaggaccagagaaagcgcctatcacatcgtcactatcagccatccggagctcgatggctaa

SEQ ID NO: 1356 - DNA, 1083 bp, Mus musculus
atgagcaagtcagaccattttctagtgataaacggcaagaactgctgtgtgttccgagatgaaaacatcgccaaggtcttgccaccggtgttggggctggaatttgtgttcggactcctgggcaatggccttgccttgtggattttctgtttccacctcaagtcctggaaatccagccggattttcttgttcaacttggccgtggctgactttctcctgatcatctgcctgccgttcctgacggacaactatgtccataactgggactggaggttcggaggcatcccttgccgtgtgatgctcttcatgttggctatgaaccgacagggcagcatcatcttcctcaccgtggtggctgtggaccgctacttccgggtggtccatccacaccacttcttgaacaagatctccaaccggacggcggccatcatttcttgcttcttgtggggtctcaccatcggcctgactgtccacctcctctatacaaacatgatgaccaaaaatggcgaggcatatctgtgtagcagcttcagcatctgttacaacttcaggtggcacgatgctatgttcctcttggaattcttcttgcccctggccatcatcttgttctgctcaggcaggatcatctggagcctgaggcagagacagatggacagacatgccaagatcaagagggccatcaacttcatcatggtggtggctattgtattcatcatttgcttcctacccagtgtggctgtgcgcatccgcatcttctggcttctctacaaatataacgtacgcaactgtgacatctactcctcggtggacctggctttctttaccacccttagctttacctacatgaacagcatgctggaccctgtggtctactatttctccagcccatctttccccaacttcttctccacgtgtatcaaccgctgccttcgaaagaaaacattgggtgaacccgataataaccgaagcactagtgtggagctcacgggggaccccagcacaaccagaagtattccaggggcgctaatggctgaccccagtgagccaggcagccccccttatctggcttccacatctcgttaa

SEQ ID NO: 1357 - DNA, 1467 bp, Mus musculus
atgaggcttcccaacacctcttctgcctccgaagacaagatgtgtgaggggaacaggacagccatggccagccctcagctgctgcccctggtggtggttctaagtagtatctccctggtcacagtgggcctcaacctgggggtgctgtatgcagtgcgcagtgagcgcaagctacacaccgtgggcaacctgtacattgtcagcctgtcggtagcagacctgattgtaggggcaatcgtcatgcccatgaacatcctctatcttatcatgacaaagtggtccttgggccgccccctctgcctcttttggctctctatggattatgtggccagcacggcatccatctttagtgtcttcatcctgtgtattgatcgctaccgctctgtccagcaacccctccggtacctgaggtatcgaaccaagacccgtgcttcagctaccatcctgggggcctggtttctctccttcctgtgggttatacctatacttggctggcatcacttcacgcccctggccccagagcttcgggaagataagtgtgagacagatttctacaatgtcacttggttcaagatcatgaccgccatcatcaacttctacctccccactttgctcatgctgtggttctatgtgaagatctacaatggtgtgcggcgacactgtcagcacccgcagctcaccaacgggtccctccctacctttttagaaatcaagctgaggtcggaagattccaaagagggtgccaagaaacctgggaaagagtctccctggggggtccagacgaggccgtcaagagaccctactgggggtctggatcagaagtcaacatctgcagaccccaaggtgacctctccgactgtcttcagccaagagggggaaagggaaacagtcacacgcccctgtttccgtcttgacgtcatgcagacacagcctgtgcctgagggagatgccaggggctcaaaggccaatgaccagaccttgagccagcccaaaatggatgagcagagcctgagtacttgccggcggatcagtgagacatcagaggaccagaccttggtggatcgacagtccttctcccggaccacagactcagacaccagcatagagccagggctgggcaaagtcaaagcgagaaggaggtctaacagtggcctggactacatcaaagtcacctggaagaggctccgctcacattccagacagtatgtgtccgggttgcacttgaaccgagagcggaaggcagccaagcagttgggttgtatcatggcagcattcattctctgctggattccctatttcatcttcttcatggtcattgccttctgcaacagctgctgcagcgaacctgtgcacatgttcaccatttggctgggctacatcaactccacgctgaaccccctcatctacccgctgtgcaacgagaacttcaagaagacattcaaaaaaattctgcacattcgttcctaa

SEQ ID NO: 1358 - DNA, 1077 bp, Mus musculus
atggagcccaatggcacggttcattcctgctgtttggactctattgcattgaaagtcaccatcagtgtggtcctcaccaccctcatcttcatcactgttgctggcaatgtggtcgtctgcctggctgtcagcttgaatcgtcggctccgcagtctgaccaattgcttcattgtgtccctggcagccactgacctgcttcttggcctcctggtgatgcccttctctgccatttaccagttgtccttcaagtggaggtttggccaggtcttctgcaacatctacaccagcctggatgtgatgctctgcacagcttccatcctcaacctcttcatgatcagcttggaccgctactgcgctgtcacggacccactgcggtaccccgtgttggtcacccctgttcgcgttgccatctctttggtctttatttgggtcatttccatcaccctctccttcctctctattcacctaggatggaacagcagaaatgggaccagagggggcaatgacaccttcaagtgcaaagtgcaggtcaacgaggtatatggactggtggatgggatggtcaccttctacctgcctcttctcatcatgtgtgtcacctactacagaatctttaagatcgccagggagcaagccaagaggatcaaccacatcagctcctggaaggcagccaccatcagagaacacaaagccaccgtgaccctggctgccgtcatgggagcattcatcgtctgctggtttccttacttcactgccttcgtttaccgtggactgagaggggatgaccctgtgaacgaggtggtcgagggtatcgtcctatggttgggttatgccaattcagccctgaaccccatcctgtacgccaccctcaacagagacttccgcatggcgtaccaacagctcttccactgcaagcttgcaagccacaactctcacaaaacttccctgaggttgaacaactctctgctgtccaggagccaaagccgagaaggtagatggcaggaggagaagcccctgaagcttcaggtgtggagtgggacagaactcacacacccccagggaagcccagtcaggtaa

SEQ ID NO: 1359 - DNA, 2483 bp, Mus musculus
tcgcgatctagaccccgcccggccacccagcactcggcccctgccctgcccagtgtccccgagccctgtgagcctgctgggccatggagcgcgcgccgcccgacgggctgatgaacgcgtcgggcgctctggccggagaggcggcggctgcaggcggggcgcgcggcttctcggctgcctggaccgctgtcctggctgcgctcatggcgctgctcatcgtggccacagtgctgggcaacgcgctggtcatgctcgccttcgtggcggattcgagcctccgcacccagaacaacttctttctgctcaacctcgccatctccgacttcctcgtgggtgccttctgcatcccattgtatgtaccctatgtgctgaccggccgttggacctttggccggggcctctgcaagctgtggctggtggtagactacctactgtgtgcctcctcagtcttcaacatcgtgctgatcagctatgaccgattcctgtcagtcactcgagctgtctcctaccgggcccagcagggggacacaagacgggctgttcggaagatggcactggtgtgggtgctggccttcctgctgtatgggcctgccatcctgagttgggagtacctgtccggtggcagctccatccccgagggccactgctatgctgagttcttctacaactggtactttctcatcacggcctccaccctcgagttcttcacacccttcctcagcgttaccttcttcaacctcagcatctacctgaacatccagaggcgcactcgtcttcggctggatgggggccgagaggctggtccagaacccccacctgatgcccaaccctcgccacctccagctccccccagctgctggggctgctggccaaaggggcacggggaggccatgccattgcacaggtatggggtgggtgaggcaggccctggtgttgagactggggaggctggcctcgggggtggcagcggtggaggcgctgctgcctcgcctacctccagctccggcagctcctcaaggggcactgagaggccacgctcactcaaaaggggctccaagccatcagcgtcttcagcgtccttggagaagcgcatgaagatggtatcccaaagcatcacccagcgctttcggctgtcgcgggacaagaaggtagccaagtcgctggctatcatcgtgagcatctttgggctctgctgggccccgtacacactcctcatgatcatccgggctgcttgccatggccactgcgtccccgactactggtacgagacgtccttctggcttctgtgggccaactcggccgtcaaccccgtcctctacccactgtgccactacagcttccgtagagccttcaccaagctcctctgcccccagaagctcaaggtccagccccatggctccctggagcagtgctggaagtgagcagctgccccacccttctacggccaggcccttgtacctgttctgagggggagcccgagcgtgggccctgcctttgtccggggtctgctccaaatgccatggcagcctcttagagcatcaacccggcagtggggcagcatggtaggagggccaagagccctcgttggtggaactggagtgtgctggctggctttgccgccacattctccttcaccccagaagagacaatccgggagtcccaggcatgccttccacctccacacactcagtgcagtgccagtgatgtcctcctttgcatacttagtggttggtgtcctccctaatgcaaaccttggtgtgtgctcccagctcctgccctggcaatgcgccctgcatgtgcacacacctgccacttccaccacacacttgcaataccttctctctcccaagacgatctggggcgatgccctttgctgccgctgtctcttccttaatcccggagcccagctcctaaccccctctcccttcaactctttgccccatgaagtgtcaagcgccccaggaaccttgaagcttctctgctcttccattctggatgttttcaggaagatggaggagaagaaaacatcaagtctgtgaacttgatgttccttggatgtttaatcaagagagacaaaattgccgaggagctcggggctggattggcaggtgtgggctcccacgccctcctccctcggcgctgcagcttccggctgagccgcgccagctgcttctgcctgccccacccccaggctcgggacgatagccctgccctgcttgccccatctgcgcagtcagaatttgggggtgggttggttgtggggtagagcggctcttcggctcatgggacagtcagcaggagggagagcaggttctcgacacctgggaggaatgctttgcctcgtcctgtgtacttacctcaggcctctgcatgctctgcaatccttgtgccctggtgtgctgcctctgccaatgtgaagacacaataaagtgtatttttttatgaccaaaaaaaaaaaaaaaaaaaaaaaaaaaaaaaaaaaa

SEQ ID NO: 1360 - DNA, 1538 bp, Mus musculus
gtctggttgttaagactgcctggccaagtggatctcctgtactagccatcatttgatgtgatgtcggagtctaacagtactggcatcttgccaccagctgctcaggtccccttggcatttttaatgtcttcatttgcctttgctataatggtaggcaatgctgtggtcatcttagcctttgtggtggacagaaaccttagacatcgaagtaattatttttttcttaatttggctatttctgacttcctcgtgggtttgatttccattcctctgtacatccctcacgtgttgtttaactggaattttggaagtggaatctgcatgttttggctcattactgactatcttttgtgcaccgcatctgtctacaatattgtcctcattagctacgatcgataccagtcagtttcaaatgctgtgtcttatagggctcaacacactggcatcatgaagattgttgctcaaatggtggctgtttggatactggctttcttggtaaatggcccgatgattctggcttcagattcttggaagaacagcacgaacacaaaggactgtgagcctggctttgttacagagtggtacatcctcaccattacaatgctcttggaattcctgcttcctgtcatctctgtggcttatttcaatgtacagatttactggagcctgtggaagcgtagggctctcagtaggtgccctagccatgctggattctccactacctcttccagtgcttcaggacacttacacagagctggggtggcttgcaggacaagtaatcctggattgaaggaatcagctgcatctcgtcactcagaaagtcctcgaagaaagagcagcatcctggtgtccttaaggactcacatgaacagcagtatcactgccttcaaagtgggttccttctggcgatcggaaagtgcagcgcttcgccaaagggagtacgcagagcttctcagaggcaggaagctagccaggtcactggccatccttctgagcgcttttgccatttgctgggctccatactgtctgttcacaattgtcctttcaacttaccccagaacggaacgccccaaatcggtgtggtacagcattgccttctggctgcaatggttcaattcgtttgttaatccctttctgtaccctttgtgtcacaggcgtttccagaaggctttctggaagatactttgtgtgacaaagcaaccagcgctgtcacagaaccagtcagtatcttcttgaggagaattgcttcacgagtgccaactttagtttctgtcctctgaatggatctgagcttccatgttgctctatccactcaagcaaacagtgtacaaaatgtaatgtctgaaaactttaataaaacccctccacatgcaagtcagtggaacatgagtccacagtagtttaggaaacatgacagactgagagctgcaaaaatactaatattttcctcagggctctctgtctctttcctgatacaacatttattgtgctatgcctgatttctttcttgcactcagtgttttccccagtagtgttag

SEQ ID NO: 1361 - DNA, 2376 bp, Mus musculus
cgcgagggagatccccttgcatttctttttccctcccttccgcccaccccagcgggagtgcaggcaggcatggatatgttcagtcttggccagggcaacaacaccacaacgtccctggagcccttcgggacaggcggcaacgatactggcctctccaacgtgaccttcagctaccaagtgatcacctctcttttgctggggacgctcattttctgcgcggtgctcggcaatgcctgcgtggttgctgccatcgccctggagcgctcccttcagaatgttgccaactatctcatcggctccttggcggtcaccgatctcatggtgtcagtgctggtgctgcccatggctgctctgtaccaggtgctcaacaagtggactctgggtcaggtcacctgtgacctgtttatcgccctggatgtgctgtgctgcacttcgtccatcctgcacctgtgcgccatcgcgctagacaggtactgggcaatcaccgaccctatagactacgtgaacaagaggacgccccggcgcgccgctgcgctgatctcgctcacttggctcattggctttctcatctccatcccgcctatgctgggctggcgcgccccggaagaccgctcgaaccccaacgagtgcaccatcagcaaggaccacgggtacaccatctactccactttcggcgctttctatattccgctgctgctcatgctggtcctctatgggcgcatcttcagagccgcgcgcttccgaatccgcaagacggtcaagaaggtggaaaagaagggagcgggcaccagcttcggaacatcgtcggccccgccccccaagaagagcctgaatggtcagccaggtagtggggactgcaggcgcagtgctgagaacagggcggtggggactccgtgcgctaatggggcggtgagacagggtgaggacgacgccaccctggaggtgatcgaggtgcatcgagtgggcaactccaaaggggaccttcctctgcccagcgaatcaggagctacctcctatgtccccgcctgcttggagagaaaaaatgagcgcactgctgaggcaaagcgcaagatggccttggcccgtgagaggaagacagtgaagacactgggcatcatcatgggcaccttcatcctctgctggctgccctttttcattgtggcgctggtcctacctttctgtgagagcagttgccacatgcctgagttgttgggtgccataattaactggctaggctactccaactccctgctcaacccagttatttatgcttatttcaacaaagactttcaaaacgcttttaagaagatcatcaagtgcaagttctgccgctgatgatgatgatggtggtggtagtggtggtaatagtggtggtgatggagaaggaagaagtggaggaagagtgtagggcttacaggacccttcctgttcactcaatatccccgccctggaagcaacacctaagaaaacttgcttttcctagaacacgcagcttcttagcccatggctttcagatcttctctctctatctcattttaaggggacagtgctttttgcagaaatcttagagaacccctagcatctgtttgtaaaattattggctcggtctttggccctaggatcagttttgatagttgcaataacctcctctctattcgaaatcccaattcttcacgatggaagtttaaacctcggcgattcaaggaagaaaacccaaacagaaaatataaactgtatggacatctaccatgcccactaggactgccaccctctgccctatatctggaactttgaggttcaagactgctctgtctctccctccctccttcctctagaaacatctgttccctttgggtgtcaatgtacactgctgattctggtctccatgcactcacggctggtctgggaaagttggaactactttgggttatggtgccctggaattgtttgccttgctgaatagcaaaagatccctttccccaatgcacagcacccactttctgtattttgtttgtttgtttgttttaactcaaaatcaagtgacaaagatgtctgctggagtggacttataagcaagaagccaggcccaaaaggaagagccaagaaggcctgcggatgttttcctgtcctggtgtcagcactcaccaaagaaattgacaatcagactatttggaaggaagagttttattcctgtagtttgttggcttttctgtaagttctggaaaggccttgtggactgcagaaggcgcccactgctggccagggagggctcattgagggtgctgagatgcccgggatggctcacctcaccctcagtttcttttctaggagtgagctatgccagagcagctcaccttgagtttgcagccttcgggg

SEQ ID NO: 1362 - DNA, 1161 bp, Mus musculus
atggaggagcagggtattcagtgcgccccgccgcctcccgccgcctcccagacaggggtacctctcaccaacctctcccacaactgcagcgccgacggctacatttaccaggactccatcgccctgccctggaaagtcctgctggttgctttgttggcgctcatcaccttggccaccacgctctccaacgcctttgtaatcgctacggtgtatcggacccggaagctacacaccccggctaactacctgatcgcctctctggcagtcactgacctgctcgtgtccatcctggtgatgcccatcagcaccatgtacacggtcactggacgctggacactaggccaggtggtctgcgacttctggctgtcgtcggatatcacctgttgcactgcttccatcatgcatctctgtgtcatcgccctggaccgctactgggccatcaccgatgcggtggagtattctgctaaaaggactcccaaaagggcggccatcatgatcgtgctggtgtgggtcttctccatctctatttcgttgccacccttcttctggcgtcaagccaaagcagaggaggagatgctggactgctttgtgaacaccgaccacgtcctctacacggtctactccacggtgggcgctttctatttacccaccctgctcctcatcgccctctatggccgcatctatgtggaagcccgctctcggattttgaaacagacacccaacaagaccggcaagcgcttgacccgagcccagttgataacagactccccgggatccacatcctcggtcacctccattaactcccgggctccggacgtgcccagtgagtccgggtctcctgtgtacgtgaaccaagtcaaagtgcgagtctcagacgccctgctggaaaagaagaaactcatggccgctagggagcgcaaagccaccaagaccctagggatcattttaggagcatttattgtgtgttggctgcccttcttcatcatctccctggtgatgcctatctgtaaggatgcctgctggtttcacatggccatttttgacttcttcaattggttaggctatcttaactccctcatcaaccccatcatctacaccatgtccaatgaggacttcaaacaagcgttccacaaactgatacgctttaagtgcgcaggttga

SEQ ID NO: 1363 - DNA, 1125 bp, Mus musculus
atgtcgctgccaaaccagtccctagaaggccttcctcaggaggcctccaacagatccctgaatgcgacaggggcttgggacccagaggtcctgcaggctctcagaatctcgctcgtggtggtgctgtccgtcatcacactggccactgtcctctccaatgcctttgtccttaccaccattctactcaccaagaagctccacaccccagccaattatctcattggctccttggccaccacggacctcctggtttctatcttggtcatgcccatcagcatagcctacaccaccacccgcacctggaactttggccagatcctgtgtgacatctgggtgtcttctgacatcacgtgctgcacggcctccatcttgcatctctgtgtcattgctctggacagatactgggccatcaccgatgccctggagtacagcaagcgtcgaaccgcaggccacgcagcagccatgattgcggccgtctggatcatctctatttgtatctccatccctccgctcttctggcggcaggccacggctcacgaggagatgtccgactgcctggtgaacacatctcagatttcttacaccatctactcgacctgtggcgccttctatatcccatccatcttgctcattatcctgtatggccgcatatacgtggccgcccggagtcgaatcctgaacccaccctccctctacgggaagcgcttcaccacggcacagcttatcacaggctctgctggctcttcgctctgctcgctcaaccccagcctccacgagagccacacacacacagttggctcccctctctttttcaaccaggtgaaaatcaagcttgctgatagcatcctagaacgcaagaggatctctgcagcccgagaaaggaaagccactaagaccctgggcatcattctgggggcctttatcatctgctggttgcctttctttgtagtatcgttggtcctccccatctgcagggactcctgttggatccacccggccctctttgacttcttcacgtggctaggttatttaaactctctcattaaccccgtcatctacactgtgttcaacgaagactttcgacaagcgtttcagaaagtcgtccatttccgaaaggcctcttag

SEQ ID NO: 1364 - DNA, 1101 bp, Mus musculus
atggattttttaaacgcatcagaccaaaacttgacctctgaggaactgttaaaccgaatgccatccaaaattctggtatccctcactctgtctgggctggcattgatgacaaccaccatcaactccctcgtgatcgctgcgatcattgtgactcggaagctgcaccacccagccaactatttaatttgttccttggcagttacagattttcttgtagctgtcctggtgatgcccttcagtattgtgtacattgtgagagagagctggattatgggacaagtactctgtgacatttggctgagtgtcgacatcatctgttgtacgtgttccatcttgcatctgtcggctatagccttggataggtaccgcgccatcacagatgcagttgaatacgccaggaagaggactcccaggcatgccggcatcatgatcacgatcgtgtgggttatatctgtgttcatctctatgcctcctctcttctggaggcaccaaggaactagccgtgatgatgagtgtgtcatcaaacatgaccacattgtttccacaatttactccacgtttggagctttctacatcccgcttgtattgatattgatcctctactacaaaatatacagagcagcaaggacactgtaccacaagagacaagcgagtcggatgataaaggaggagctgaacggtcaagtcttcttggagagcggtgagaagagcattaaactggtctccacatcctacatgttagaaaaatccttgtccgatccatcaacggactttgatagaattcacagcaccgtgaaaagtcccagatcggaactgaagcatgagaaatcttggagaagacagaaaatctcaggcaccagagaacgcaaagcagccactaccctgggattgatcttgggtgcatttgtaatatgttggctgcccttttttgtaaaagaattggttgttaatgtctgtgaaaaatgtaaaatttctgaagaaatgtcaaactttttggcatggcttggttacctgaattcccttataaatccactgatttataccatctttaatgaagacttcaagaaagctttccaaaaacttgtacgatgccgatattag

SEQ ID NO: 1365 - DNA, 1416 bp, Mus musculus
atggaaattctctgtgaagacaatatctccctgagctcaattccaaactccttaatgcaattaggtgacgactcgaggctctaccctaatgacttcaactccagggatgctaacacttccgaagcctcgaactggacaattgatgctgaaaacagaaccaacctctcctgcgaagggtacctcccaccgacatgcctctccattcttcatctccaggaaaaaaactggtctgctttattgacaactgtcgtgattattctcaccattgcgggaaacatactggtcatcatggcagtgtccctagagaaaaagctgcagaatgccaccaactatttcctgatgtcacttgccatagctgatatgctgctgggtttccttgtcatgcccgtgtccatgttaaccatcctgtatgggtaccggtggcctttgcccagcaagctctgtgccgtctggatttacctggatgtgctcttctccacggcatccatcatgcacctctgcgccatctccctggaccgctacgtggctatccagaaccccattcaccatagccgcttcaactccagaaccaaagccttcctgaaaatcattgcagtgtggaccatatccgtaggtatatccatgccaatcccagtcttcgggctacaggatgattcgaaggtctttaaggaagggagctgcctgctcgccgatgacaactttgttctcataggctcttttgtggcatttttcatccccctaaccatcatggtgatcacctacttcctgactatcaagtcacttcagaaagaagccaccttgtgtgtgagtgacctcagcactcgggccaaattatcctccttcagcttcctccctcagagttctctgtcatcagaaaagctcttccaacggtccatccacagagagccaggctcctacgcaggccgaaggacgatgcagtccatcagcaatgagcaaaaagcatgcaaggtgctgggcatcgtgttctttctgtttgttgtaatgtggtgcccattcttcatcaccaatatcatggccgtcatctgcaaagaatcctgcaatgaaaatgtcattggagccctgctcaatgtgtttgtctggattggttatctctcctcagccgtcaacccactggtatatacgttgttcaataaaacttataggtccgccttctcacggtacattcagtgccagtacaaggagaacagaaagccactgcagttaattttagtgaacactataccaacattggcctacaagtctagtcagctccaggtgggacaaaaaaagaactcacaggaagatgctgagccgacagctaatgactgctccatggttacactagggaaccaacactcggaagagatgtgtacagacaatattgaaaccgtgaatgaaaaggttagctgtgtgtga

SEQ ID NO: 1366 - DNA, 1515 bp, Mus musculus
atggcttcatcttataaaatgtctgaacaaagcacaacttctgagcacattttacagaagacatgtgatcacctgatcctgactaaccgttctggattagagacagactcagtagcagaggaaatgaagcagactgtggagggacaggggcatacagtgcactgggcagctctcctgatactcgcggtgataatacccaccattggtgggaacatccttgtgattctggctgttgcactggagaaaaggctgcagtacgctaccaactactttttaatgtccttggcgatagcagatttgctggttggattgtttgtgatgccgattgccctcttgacaatcatgtttgaggctatatggcccctcccactggccctgtgtcctgcctggttattcctcgatgttctcttttcaactgcctccatcatgcatctctgtgccatttccctggaccgctatatagccatcaaaaagccaattcaggccaatcagtgcaacacccgggctactgcattcatcaagattacagtggtatggttaatttcaataggcatcgccatcccagtccctattaaaggaatcgagactgatgtgattaatccacacaatgtcacctgtgagctgacaaaggaccgctttggcagttttatggtctttgggtcactggctgctttcttcgtacctctcaccatcatggtagtcacttactttctcaccattcacactttacagaagaaagcttacttggtcaaaaataagccacctcaacgcctaacacggtggactgtgcccacagttttcctaagggaagactcatccttttcatcaccagaaaaggtggcaatgctggatgggtctcacagggataaaattctacctaactcaagtgatgagacacttatgcgaagaatgtcctcagttggaaaaagatcagcccaaaccatttctaatgagcagagagcctcgaaggcccttggagtcgtgtttttcctttttctgcttatgtggtgccccttttttattacaaatctaactttagctctgtgtgattcctgcaatcagaccactctcaaaacactcctggagatatttgtgtggataggctacgtttcctcgggggtgaatcctctgatctatacactcttcaataagacatttcgggaagcatttggcaggtacatcacctgcaattaccgagccacaaagtcagtaaaagcacttaggaagttttccagtacactttgttttgggaattcaatggtagaaaactctaaatttttcacaaaacatggaattcgaaatgggatcaaccctgccatgtaccagagcccaatgaggctccgatgttcaaccattcagtcctcatcaatcatcctcctcgatacccttctcactgaaaacgatggcgacaaagcggaagagcaggtcagctacatattgcaggaacgggccggcctcatcttgagagagggtgatgagcaggacgcacgcgcaccatggcaggttcaagagtga

SEQ ID NO: 1367 - DNA, 1380 bp, Mus musculus
atggtgaacctgggcactgcggtgcgctcactccttgtgcacctaattggcctattggtttggcagttcgatatttccataagtccagtagcagctatagtaactgacacttttaattcctccgatggtggacgcttgtttcaattcccggacggggtacaaaactggccagcactttcaatagtcgtgattataatcatgacaatagggggcaacattctcgttatcatggcagtaagcatggagaagaaactgcacaatgctaccaattatttcttaatgtccctagccattgctgatatgctggtgggactacttgtcatgcccctgtctctgcttgcaattctttatgattatgtctggcctttacctagatatttgtgccccgtctggatttcactagatgtgctattttcaactgcgtccatcatgcacctctgcgccatatcgctggaccggtatgtagcagtgcgtagtcctgttgagcatagccggttcaattcgcggactaaggccatcatgaagattgccatcgtttgggcaatatcaataggagtttcagttcctatccctgtgattggactgagggacgaaagcaaagtgttcgtgaataatactacctgcgtgctcaatgacccgaacttcgttctcatcgggtccttcgtggcattcttcatcccgttgacaattatggtgatcacctacttcttaacgatctacgtcctacgccgtcaaaccctgatgttacttcgaggtcacaccgaggaggaactgcgtaatatcagcctgaactttctaaagtgctgctgcaagaagggtgatgaggaagagaacgctcccaaccccaatccagatcagaagccacgtcgaaagaagaaagaaaagcggcctagaggcaccatgcaagctatcaacaatgagaagaaagcttccaaagtccttggcattgtattctttgtgtttctgatcatgtggtgcccgtttttcatcaccaatatcctgtcggtgctttgtgggaaggcctgtaaccaaaagctaatggagaaacttctcaatgtgtttgtttggattggctatgtgtgttcaggcatcaatcctctggtgtacactctcttcaacaaaatttaccgaagggctttctctaaatatttgcgctgcgattataagccagacaaaaagcctcctgttcgacagattcctagggttgctgccactgctttgtctgggagggagctcaatgttaacatttatcggcataccaatgaacgtgtagttaggaaagctaatgacacagagcctggcatagagatgcaggtagagaatttagagctgccggtcaatccctctaatgtggtcagcgagaggattagtagtgtgtaa

SEQ ID NO: 1368 - DNA, 1167 bp, Mus musculus
atggacaaacttgatgctaatgtgagttccaacgagggtttcaggtccgtggagaaggtcgtgctgctcacgttccttgcagtggttatcctgatggccatcttgggcaacctgctggtgatggtggctgtgtgcagggacaggcagctcaggaaaataaaaaccaactatttcattgtgtctctcgcctttgctgacctgctggtttcggtgctggtgatgccctttggtgccattgagctggtccaagacatctgggcttatggggagatgttctgcctggtccggacctctctggatgtcctactcaccacagcatcgatctttcacctgtgctgtatttccctggacaggtattacgccatctgctgccagcctttggtttataggaacaagatgacccctctacgcatcgcattaatgttgggaggctgctgggtccttcccatgtttatatcttttctccccataatgcaaggctggaacaacatcggcatagttgatgtgatagagaaaaggaaattcagccacaactctaactccacgtggtgtgtcttcatggtcaacaagccctatgctatcacctgctctgtggtggccttctacatcccgtttctcctcatggtgctggcctattaccgaatctatgtcactgctaaggagcatgcccagcagatacagatgttacaacgggcaggagccacctctgaaagcaggccccagccagctgaccagcacagcacacatcgcatgaggacagagaccaaggcagccaagactttatgtgtcatcatgggctgcttctgtttctgctgggcccccttctttgtcaccaatattgtggaccctttcatagactacactgtccccgagcaggtgtggactgctttcctctggcttggctatatcaattcggggttgaacccttttctctatgccttcttgaataagtctttcagacgtgccttcctcatcatcctctgctgtgatgatgagcgctacaaaagaccccccattctgggccagactgtcccctgttcaaccacaaccattaatggatccacccatgtactaagggatgcagtggaatgtggtggccagtgggagagtcggtgtcacctcacagcaacttctcctttggtggctgctcagcccagtgatacttag

SEQ ID NO: 1369 - DNA, 1074 bp, Mus musculus
atggatctgcctgtaaacttgacctccttttctctctctactccctcctctttggaacctaaccgcagcttggacacggaagtcctgcgccctagtcggccttttctctcagctttccgagtgctagtcctgactttgttgggctttctagctgcggccacattcacttggaacctgctggtgctggctaccatcctcaaggtacgcaccttccaccgagtaccacacaacctggtagcttccatggccatctcggatgtgctagtggctgtgctggttatgccactgagcctggtacatgagctgtctgggcgccgctggcagctgggccggcgtctatgccagctgtggatcgcatgtgacgtgctctgctgtactgccagcatctggaatgtgacagcaatagcactggaccgctactggtcaatcacgcgccacctggagtacacactccgtacccgcaagcgtgtctccaatgtgatgatcctgctcacctgggcactctccactgtcatctctctggctccactgctatttggctggggagagacttattctgagcccagtgaggaatgccaagtcagtcgcgagccttcctacaccgtgttctccaccgtgggtgccttctacctgccgctgtggctggtgctctttgtgtactggaaaatttacagggcggcgaaattccgcatgggctccaggaagactaacagcgtctcccccgtacccgaagctgtggaggtgaagaatgctacacaacatccccagatggtgttcacggcccgccatgccaccgtcaccttccagacagaaggggatacgtggagggagcagaaggagcaaagggcagccctcatggtgggcatcctcatcggagtgtttgtgctctgctggttccctttcttcgtcacagagctcatcagtcccctgtgttcctgggacgtccctgccatctggaagagcatcttcctgtggttgggctattctaattccttcttcaacccactcatctacacagcattcaacaggagctacagcagtgctttcaaggtcttcttctccaagcaacaatga

SEQ ID NO: 1370 - DNA, 1362 bp, Mus musculus
cctgtcctggtcctcaaccctagtccccatggttccagagcccggccctgtcaacagtagcaccccagcctggggccccgggccaccgccagccccagggggcagcggctgggtggccgctgcgctgtgcgtggtcatcgtactgacggcagccgccaattcgctgctgatcgcgctcatctgcacgcagcccgcgctgcgcaacacgtctaacttcttcctggtgtcgctcttcacgtcggacctgatggtgggattggtggtgatgcccccagccatgctgaacgcgctgtatgggcgctgggtgctagctcgcggcctctgtctgctttggaccgccttcgacgtgatgtgctgcagcgcctccattctcaacctctgcctcatcagcctggaccgctacctgctcatcctctcgccgctgcgctacaagctgcgcatgacagccccgcgtgccctggcgctcatcctgggtgcctggagcctcgccgcgctggcctccttcctgcccctcttgctgggctggcatgaactgggcaaagctcgaacatctgccccgggccagtgccgcctattggccagcctgccttatgtcctcgtggcgtccggcgtcacctttttcctgccttcgggtgccatctgcttcacctactgcaggatcttgctggctgcccgcaagcaggcggtgcaagtggcctcgctcaccacgggcacggctacggctggccaggccttggaaaccttgcaggtgcccaggacaccacgcccagggatggagtctgctgacagtaggcgtctgaccaccaagcatagcaggaaggccttgaaggccagcctgaccctcggcatcctgctgagcatgttctttgtcacctggctgcccttctttgtggccagcatagctcaggccgtatgtgactgcatctctccaggtctcttcgatgtcctcacatggctgggatactgtaatagcaccatgaaccctatcatctatcccctcttcatgcgggacttcaagagggccctgggcaggttcgtgccgtgtgtccactgtcccccggagcaccgggccagccccgcctccccctccatgtggacctctcacagtggtgccaggccaggcctcagcctgcagcaggtgctgcccctgcctctgccacccaactcagattcagactcagcttcagggggcacctcgggcctgcagctcacagcccagcttttgctgcctggagaggcgacccgggaccccccgccacccaccagggcccctactgtggtcaacttcttcgtcacagactctgtggagcctgagatacggcagcatccacttggttcccccatgaactgaccaggtcaaga

SEQ ID NO: 1371 - DNA, 1347 bp, Mus musculus
atgatggacgttaacagcagcggccgccccgacctctacggccatctccgctctctcatcctgccggaggtggggcgcaggctgcaggacctgagccccgacggtggcgcccactcggtggtgagctcctggatgccgcacctgctgagcggcttcccagaggtgacagctagcccggcgcccacctgggacgcgcccccggacaatgtctccggctgcggggagcagatcaactatggcagagtcgagaaagttgtgatcggctccatcctgacgctcatcacgctgctgacgatcgcgggcaactgcctggtggtgatctcggtgtgctttgtcaagaacgtccgccagccctccaactacctgattgtgtccctggcgctggctgacctctcggtggccgtggcggtcatgcctttcgttagtgtcacggacctcatcgggggcaagtggatcttcggccacttcttctgcaacgtcttcatcgccatggacgtcatgtgctgcacggcctcgatcatgaccctgtgcgtgatcagcatcgacaggtaccttgggatcaccaggcccctcacgtaccccgtgaggcagaatgggaaatgtatggccaaaatgattctgtcggtctggcctctctctgcctccatcaccttacctcctctcttcggatgggctcagaatgtgaacgatgacaaagtgtgcttgatcagccaggattttggctacacgatctactccaccgcagtggcgttttatatccccatgtcggtcatgctgttcatgtactatcagatttacaaggccgccaggaagagcgcagccaaacacaagttctcaggcttcccacgcgtgcagccggagagcgtcatctccctgaatggcgtggtgaaactccagaaggaggtggaagagtgtgcgaacctttcgagactgctcaaacacgaaaggaaaaacatttccagcttcaagagggaacagaaagcagccactaccttggggatcatcgtgggagccttcacggtgtgctggctgccgtttttcctcttgtccacagcaaggccctttatctgtggcacctcctgtagctgcatcccgctgtgggtggagaggacatgtctgtggctgggctatgcaaactctctcattaacccttttatatattccttcttcaaccgggacctgaggaccacctatcgtagcctactccagtgccagtaccggaatatcaaccggaagctctctgctgcaggcatgcacgaagccctgaaacttgctgagaggcctgagagaagcgagtttgtgctacaaaactgtgaccactgtgggaaaaaaggtcatgatacatga

SEQ ID NO: 1372 - DNA, 1371 bp, Mus musculus
atggaggagcaggcgcggccgcctggccgcccggccgcgagtgcaaccttgcagggtagcgcgcatccgggaggggcggcttccacggccactgcagccgcgctgtcgttcagctccgtagccacggtaacgctgggaaaccaaagcgatgcgggcaggccggaggcagcggggtctcggggacccgcaccgctgctatggcacggggcagcggtggccgcccaggcgctcgtgctcctgctcatcttcttgctgtctagcctgggcaactgcgcggtgatgggggtgatcgtgaagcatcggcagctgcgcacggtcacaaacgccttcatcctgtcgctgtccctgtcggacctgctcactgcgctgctctgcctacccgccgccttcctcgatctattcgcgcctcccggagactctgggccctggcgcagcttctgcgcagccagccgcttcttcagttcgtgtttcggaatcgtatccacgttcagcgtggcgctcatctcgctggaccgctactgcgccatcgtgcggccgccgcgggacaagctgggccggcggcgcgcgctgcagctgctggcaggagcgtggttggctgcgctgggcttctccctgccctgggacctgctcagggcaccccgggagccccccgctccgcagagcttccaccgctgcctttacagaacctccccagaccctgcgcagctgggcgtcgcctacagcgtgggactggtggtggcttgctacttgctgcccttcctactgatgtgtttctgccgctaccacatctgcaagaccgtgcgcctgtcggacgtgcgcgtgcggccgatgaccacttacgcgcgcgtgctgcgcttcttcagcgaggtgcgcacagccaccaccgtgctcatcatgattatctttgtcatgtgctgctggggtccctactgcttcctggtgctgctggccgcgacccggcagggtcaggccacgcaggctccctcgctgctcaatgtggcggctgtttggctgacctgggccaatggggctatcaacccggtcatatatgccatccgcaaccccaacatttccatgctcctaggacgcaaccgcgaagaagggtacaggactagaaacatggatgcttttttgcctagccaaggcctaggttttcaagccagaagtcgcaatcgccttcgaaatggctgtgccaacaggcttggggcttgcagcaggatgccttcttccaacccagctagtgggtcaggaggggaagtggtcatgtgggctcgaaaaaatccagttgtgctcttcttccgagagggtccaccggactcagttatggaagtcggcaaactgcataattctgaaaccagggacagcagcatt

SEQ ID NO: 1373 - DNA, 1056 bp, Mus musculus
atggccgaggctgaatatttcatctggactaatcctgagggtgactttgagaaagaatttggaaatatcacgggaatgctgcccactggagattatttcatcccctgtaagagagttccaataaccaacaggcaggctttagttgtcttttatgcactggtgtcccttctgagcttgctgggaaactcgctggtgatgctggttatcttatacaggcgaaggacccgatccgtcatggatgtctacgtgctgaacctagccatcgccgacctactcttttcattgaccctgcccttcttggctgtctccaaattgaagggctggatttttggcacacccctgtgcaagatggtctcactcctgaaggaattcaacttcttcagtggtatcctgctgctggcctgcatcagtgtggaccgatacctggccatcgtccatgccacccgtacgctggcccgaaagcgctacttggttaaattcgtgtgcgtgggcatctggggtctatctttgattctgtctctgccttttgctatcttccgccaggcatataaaccattccgttctggtacagtctgctatgaagtcctgggtgaagccacaacagattttcggatgaccttgcggggtctgtcccacatatttggcttcctcctgccgctgctcactatgctggtctgctacgggctcacactgcgcatgctctttaagacccacatgaggcagaaacaccgggccatgggggtgatctttgctgttgtgttggtcttcttgctctgttgtctgccctacaatctggttctgctctcagacactctcttaggagcccacttgattgaagatacttgcgaacgccgcaatgacattgaccaggccctgtatattactgagatcctgggcttttctcatagttgtcttaaccctatcatctatgccttcgttggccaaaattttcgccatgaattcctcaagatccttgctaaccatggcctggttcgcaaggaggttttgacacaccgccgtgttgcctttcatacgtctctcaccgctatttattaa

SEQ ID NO: 1374 - DNA, 1080 bp, Mus musculus
atgggagaattcaaggtggataagttcaacattgaagatttcttcagtggagatcttgatattttcaattatagctctggcatgccctctattctgccagatgctgtcccatgccactcagagaacctggaaatcaacagttatgctgtggttgtaatatacgtcctggtgactctgctgagccttgtggggaactccttggtgatgctggtcatcttatacaaccggagcacctgctctgtcaccgatgtctacctgctgaacctggccattgctgacctgttctttgccctgaccttgcctgtctgggctgcatctaaagtaaatggatggacttttggctcaaccctgtgcaagatattctcatacgtgaaggaggttaccttctacagcagtgttctgctactagcctgcatcagcatggaccgctacctggccattgtacatgccacaagtacactgatccagaagagacacttggtcaagtttgtgtgcatagccatgtggttactatcagtaattctggccctgcccatcttaattctacgaaatcctgttaaggtaaacctttctaccttagtctgctatgaggatgtaggtaacaatacatcccgtttgagggtcgtactgcgtatcctgcctcagacttttggcttcctcgtgccgctgctcatcatgctgttctgctacgggttcacactgcgcaccctctttaaggcccacatggggcagaagcaccgggccatgcgggtcatcttcgctgtcgtccttgtcttcctgctctgctggctgccctacaacctggttctgttcacagacaccctcatgagaaccaagctgatcaaggagacctgtgagcgccgcgatgacattgacaaggccttgaatgctacggagattcttggcttcctccacagctgccttaaccccatcatctatgcctttattggccagaaatttcgccatggacttctcaagatcatggctacttatggccttgtcagcaaggagttcttagccaaggagggaaggccttcttttgttagctcgtcttcagcaaacacctctactaccctctaa

SEQ ID NO: 1375 - DNA, 2539 bp, Mus musculus
cggactccccagtgacaagcgtcggtgtcccttcgtgccaaggaggtttcagctgagcatgctcagacacatgggaggcaccagactatcaaaactccttctgagaagcaaggacacgtctacgaactcaatgctgcaaatctacagctctttcctctgacaccggacacctctcgagcgcacaccggccgcaatgtggctcctacttcatgtcatccttctgacagaggtcaaagattttgcactggctgacagcagtatggtggctcctctgtgccccaaagggtattttccctgtgggaatctcaccaaatgcttgccccgagcctttcactgcgatggtgtggatgattgcgggaatggtgccgacgaggacaactgtggtgacactagtggatggacaaccatatttggcacagtccatgggaatgtcaataaagtgacattgacacaggagtgctttctcagccagtatccacagcactgttactgcagagaaaatgaactggaatgtgtaaaggctgacttaaaagctgtgccaaaggtttccagcaacgtaacattactatctcttaagaaaaacaaaatccacagacttccagtcaaggtcttcagcagatacacagaactcagaaagatataccttcagcacaactgcatcacacacatctccaggagagcattccttggattacataatctacaaatactgtatctcagccataactgcattacctctctcaggcctgggatattcaaagacttgcatcagcttgcttggctaattttagatgacaacccgatcaccagaatctcacagaagtcctttatggggttaaactccttgtttttcttgcccatggtgggtaaccggctcgaggcccttcctgaaacattgtgtgctcagatgcctcaactcaactgggtggatctggcaaacaatggaataaagtacataacgaactccaccttcctaacgtgcgactcgctcacggttctgtttctgcctagaaatcaaattggttttgttccagagaagacattttcttcattaaaaaatttaggagaactggacctgtctagcaatatgataacaaaactcccagtccaccttttcagcgaccttcatcttctccagaagctgaacctgtcatccaaccctcttctgtatgtccacaagaaccagtttggaagtctcaaacaacttcagtctctagacctggaaaggatagagattccaaacataagcacaggaatgttccagccaatgaagaacctttctcacatttatttgaaaacctttcgatactgctcctatgtcccccatgtccgaatctgtatgccgtcgactgatggtatttcttcgtctgaggacctcttggctaacggtatcctcagagtgtctgtctgggttatagctttcattacctgcgttgggaatttccttgtcatagccgtgagatctctcattaaggctgagaatacaactcacgctatgtccatcaaaatcctttgttgtgccgattgcctgatgggggtgtacctgttctccgtgggcgtctttgacatcaagtaccgagggcagtatcagaagtatgcgctgctgtggatggagagtgtgccctgccgcctgctgggcttcctggccacgctgtccacagaggtctcggtgctgctgctgacattcctgacgctggagaagttccttgtcatagtattccctttcagcaacctgcgcctgggcaagcgccagactgctgtggccctcgccagcatctgggtggtgggatttctcatagcggccgttccgttcaccagagaggattatttcggcaacttttatgggaaaaatggagtctgcttcccacttcattatgaccaagcagaagattttggaagtagagggtactcccttgggattttcctaggtgtgaacttgctggctttcctcgtcatcgtgatttcctatgtcaccatgttctgctccattcataaaacagcccttcagactgcagaagtgaggagccacatcgggaaggaggtggctgttgcaaaccggttcttttttatcgtgttctctgatgccatctgctggatccctgtgtttgtcgttaagatcctgtctctccttcaagtggagataccaggcacaatcacttcctggatcgtggtttttttccttccggtgaacagcgccttaaaccccatcctctacactctgacgacctccttttttaaggacaagttgaaacagttgctgcacaaacatcggaggaaacccatcttcaaagttaagaagaaaagtttatccgcttccattgtgtggacagacgagtcttcacttaaacttggagtgttgagcaaaatagcccttggggacagtataatgaagccggtctccccgtagaggctttggattgctggactttgagggtactacctaaaacaaggtacaatttggggaagatggcatctgagaaggtttccatcttggccagcagccacccactcagcaccagggacacaatggaatggctgt

SEQ ID NO: 1376 - DNA, 2103 bp, Mus musculus
atggggcggcgggtcccggctctgagacagctgctggtgctggcaatgctggtgctgaagcagtcacagctgcactctccagagttgtcagggtcgcgctgccctgagccctgcgactgcgcgccggatggtgccctgcgctgccctggccctcgagctggcctcgcccgactatctctcacctatctccctgtcaaagtaatcccatcacaagctttcaggggacttaatgaggtcgtaaaaattgaaatctctcagagtgattccctggaaaggatagaagctaatgcctttgacaacctcctcaatctgtctgaaatactgatccagaacaccaaaaacctgctatacattgaacccggtgcttttacaaacctccctcggttaaaatacctgagcatctgtaacacaggcatccggaccctcccagatgtttcgaagatctcttcctctgaatttaatttcattctggaaatctgtgataacttatacataaccaccataccagggaacgctttccaagggatgaataatgagtccatcacgctgaaactgtatggaaatgggtttgaagaagtacaaagccatgcattcaatgggacgacgctaatctcgctggagttaaaagaaaacatctacctggagaagatgcacagtggcaccttccagggggccacggggcccagcatcctggatgtctcttccaccaaattgcaggccctgccgagccacgggctggagtccattcagacgctcatcgccacgtcatcctactcactgaaaactctgccctccagagaaaaattcaccagcctactggttgccacgctgacctaccctagccactgctgtgctttcaggaatttgccgaagaaagaacagaatttttcattttccatttttgaaaacttttccaaacaatgtgaaagcacagttagagaagcgaataacgagacgctttattctgccatctttgaggagaatgaactcagtggctgggattacgattatgacttctgttcacccaagacactccaatgtactccagaaccagatgctttcaatccctgtgaagatattatgggctatgccttccttagggtgttgatttggctaattaatatactagccatctttggcaacttgacagtcctctttgttctcctgaccagtcgttataaactgacggtgccccgcttcctcatgtgtaatctctcctttgcagacttttgcatggggctctacctgctgctcattgcctcagtggactcccaaacaaaaggccagtactataaccatgccatagactggcagacagggagtggctgcagtgcagctggcttctttactgtgttcgccagtgaactttctgtctatacccttacagtcatcactctggaaaggtggcacaccatcacctatgctgttcagctggaccaaaagctgaggctgagacatgccatcccaattatgctcggaggatggattttttctaccctgatggccacattgccccttgtgggtgtcagcagttacatgaaagtcagcatctgcctccccatggatgtggaatccactctgtcacaagtctacatattatccatcttgctcctcaatgcagtggcctttgtcgtcatctgtgcttgctacgttaggatatactttgcagttcaaaatccagagctgacggctcctaacaaggacacaaaaattgctaagaagatggccatcctcatcttcacagacttcacatgcatggcacccatctcattctttgccatctcagctgccttcaaagtaccccttatcactgtcaccaactcaaaagttctgctggtccttttttatcctgtcaattcttgtgccaacccatttctgtacgcagtgttcacgaaggcatttcagagagatttctttctcttgctgagcagatttggttgctgtaagcaccgggctgaactttacagaaggaaggaattttctgcatgtaccttcaactccaaaaacggctttccaagatcaagtaagccttcccaggctgccctgaagttatccatagtgcactgtcaacaacctacacctccaagagtgttaattcagtaa

SEQ ID NO: 1377 - DNA, 1056 bp, Mus musculus
atggctgcaaacactacatctcctgcagcaccttcttctcctggtggcatgtccctgtctctgttgcccattgttctactgtctgtggccctggctgtggggcttcctggcaatagctttgtagtgtggagcatcctgaaaaggatgcagaaacgcacggtcaccgccctgctggtgctgaacttggccctggccgacttggctgtgttgctcactgctccctttttcctccactttctggctcgaggcacctggagttttagagagatgggttgccgcctgtgccactatgtctgtggaataagcatgtatgccagtgtcctgcttataaccatcatgagtctggaccgatcactggcagtggcccgcccctttatgtcccaaaaggttcgtactaaggcctttgcccgatgggtgctggcaggcatctgggtggtgtcttttctgctggccataccggtccttgtgtaccgtacagtaaaatggaacaacaggactctgatctgcgctccgaactatcccaacaaagagcataaagtcttccatctgctcttcgaagccatcacgggcttcctgctgcccttcctagcggtggtggccagctactctgacatcgggcgcaggctgcaggctcggcgcttccgccgtagtcgccgcaccggccgcctggtggtgctcattatcctggccttcgccgccttctggctgccttaccacctggtgaacctggtggaagccggccgcacagtggccggctgggacaagaacagccctgcggggcagcgtctgaggctggcccgctatgtgctcatcgcgctggccttcctgagcagcagcgtgaacccggtgctgtacgcgtgcgcgggcggcggcctgctgcgttcggcgggcgtgggcttcgtggtcaagctactggagggcactggctcggaggtgtccagcacccgccgcgggggcactctggtccagaccccgaaggacacacctgcctgtcctgagcctggccccaccgacagcttcatgacttcctccaccattcctgagtcttcgaagtga

SEQ ID NO: 1378 - DNA, 1083 bp, Mus musculus
atgtctgtctgctaccgtccgcctgggaatgagacactactgagctggaagggctcgcgggccaccggcactgcttttctactgctggcggcgttgctgggactgccaggcaatggcttcgtagtatggagcttagcgggctggcggcccacggcgggccggccactggcggccacacttgtgctgcacctggccctggccgacggcgcggtgctgctgctcacgccgctctttgtggctttcctcagccaagaggcttggcccttgggccaggtgggctgcaaggcggtgtactacgtgtgcgcgctcagcatgtacgccagcgtgctgctcaccggcctgctcagcctgcagcgctgcctggctgtcactcggcccttcctggctccccgactgcgcagcccggccctggcccgccgcttgctgctgggggtctggctggccgccctggtgctcgccgtcccggccgcggtctaccgccacctctggggcgggcgcgtgtgtcagctgtgccacccatcgccagtgcacgcagctgctcatctgagcctggagaccctgactgccttcgtcttgccttttgggaccgtgctcggctgctatggcgtgacgctggcgcggttgcgaggagcgcgctggggctcggggcgacaaggcacacgggtgggtcgtctggtgagcgccatcgtgctggcctttggcttgctctgggctccctaccacgcggtcaatctcctacaggcggtggccgcgctcgctccgccggaaggacccctggccaggctcggcggggcgggccaggcggcgcgcgctggaactacagccttggctttcttcagttccagcgtcaacccagtgctctatgtcttcactgcgggggatttgctgccgcgggccgggcctcggttccttactcgactcttcgagggctctggggaggcccgagggggcagccgctctagggagggtaccatggaactccgaactactcctaagctgaaagtaatggggcagggcaggggcaatggagaccctggaggcggagatgggggcaagacggagaaagacagtcaagaatggtag

SEQ ID NO: 1379 - DNA, 975 bp, Mus musculus
atggaccagtcaaatatgacatcccttgctgaagagaaagccatgaatacctccagcagaaatgcctccctggggagctcacacccacccattcccatagtgcactgggtcatcatgagcatctcccctctgggctttgtggagaatgggatcctcctctggttcctctgcttccggatgaggagaaatcctttcacggtctacattacccacttgtccatggctgatatctctcttctgttctgtatttttatcctgtccattgactatgctttagactatgaactctcttctggccatcactacacaatcgtgacattatcggtgacttttctatttggctacaacacgggcctctatctgctgacagccatcagtgtggagaggtgcctatcggtcctctaccctatatggtacactagccaccgccccaagcaccagtcagcattcgtctgtgcccttctgtgtgcactttcgtgcttggtgaccaccatggagtatgtcatgtgtattgacagcggagaagagagtcattctcggagtgactgccgggcggtcatcatcttcatagccatcctcagcttcttggtcttcactccgctcatgttagtgtccagctccatcttggtggtgaagatacggaagaacacgtgggcctcccattcttcgaagctgtacattgtcatcatggtcaccattatcatattcctcatctttgccatgcccatgcgggtcctctacttgctgtactacgagtactggtcagcctttgggaacctgcataacatctccttgcttttctccaccatcaacagcagcgccaaccctttcatctacttttttgtgggcagcagtaagaagaagcgcttcagggagtccttaaaagtcgtcctgaccagggctttcaaagatgaaatgcaacccaggcgccaggagggcaacggcaacactgtatccattgagactgtggtctga

SEQ ID NO: 1380 - DNA, 948 bp, Mus musculus
atgtccactcaggagccccagaagagtcttctgggttctctcaactccaatgccacctctcaccttggactggccaccaaccagtcagagccttggtgcctgtatgtgtccatcccagatggcctcttcctcagcctagggctggtgagtctggtggagaatgtgctggttgtgatagccatcaccaaaaaccgcaacctgcactcgcccatgtattacttcatctgctgcctggccctgtctgacctgatggtaagtgtcagcatcgtgctggagactactatcatcctgctgctggaggtgggcatcctggtggccagagtggctttggtgcagcagctggacaacctcattgacgtgctcatctgtggctccatggtgtccagtctctgcttcctgggcatcattgctatagaccgctacatctccatcttctatgcgctgcgttatcacagcatcgtgacgctgcccagagcacgacgggctgtcgtgggcatctggatggtcagcatcgtctccagcaccctctttatcacctactacaagcacacagccgttctgctctgcctcgtcactttctttctagccatgctggcactcatggcgattctgtatgcccacatgttcacgagagcgtgccagcacgtccagggcattgcccagctccacaaaaggcggcggtccatccgccaaggcttctgcctcaagggtgctgccacccttactatccttctggggattttcttcctgtgctggggccccttcttcctgcatctcttgctcatcgtcctctgccctcagcaccccacctgcagctgcatcttcaagaacttcaacctcttcctcctcctcatcgtcctcagctccactgttgaccccctcatctatgctttccgcagccaggagctccgcatgacactcaaggaggtgctgctgtgctcctggtga

SEQ ID NO: 1381 - DNA, 891 bp, Mus musculus
atgaagcatattatcaattcgtatgaacacaccaatgacaccgcaagaaataactccgattgtcctgatgtagttttgccagaagagatatttttcacaatctctgtcattggcatattggagaacttgattgtcctcctggctgtgatcaaaaataaaaatctccagtcccccatgtattttttcatctgcagtttggccatttctgacatgttgggcagtctgtataagatcttggaaaacatcctgatcatgttcagaaacatgggttatcttaagcctcgtggcagttttgaaagcacagcagatgacatcattgactgcatgttcatcctctctttgctgggctctatcttcagcctgtctgtcattgcagctgaccgttacatcaccatcttccatgccctgcaataccatagcattgtgaccatgcgccgcaccatcatcaccctaacaattatctggatgttctgcacagggagcggcatcaccatggtgatcttctcccaccacatccccacagtgctcaccttcacatcgctgttccctttgatgctggtttttatcctgtgtctctacatccacatgttcttacttgcccgctcccatgctaggaagatctctacccttcctagaaccaacatgaagggtgccatgacactaaccatccttcttggagtcttcatcttctgttgggccccctttgtgctccatgttctcttaatgaccttctgcccaaataacccttactgtgtttgctacatgtctctcttccaggtcaatggcatgttgatcatgtgcaatgcagttattgacccctttatatatgcctttcggagcccagagctcagagatgcattcaaaaggatgctcttctgcaaccggtattag

SEQ ID NO: 1382 - DNA, 972 bp, Mus musculus
atgaactcttcctgctgcctgtcttctgtttctccgatgctgcctaacctctctgagcaccctgcagcccctcctgccagcaaccggagcggcagtgggttctgtgagcaggtcttcatcaagccggaggtcttcctggctctgggcatcgtcagtctgatggaaaacatcctggtgatcctggctgtggtcaggaatggcaacctgcactctcccatgtacttcttcctgtgcagcctggctgcagccgacatgctggtgagcctgtccaactccctggagaccatcatgatcgccgtgatcaacagcgactccctgaccttggaggaccagtttatccagcacatggataatatcttcgactctatgatttgcatctccctggtggcctccatctgcaacctcctggccattgccatcgacaggtacgtcaccatcttctatgcccttcggtaccacagcatcatgacagttaggaaagccctcaccttgatcggggtcatctgggtctgctgcggcatctgcggcgtgatgttcatcatctactccgagagcaagatggtcatcgtgtgtctcatcaccatgttcttcgccatggtgctcctcatgggcaccctatatatccacatgttcctcttcgccaggctccacgtccagcgcatcgcagtgctgccccctgctggcgtggtggccccacagcagcactcctgcatgaagggggctgtcaccatcactatcctgctgggtgttttcatcttctgctgggcgcctttcttcctccacctggtcctcatcatcacctgccccaccaatccctactgcatctgctacacggcccatttcaacacctacctggttctcatcatgtgcaactccgtcatcgaccccctcatctacgccttccgcagcctggagctgcgcaacacgttcaaggagattctctgcggctgcaacagcatgaacttgggctag

SEQ ID NO: 1383 - DNA, 999 bp, Mus musculus
atgaactccacccaccaccatggcatgtatacttccctccacctctggaaccgcagcagctacgggctgcacagcaatgccagcgagtcgctggggaaaggccacccggacggaggatgctatgagcaactttttgtttcccccgaggtgtttgtgactctgggtgtcataagcctgttggagaacattctagtgatcgtggcgatagccaagaacaagaacctgcactcacccatgtactttttcatctgtagcctggctgtggcagatatgctggtgagcgtttcgaatgggtcggaaaccatcgtcattaccctgttaaacagtacggatacggatgcccagagcttcaccgtgaacattgataatgtcattgactctgtgatctgtagctccttgctcgcatccatttgcagcctgctttccattgcggtggacaggtatttcactatcttttacgcgctccagtaccataacatcatgacggttaggcgggtcgggatcatcataagttgtatctgggcagcttgcactgtgtcaggcgttctcttcatcatttactcggacagcagcgctgtcatcatctgcctcatttccatgttcttcactatgctagttctcatggcctctctctatgtccacatgttcctgatggcgaggcttcacattaagaggattgctgtcctcccaggcacagggaccatccgccagggtaccaacatgaagggggcgattaccttgaccatcctgattggagtctttgttgtctgctgggccccgttctttctccatttactgttctacatctcttgccctcagaatccatactgcgtgtgcttcatgtctcattttaatttgtatctcatactgatcatgtgtaacgccgtcatcgaccctctcatttatgccctccggagtcaagaactgaggaaaactttcaaagagatcatctgtttctatcccctgggaggcatctgtgagttgtctagcaggtattaa

SEQ ID NO: 1384 - DNA, 1119 bp, Mus musculus
atgcaagaccagagcccggtaaacagaagattcaactcccagaaaccgcctggaacccgtgaagaatcatgcttacctttgcgcggacgagagcagaatggtaaatccgatgccaagaagtgggggcattctcttccagcaatgaactcctcctccaccctgactgtattgaatcttaccctgaacgcctcagaggatggcattttaggatcaaatgtcaagaacaagtctttggcctgtgaagaaatgggcattgccgtggaggtgttcctgaccctgggtctcgtcagcctcttagagaacatcctggtcattggggccatagtaaagaacaaaaacctgcactcacccatgtacttctatgtgggcagcttagccgtggccgacatgctggtgagcatgtccaatgcctgggagactgtcaccatatacttgctaaataataaacacctggtgatagccgacacctttgtgcgacacatcgacaacgtgttcgactccatgatctgcatctctgtggtggcctcgatgtgcagtttgctggccattgcggtggacaggtacatcaccatcttctatgccttgcgctaccaccacatcatgaccgcgaggcgctcgggggtgatcatcgcctgcatctggaccttctgcataagctgcggcattgttttcatcatctactatgagtccaagtatgtgatcatttgcctcatctccatgttcttcaccatgctgttcttcatggtgtctctgtatatacacatgttcctcctggcccggaaccatgtcaagcggatagcagcttcccccagatacaactccgtgaggcaaaggaccagcatgaagggggctattaccctcaccatgctactggggattttcattgtctgctggtctcccttctttcttcaccttatcttaatgatctcctgccctcagaacgtctactgctcttgctttatgtcttacttcaacatgtaccttatactcatcatgtgcaactccgtgatcgatcctctcatctacgccctccgcagccaagagatgcggaggacctttaaggagatcgtctgttgtcacggattccggcgaccttgtaggctccttggcgggtattaa

SEQ ID NO: 1385 - DNA, 1279 bp, Mus musculus
ccccactagttcataacacagaatttaacatgggttcttcttccacccataggaatgaactccactcttgacagcagcccagctccaggtctgaccatcagtcccaccatggaccttgtgacctggatctacttttcagtgacattcctcgccatggccacgtgtgtgggggggatggcaggcaactcattggtgatttggctcctgagctgcaatggcatgcagaggtctcccttctgtgtctatgtgctcaacctggcggtggctgacttcctcttcttattctgcatggcctccatgctcagcctggaaacagggcccctgctcatagtcaacatttctgccaaaatctatgaagggatgaggagaatcaagtactttgcctatacagcaggcctgagcctgctgacagccatcagcacccagcgctgcctctccgtgcttttccccatctggtataagtgccaccggccccggcacctgtcatcagtggtatctggtgcactctgggcactggccttcctgatgaacttcctggcttctttcttctgcgtccaattctggcatcccaacaaacaccagtgcttcaaggtggacattgttttcaacagtcttatcctggggatcttcatgccggtcatgatcctgaccagcaccatcctcttcatccgggtgcggaagaacagcctgatgcagagacggcggccccggcggctgtacgtggtcatcctgacttccatccttgtcttcctcacctgttctctgcccttgggcatcaactggttcttactctactgggtggatgtgaaacgggatgtgaggctactttatagctgcgtatcacgcttctcttcgtctttgagcagcagtgccaacccggtcatttacttcctcgtgggcagccagaagagccaccggctgcaggagtccctgggtgctgtgctggggcgggcactgcgggatgagcctgagccagagggcagagagacgccatccacgtgtactaatgatggggtctgaagggagcccaaccaggaactcctccaaagccccacccagcccttccctaaaagtacccagcaagcctgcaatgcaaaggccttgcacctcaaaatgtttgggtcacgttcctctctgccagggagggttcaccactatcaccttgtgttcctaatctaaactaagaggtgaggcaatatatctttctgttttacctgtttagacacagatcctaactttgggtcccatcatgggcaaggctgtctgggaaatggagttt

SEQ ID NO: 1386 - DNA, 930 bp, Mus musculus
atgacgtccctgagcgtgcacacagattctcccagcacccagggagaaatggctttcaacctgaccatcctgtccctcacagagctcctcagcctgggcgggctgctgggcaatggagtggccctctggctgctcaaccaaaatgtctacaggaaccccttctccatctatctcttggatgtggcctgcgccgacctcatcttcctctgctgccacatggtggccatcatccctgagctgctgcaggaccagctgaacttccctgaatttgtacatatcagcctgaccatgctgcggttcttctgctacattgtgggcctgagcctcctggcggccatcagcacggagcagtgcctggccactctcttccctgcctggtacctgtgccgccgcccacgctacctgaccacctgtgtgtgtgcgctcatctgggtgctctgcctgctactggacctgctgctgagcggcgcctgcacccagttctttggagcacccagctaccacctgtgtgacatgctgtggctggtggtggcagttctcctggctgccctgtgctgcaccatgtgtgtgaccagcctgctcctgctgctgcgggtggagcgtggtccagagagacaccagcctcggggcttccccaccctggtcctgctggccgtcctgctcttcctcttctgcggcctgccctttggcatcttctggctgtccaagaacctgtcctggcacatccccctctacttctatcatttcagcttcttcatggccagtgtgcacagtgcagccaagcctgccatctactttttcttgggcagcacacctggccagaggtttcgggaacccctccggctggtgctccagcgggcacttggagatgaggctgagctgggagctgggagagaggcttcccaagggggacttgtggacatgactgtc

SEQ ID NO: 1387 - DNA, 2048 bp, Mus musculus
agcctgctgcccgtgggtcagcaaactcggagtcccaggagaagatctctacgaagggaactcggaggatcaggacagccacaggcttttgctaggcaggaacacatactgctgagctcccaacaggagcctggactcctcactcctggagatggccggaaactgttcatgggaagctcactccaccaaccagaacaagatgtgtcctggtatgagcgaggctcgggagctctacagcagaggatttctgaccattgagcagattgctacgctccctccgccagctgtcacaaactacatcttcctgctgctttgcctgtgtggcctggtgggaaacgggctggtcctctggtttttcggcttctccatcaagaggacccctttctccatctacttcctgcacctggccagcgccgatgggatgtacctcttcagcaaggccgtgattgctctcctgaacatggggaccttcctgggctccttccccgactacattcgaagagtgtcccggatcgtggggctctgcacattcttcacaggtgtgagcctcctgccagccattagcatcgaacgctgtgtgtctgtcatcttccccacctggtactggcgtcggaggcccaagcgcctgtcagctggggtctgtgccctgctctggatgctatcattcctggttaccagtatccacaattacttctgtatgttcctgggccacgaggcccctggtacagtctgccgcaacatggacatcgccctgggcatcttgctgttctttctcttctgcccactcatggtacttccctgcctggcgctcatcctgcacgtagagtgccgagcacggcgccgccaacgctctgccaagctcaatcacgtggtcctggcgattgtctctgtcttcctcgtatcatccatctacttggggatcgactggttcctcttctgggtcttccagatcccagcccccttccccgagtacgtcactgacttgtgtatctgcatcaacagcagtgccaaacccatcgtctacttcctggctgggagagacaagtcacagcgcctgtgggaacctctcagggtggtcttccagcgggctctccgggatggtgcggagccgggggacgctgctagcagcacacccaacacggtcaccatggaaatgcagtgcccctctgggaacgcatcctgagaggccaacttctggggcaaggctgcagcagagagcggccagtagcttccagagacactctgcccgagggcaggagtagggcagctgcccctgtgctgccagggagaagacctgccttaacactcttgtcaggggtggccaggaggctgagcagccacctctggacagaccctgtggcctctgctccccaaccattctgcttctgtgactcagtgtaccaaagttgccctcaccagcatggtagggtcccttcttaacagaagctcaagagcgaaggcaagaaggaggtcaccttctcaaacgtgactcatcgagcatcaccctccctgggccagcagcctcagccccacccccagggagttgttcagcctcccaaggctgcatcagaacaaaccctagagaacggtgctatctggaactgggtcctatccactggcattgcactctgcaaacaagcccctgcccctttgatgagtcacctagtgactttaatgggatgggatctggccttggcaagccatgtgagacagaaaggaccttctgtcaccatgggtagctgactgcttttctgaccccacccacccaccccaaccagccagctctgggcagctgactgcactcagcatcttccaggccactgtagtccactgctaagtcctcaatctcctgtacccatttcaaagtggactctggccccctggaggctgccaccacgatgtcactcatcatccagcacagtggcctgtgtagccaaaggaagttttataaaagataataaagtatatatcaatacacatttttttaaactttgcagtgaagcaggaaaaaaaaaaaaaaaaaaaaaaaaaaaaaaaaaaaaaaaaaa

SEQ ID NO: 1388 - DNA, 1062 bp, Mus musculus
atgaagggcaatgtcagcgagctgctcaatgccactcagcaggctccaggcggcggggagggagggagaccacgaccgtcctggctggcctctacactggccttcatcctcatctttaccatcgtggtggacattctgggcaacctgctggtcatcctgtctgtgtaccgcaacaagaagctcaggaactcagggaatatatttgtggtgagtttagctgtggcagacctcgtggtggctgtttacccttatcccttggtgctgacatctatccttaacaacggatggaatctgggatatctacactgtcaagtcagcgcatttctaatgggcttgagtgtcatcggctcgatattcaacatcacggggatcgctatgaaccgttactgctacatttgccacagcctcaagtacgacaaaatatacagtaacaagaactcgctctgctacgtgttcctgatatggatgctgacactcatcgccatcatgcccaacctgcaaaccggaacactccagtacgatccccggatctactcctgtaccttcacccagtctgtcagctcagcgtacacgatagcagtggtggttttccatttcatcgtgcctatgattattgtcatcttctgctacttaaggatatgggtcctggtccttcaggtcagacggagggtgaaacccgacaacaagcccaaactgaagccccaggacttcaggaactttgtcaccatgttcgtagtttttgtactttttgccatttgttgggccccactcaacctcataggtcttattgtggcctcagaccctgccaccatggtccccaggatcccagagtggctgttcgtggctagttactacctggcgtacttcaacagctgcctcaacgcaattatatacggactactgaatcagaatttcagaaaggaatacaaaaagattattgtctcgttgtgcacagccaagatgttctttgtggagagttcaaatgaagaagcagataagattaaatgtaagccctctccactaatacccaataataacttaataaaggtggactctgtttaa

SEQ ID NO: 1389 - DNA, 867 bp, Mus musculus
atgttctccatattcaacatctggggcacattcaacaaagtgctcttcttcctcagcctcactgtcagccttgcagggctggtgggcaacgctctgctgctctggcacctcggtctgcacattaagaagggacccttcaacacctacctgctgcacctggctgctgccgatttcctcttcctctcatgccaagttggcttctctattgctacgatcgtgtcgggccatgaggacacactctacttcccagtcaccttcctgtggtttgccgtggggctctggctgctggctgccttcagtgtggactgttgcctcgcctacatgttcccctccttttgcagccccaaccgccgtcccaggttcacttcagttgtcctctgcctcgtgatctgggccctgaccatgccggccgtgctgttgccagccaacgcctgtgggctgctaaaaaacggaatgagtctgctggtctgcctcaagtaccattggaccagtgtcacctggctagcggtactgtctggcatggcatgtggggcaagcaagtttctcttaatctttgggaactgctgctcttcacagccaccccccaagttctgcaagttggcccagtgctctgggatccttctgttcttctgtcgcctacccctggttgtctactggtgcctgcggccagtcttaaaattcctgctccccttcttctttccactggccaccctcctggcctgcattgacagcagtgcaaagcccctcttgtactacatgaagggcaggcagctcaggaaggacccactgcaggtagccctaaacagggctctaggggaagagtcccagtcaggtcttggggggctatccttgcccatgcaccaagtg

SEQ ID NO: 1390 - DNA, 1173 bp, Mus musculus
atgccccccaggtctctctccaacctctcctttcccacagaggcgaatgagagcgagctggtacccgaggtgtgggaaaaggatttcctgcccgactcagatgggaccaccgcggagttggtgatccgctgtgtgataccatccctctacctaatcatcatctcggtgggtttgctgggcaacatcatgctggtgaagatattcctcaccaacagcgccatgcggaatgtccctaacatcttcatctctaacctggcggctggggacctgctgctgctgctgacctgcgttccagtggacgcctcccgttacttctttgatgaatgggtgttcggcaagctgggctgcaaactcatcccggccatccagctcacctcggtgggggtttccgtgttcactctcactgctctcagcgctgacaggtacagagctatcgtgaaccccatggacatgcagacgtccggtgtgttgctgtggaccagtttgaaggcagtgggcatctgggtggtctctgtgttgttggcggtccctgaagctgtgttttcagaagtagcacgcattggtagcttggataacagcagtttcacagcatgcataccctacccacaaacagatgagttacatccaaagattcattcagtgctcatttttcttgtctatttcctcataccccttgttatcatcagcatttattattatcatattgcaaagactttaattaaaagtgcacacaatcttcctggagaatacaatgaacataccaaaaagcagatggagacacggaaacgcctggctaagattgttctggtctttgtgggctgctttgtcttctgctggtttcccaaccacgtcctctacttgtataggtctttcaactacaaggagatagatccttctctcgggcacatgatcgtcaccttagtggcccgggttctgagtttcagcaattcctgtgtcaatccctttgctctttacctgctcagcgaaagctttaggaagcacttcaacagccagctctgttgtgggcggaagtcctatcccgagaggtccaccagctacctcctcagctcgtcagcagtaagaatgacttctttgaaaagcaatacaaagaatgtggtgaccaattctgtcctgctcaatggacatagcacaaagcaagaaatagcactgtga

SEQ ID NO: 1391 - DNA, 1188 bp, Mus musculus
atgggaaaacttgaaaatgcttcctggatccacgattctctcatgaagtacttgaacagcacagaggagtacttggcctacctgtgtggacccaagcgcagtgacctatcccttccagtgtctgtggtctatgcgctgatcttcgtggtgggggtgataggcaatcttctggtgtgcctggtgattgcccgacatcagactttgaagacacccaccaactactatctcttcagcttggcagtctcagacttgctggtcctgctcttaggtatgccactggaggtctacgagttgtggcacaattatcccttcctgtttgggccggtgggatgctacttcaagacagccctcttcgagactgtgtgctttgcctccattctcagtgtcaccacggttagcattgagcgctacgtggccattgtccatccattccgagccaagctggagagcacacggcgacgggccctcaggatcctcagcctagtctggagcttctctgtggtcttttctttgcccaacaccagcatccatggcatcaagttccagcagtttcccaacgggtcctccgtgcccggctctgccacctgcacagtcaccaaacccatgtgggtgtataacttcatcatccaagctacctccttcctcttctacatcctcccgatgaccctcatcagcgtcctctactatctcatggggctcaggctgaagagagatgaatctcttgaggcagacaaagtgactgtgaatattcacagaccctccagaaaatcagtcaccaagatgctgtttgtcttggtcctcgtgtttgctatctgttggacccctttccatgtggacaggctcttcttcagctttgtggacgagtggactgagtccctggctgctgtgttcaacctcatccacgtggtatcaggtgtctttttctatctgagctccgctgtcaaccccattatatataacctcctgtctcggcgcttccgggcggcctttcggaatgttgtctctccttcctgcaaatggtgccatccccagcatcgcccacaggggcctccagcccagaaggttatcttcttgacagaatgccaccttgtggagctgacagaggatgcgggcccccagttcccttgtcagtcatccatccacaacacccaacttaccaccgtcccctgtgttgaagaggtaccatga

SEQ ID NO: 1392 - DNA, 1149 bp, Mus musculus
atgaactcaactctgttctccaaggttgaaaatcactcaattcactataatgcctcagagaattctccacttctggcttttgaaaatgatgactgccacctgcccttggctgtgatattcaccttggctctcgcttatggggcggtgattattcttggcgtctctggaaacctggcattgatcataatcattctgaaacagaaggagatgagaaatgtcaccaacattctgatcgtgaacctctccttctcagacttgctcgttgcggtcatgtgtctcccgttcacttttgtatatacactgatggaccactgggtcttcggggagaccatgtgcaaactgaatccctttgtacagtgtgtctccatcacagtatccattttctcgctggttctcatcgctgtggaacggcatcagctaatcatcaacccaagagggtggagaccaaacaatagacatgcttacataggcattactgtcatttgggtccttgcagtggcttcttctctgccctttgtgatctatcaaattctgaccgacgagcccttccaaaatgtgtcacttgcggcgttcaaggacaagtatgtgtgctttgacaaattcccatctgactctcacaggctgtcttacacgactctcctcctggtgctgcagtatttcggcccactctgctttatattcatatgctacttcaagatatacattcgcttgaaaaggagaaacaacatgatggacaagatccgggacagtaagtacaggtccagtgagaccaagcgaatcaacatcatgctgctctccattgtggtcgccttcgccgtctgctggctgccccttaccatcttcaacactgtgttcgactggaaccaccagatcattgccacctgcaaccacaatctgctgtttctgctctgtcacctcaccgccatgatctccacctgcgtcaaccccatcttttatggattcctgaacaaaaatttccagagagacttgcagttcttcttcaacttttgtgacttccggtctcgagacgatgactacgagaccatagccatgtctaccatgcatacggatgtgtccaagacgtctctgaagcaggctagcccagtcgcatttaaaaaaatcagtatgaatgacaatgaaaaagtctga

SEQ ID NO: 1393 - DNA, 1158 bp, Mus musculus
atggttctgaagatgggcccggtaggtgcagaggcagatgagaatcaaactgtagaagtgaaagtggagccctatgggccagggcacactactcctagaggtgagttgccccctgatccggagccggagctcatagacagcaccaaactggtcgaggtgcaggtgatcctcatattggcctactgctccatcatcttgctaggggtagttggcaactccctggtaatccatgtggtaatcaaattcaagagcatgcgcacagtaaccaacttttttattgccaacctggctgtggcggatcttttggtgaacaccctgtgcctgccattcactcttacctataccttgatgggagagtggaaaatgggtccggtcttgtgccatttggtgccctatgcccagggtctggcggtacaagtgtccacaataactttgacagtcattgctctggaccgccatcgttgcattgtctaccacctggagagcaagatctccaagcgaatcagcttcctgatcattggcctggcctggggcatcagcgctctgctggcaagtccactggccatcttccgggaatactccctgattgagatcattcctgactttgagattgtggcctgtaccgagaagtggcctggggaagagaagagtgtgtatggtacagtctacagcctttccaccctgctcatcctgtacgttttgcctctgggcatcatatctttctcctacacccgtatctggagtaagctgaggaaccacgtcagtcctggagctgcaagtgaccattaccatcagcgaaggcacaaaatgaccaaaatgctggtgtgcgtggtagtggtgtttgcagtcagctggctacccctccacgccttccaactcgctgtggacatcgacagccacgtcctggacctgaaggagtacaaactcatcttcaccgtgttccacattatcgccatgtgctccacctttgccaacccccttctctatggttggatgaatagcaactacagaaaagctttcctctcggccttccgctgtgagcagaggttggatgccattcactcggaggtgtctatgaccttcaaggctaaaaagaacctggaagtcaaaaagaacaatggccccactgactctttttcggaggctaccaatgtgtaa

SEQ ID NO: 1394 - DNA, 1401 bp, Mus musculus
atggaggttaaacttgaagagcattttaacaagacatttgtcacggagaacaatactgctgccagtcagaacacggcctcccctgcctgggaggactacagaggcacagagaacaatacttctgctgctcggaacactgcctttccagtctgggaggactatagaggcagcgtagacgacttacaatacttcctgattgggctctatacatttgtaagtcttcttggttttatgggaaatctacttatcttaatggctgttatgaaaaagcgcaatcagaagactacagtgaactttctcataggcaacctggccttctccgacattttggttgtcctgttttgctcccctttcaccctgacctctgtcttgttggatcagtggatgttcggcaaagccatgtgccatatcatgccattccttcagtgtgtatcagttctggtttcaactctgattttaatatcgattgccattgtcaggtatcatatgataaagcaccctatatctaacaatttaacagcaaaccatggctacttcctgatagctactgtctggacactgggctttgccatctgttctcccctcccagtgtttcacagccttgtggaacttaaggaaacctttggctcagcattgctaagcagcaagtatttgtgtgttgagtcatggccctctgattcatacagaattgctttcacaatctctttattgttagttcagtatatcctgcctctagtatgtttaacagtaagtcatactagtgtctgcaggagtataagctgtggattgtcccacaaagaaaacagactcgaagaaaatgagatgatcaacttaactctacatccatccaaaaagagtcgggaccaggcaaaaccccccagcactcaaaagtggagctactcattcatcagaaagcaccgaagaaggtacagcaagaagacggcatgcgtgttacccgccccagcaggaccttcccaggagaagcacctaaccgttccagaaaacccaggctcggtccgtagccagctgtcaccatccagtaaggttattccaggggtcccgatctgctttgaggtgaaacctgaagaaagctcagatgctcaggagatgagagtcaagcgttccctcacgagaataaagaagagatctcgcagtgttttctacagactgactatattgatattagtgttcgctgttagctggatgccactccacgtcttccacgtggtgaccgatttcaatgataacctgatttccaataggcatttcaagctggtgtactgcatctgtcacttgttaggcatgatgtcctgttgtcttaatccgatcttatatggattccttaataatggtatcaaagcagacttgagagcccttatccactgcctacacatgtcatga

SEQ ID NO: 1395 - DNA, 1116 bp, Mus musculus
atggaagtgctcacaaaccagccaacacctaataaaaccagtggcaagagcaacaactcggcatttttctactttgaatcctgccaacccccttttctagccatactcttgctactcatagcatatactgtgatcctaatcatgggcatttttggaaacctctctcttatcatcatcatctttaagaaacagagagaagctcaaaatgttaccaacatactgattgccaacctgtccctctctgacatcttggtgtgtgtcatgtgcatcccttttacggtcatctacactctgatggaccactgggtatttgggaacactatgtgtaaactcacttcctacgtgcaaagtgtctcagtttctgtgtccatattctcccttgtgttgattgctattgaacgatatcagctgattgtgaacccccgtggctggaaacccagagtagctcatgcctattgggggatcatcttgatttggctcatttctctgacattgtctattcccttattcctgtcctaccacctcaccaatgagccctttcataatctctctctccctactgacatctacacccaccaggtagcttgtgtggagatttggccttctaaactgaaccaactcctcttttctacatcattatttatgctccagtattttgtccctctgggtttcattcttatctgctacctgaagatcgttctctgcctccgaaaaagaactaggcaggtggacaggagaaaggaaaataagagccgtctcaatgagaacaagagggtaaatgtgatgttgatttccatcgtagtgacttttggagcctgctggttgcccttgaacattttcaatgtcatcttcgactggtatcatgagatgctgatgagctgccaccacgacctggtatttgtagtttgccacttgattgctatggtttctacttgcataaatcctctcttttatggatttctcaacaaaaacttccagaaggatctaatgatgcttattcaccactgttggtgtggtgaacctcaggaaagttatgaaaatattgccatgtctactatgcacacagatgaatccaagggatcattaaaactggctcacataccaacaggcatatag

SEQ ID NO: 1396 - DNA, 1275 bp, Mus musculus
atgcacctcaacagctccgtgcagcagggagccccaagtgaacccggtgcccagcccttcccacatccacagttcggactggagacgatgctcctggcgctcagcttgagcaatggttctggcaattcctcagaatccatcctggagcccaacagcaacctggacgtgaacactgacatttattccaaggtgctggtgaccgctgtatacctggcactttttgtggtgggcactgtgggcaactcggtgacagccttcactctagcgcggaagaagtcgctgcagagcctgcagagcactgtgcattaccacctgggtagcctggcactgtctgacctgctcatcctgctgctggccatgcccgtggagctgtacaacttcatctgggtgcaccatccctgggcctttggggatgctggctgccgtggctactatttcctgcgagatgcctgcacctatgccacagccctcaatgtagccagcctgagtgtggagcgctacttggccatctgccatcccttcaaggccaagaccctcatgtcccgcagccgcaccaagaaattcatcagtgccatatggctagcctcggcgctgctggctgtacccatgcttttcaccatgggcctgcagaaccgcagtgccgatggccagcaccctggtggcctggtgtgcacacccacggtggacacagccaccgtcaaggtcgtcatccaggttaacaccttcatgtccttcctgtttcccatgctgatcatctccatcctaaacactgtgatagccaacaaactgaccgtcatggtgcaccaggctgccgagcagggccgtggtgtgtgcaccgtgggcacccacaacagtttagagcacagcacgttcaacatgtccatcgagccaggccgtgtccaggccctgcgccatggagtcctcgtcttacgtgctgtggtaatcgcctttgtggtctgctggctgccctaccacgtgcggcgcctcatgttctgctatatctcagatgaacagtggactacgttcctcttcgacttctaccactatttctatatgctgaccaacgctctcttctacgtcagctcagccatcaatcccatcctttacaacctcgtctccgccaacttccgccaggtcttcctgtccacactggcttgcctctgtcctgggtggcgccgccgccgaaagaagaggccaacgttctccaggaagccaaacagcatgtccagcaaccatgcgttttccaccagcgccacccgggaaaccctgtactag

SEQ ID NO: 1397 - DNA, 1254 bp, Mus musculus
atggagaccagcagcctgtggcccccgaggcccagccccagtgcagggctgagcctggaggcgcggctgggcgtggacactcgcctctgggccaaggtgctgttcaccgcgctctattcgctcatcttcgcgcttggcacagccggcaatgcgctgtccgtgcacgtggtgctgaaggcgcggacgggtcgccccgggcgcctgcgctaccacgtgctcagcctggcactgtcagccctgctgctactgctgatcagcgtgcccatggagctctacaacttcgtgtggtcccactacccctgggtcttcggcgatctcggctgtcgtggctattacttcgtgcgcgagctgtgcgcctacgccacggtgctgagcgtggccagcctgagcgcagagcgctgcctggccgtgtgccagccgctgcgcgcccgccgcctgctcaccccgcgccgcacctgccgcctgctgtcactggtctgggtcgcctctctgggccttgccctgcccatggcggttatcatgggacagaagcacgaaatggagagggccgacggggagcctgagcctgcctcgcgtgtgtgcacggtgctagtaagtcgcgccagctccaggtctacattccaggtgaaacgtgctggtctccttcgttctcccctttgggaactcactgctattctgaatgggatcactgtcaaccacctggtggccctctactcccaggtaccatcagcttctgcccaagtcaactccatccccagccgcctggagctcctgagtgaggaaggcctcctgggcttcatcacatggagaaagaccctctccctgggggtccaagccagcctggtgagacacaaggatgccagccagatccgcagcctccagcacagcgcccaggttctcagagccatcgtggctgtgtatgtcatctgctggctgccgtaccatgcccgcaggctcatgtactgctacatccccgatgatggatggactgatgagctctatgacttctatcactatttctacatggtgaccaacacgctcttctatgtcagctcggcagtgaccccagtcctctacaatgccgtgtcttcctccttcagaaagctctttctggaatctctcagttccctgtgtggtgaacagcgctccgtggtgcccttaccccaagaagccccagagtcaactactagtacgtacagtttccggctttggggatccccaagaaaccccagcctgggtgaaatacaagtgtga

SEQ ID NO: 1398 - DNA, 1218 bp, Mus musculus
atggcctccccgcgcctgggaattttctgctgccctacgtgggacgcagccacacagctggtgctaagcttccaaccgcgggtgttccatgccctgtgcctgggaagcggcactctccgcctggtgcttggcctccttcagctcctatcagggcgtcgatctgttggtcacagggcgcctgcgacatccccagccgcctcagtccacatcctccgtgctgccactgcctgtgacttgcttggctgcctgggaatcgttatcaggtccacagtgtggatagcctacccagagttcattgaaaacatttccaatgtgaatgcaacagacatttggcctgctactttctgtgtggggagcgcaatgtggatccagctgttgtacagtgcctgcttctggtggctcttttgctatgcagttgatgtctacttggtgatcaggagatcggcgggacggagcaccatcctgctgtaccacatcatggcctggggcctggctgtgctgctctgtgtggagggagcagtcatgctctactacccttctgtgtccaggtgtgagaggggcctggaccatgccatcccccattatgtcaccacatacttgccacttctgcttgtcctggtggccaacccaatcctgtttcacaagacagtgacttcagtggcctctttactgaaaggaagaaaaggtgtttacacagagaatgagagactgatgggggctgtgatcaagacccgttttttcaaaataatgctggtgttaattgcatgttggttgtccaatatcatcaatgaaagtcttttgttctaccttgaaatgcaaccagatatccatggaggctctctgaaacgcatccagaatgcagctaggaccacatggtttataatgggaatactgaatccagcccaaggacttctcttgtctctggccttctatggctggacaggatgcagcctggatgtccatcctcccaagatggtgattcagtgggaaacaatgactgcctctgctgctgagggcacgtaccagacccctgtgcgttcctgtgtgccccatcaaaaccccaggaaggttgtatgtgtcgggggacatacttctgatgaggtgctgagcattttgtctgaagattcagatgccagtactgttgaaatccatactgcaactgggtcctgcaacataaaggaagttgactccatttcccaagcccagggggaactctga

SEQ ID NO: 1399 - DNA, 1232 bp, Mus musculus
gaattcggcacgaggttttctacagccatggcccaaaggcttacaggtgaacagacactggaccactatgaggatagcacccatgcaagcatcttcacctataccaacagcaacagcaccaaaggtccctttgaaggccccaattatcacattgctcccaggtgggtgtaccacctcaccagcacctggatgattcttgtggtcgttgcatctgtcttcactaatggacttgtgctggcagccaccatgagattcaagaagctgcgccatccactgaactggattctggtgaacttggcagttgctgacctagcagagaccattattgccagcactatcagtgttgtgaaccaaatctatggctacttcgttctgggacaccctctgtgtgtcattgaaggctacattgtctcattgtgtggaatcacaggcctctggtccctggccatcatttcctgggagagatggctggtggtctgcaagccctttggcaatgtgagatttgatgctaagctggccactgtgggaatcgtcttctcctgggtctgggctgctatatggacggccccaccaatctttggttggagcaggtactggccttatggcctgaagacatcctgtggcccagacgtgttcagcggtacctcgtaccccggggttcagtcttatatgatggtcctcatggtcacgtgctgcatcttcccactcagcatcatcgtgctctgctacctccaagtgtggctggccatccgagcagtggcaaagcaacagaaagaatctgagtccactcagaaggccgagaaggaggtgacacgcatggtggtggtgatggtcttcgcatactgcctctgctggggaccctatactttctttgcatgctttgctactgcccaccctggctatgccttccaccctcttgtggcctccctaccatcctactttgccaaaagtgccactatctacaaccccattatctatgtctttatgaaccggcagtttcgaaactgcatcttacatctctttggaaagaaggttgatgatagctctgaactttccagcacctccaagacagaagtctcatctgtctcttcagtgtcacctgcataaagtctgcctccaacctgtcccatccatcaaagctttggccatgttttacctcccttctcatctatccttgtaaaataaacataatttctccttgctcaaaaaaaaaaaaaaaaaaaaaactcgag

SEQ ID NO: 1400 - DNA, 1041 bp, Mus musculus
atgtcaggagaggatgacttttacctgtttcagaatatctcttcggtggggccctgggatgggcctcagtaccaccttgctcctgtctgggccttccgcctccaggcagccttcatgggatttgtcttctttgtggggaccccactcaatgccatagtgctggtggccacactgcattacaaaaagttgcgacagcccctcaactatattctggtcaatgtatccctcgggggcttcctcttctgcatcttctctgtcttcacagtcttcatcgccagctgtcacggatacttcctctttggtcgccatgtttgtgctctggaggccttcttgggctctgtagcaggtctagtgacaggatggtcattggctttcctggcttttgaacgctacgttgtcatctgtaaacccttcggcagcatccgcttcaactccaagcatgcactgatggtggtcctggctacttggattattggtatcggggtgtccatcccacccttttttggctggagcaggttcatccctgagggcctgcagtgctcctgtggcccagactggtacactgtgggcaccaagtatcgaagcgagtactacacctggttcctcttcatcttctgtttcatcattcctctttccctcatctgcttctcctactcccagttgctgaggactctcagagctgtggcagctcagcagcaagagtctgctacgacacaaaaggctgaacgggaggtgagtcatatggtggtggtgatggtgggatccttctgtctctgctacgtgccctatgctgccctggccatgtacatggtcaacaatcggaaccacgggctggacttacggcttgtcaccatccccgccttcttttccaagagctcctgtgtctacaaccccatcatctactgcttcatgaataagcagttccgggcttgcattctggagatggtgtgcaggaagcccatggcagacgaatctgacgtgtctggctctcagaaaacagaagtttctactgtctcttctagcaaagttggccctcactga

SEQ ID NO: 1401 - DNA, 1737 bp, Mus musculus
tcgggccgcccggctcaccgagccctctctctcacggcgcgccggcgtcgggccatgtactcggggaaccgtagtggcgaccagggctactgggaggacggggcgggcgccgagggcgcagcaccggcgggcacgcggagccccgcgcctctcttcagccccaccgcgtacgagcgcctggcgctgctactcggctgcctcgcgctgctgggcgtcggcggcaacctgctggtgctgcttctctactccaagttcccgagactgcgcacgcccacccacctcttcctggtcaacctgagcctgggcgacctgctggtatccctgttcggagtcaccttcaccttcgcgtcgtgcctgcggaacggctgggtgtgggacgccgtgggctgcgcgtgggacgggtttagcggcagcctctttgggttcgtttccattaccaccctcactgtgctggcctatgaacgttatatccgtgtggtacatgccagagtgatcaacttttcctgggcctggagggccattacctatatctggctctactccttggcatgggcaggagcacctctcctgggctggaacaggtacatcctagacatacatggactgggctgtaccgtggactggagatccaaggatgccaacgactcttcctttgtgctcttcctgtttctcggctgcctggtggtgcccgtgggcatcatagcccattgctacggccacattctctattctgttcgaatgcttcgctgtgttgaagatcttcagaccattcaagtgatcaagatgctaagatatgaaaagaaagtagcaaagatgtgctttttgatggcctttgtctttctcacctgctggatgccttacattgtgacccgcttcttggtggtcaatggctatggacacctggtcaccccaactgtgtctattgtttcttatctctttgctaaatcgagcactgtgtacaacccagttatctacatcttcatgaacagaaagtttcggaggtcccttctgcagctcctatgcttccgcctgctgagatgccagcggcctgctaaaaacctcccagcggctgagagtgaaatgcacatcaggcccatcgtgatgtcacagaaagatggggacaggccaaagaagaaagtgacctttaactcttcctctatcatctttatcatcaccagtgatgagtccctgtcagtcgaggacagtgacagaagcagcgcatctaaggtcgatgtcatccaagtgcgtcctctataagaatggaagacagagtcctatatccagccaccacaatgttcctgtcaggagtgccccagagtccccatttggtgtaatagtgacagaacctctgtggccctgtgggaaatccgaatcacccacatgttgtctgtattcaagaagcgactgagcaagacaaattattttaactcaatgggtgctttataacttgagaacctcctggtggcacaagatgagcatctggcgtcatcgctactatgccaggatttaatatttgaatgactgtatttgccaaagcacataatacattttgtttatcaaatgtatttcactataaaaataacaatctcatatacacgtgtacaatgactggaacatctggagtacgttgcggtgttgagtcctgttctgtgccatgttgtgtgtttgaccaattaaatttattgaagagataataaatcaatccctacttttatctgaaaaaaaaaaaaaaaaaaa

SEQ ID NO: 1402 - DNA, 2137 bp, Mus musculus
cactcattcctttgcgcttcattggacattaagcagtcagcagcccaaagagcagctccaggctggatggatgagagcgggcagcaggtggaccaggccgcagggttaaggatggtatagagccggaagtctggggaccgatccctgatctttccatggccttagctcctctgagagcctgagcatggactctccttcaggaccaagagtcttgtcaagcttaactcaggatcccagcttcacaaccagtcctgccctgcaaggcatttggaacggcactcagaacgtctccgtaagagcccagcttctctctgttagccccacgacatctgcacatcaggctgctgcctgggtccccttccccacagtcgatgtcccagaccatgctcactataccctaggcacggtgatcctgctggtgggactcacagggatgctgggcaatctgacggtcatctacaccttctgcaggaacagaggcctgcggacaccagcaaacatgttcatcatcaacctcgcagtcagcgacttcctcatgtcagtcactcaggccccggtcttctttgccagcagcctctacaagaagtggctctttggggagacaggttgcgagttctatgccttctgcggggctgtctttggcatcacttccatgatcaccctgacagccatagccatggaccgctatctggtgatcacacgtccactggccaccatcggcaggggatccaaaagacgaacggcactcgtcctgctaggcgtctggctttatgccctggcctggagtctgccacctttctttggttggagtgcctacgtgcccgaggggctgctgacatcctgctcctgggactacatgaccttcacaccccaggtgcgtgcctacaccatgctgctcttctgctttgtcttcttcctccccctgctcatcatcatcttctgctacatcttcatcttcagggccatccgagagacaggccgggcctgtgagggctgcggtgagtcccctctgcggcagaggcggcagtggcagcggctgcagagtgagtggaagatggccaaggtcgcactgattgtcattcttctcttcgtgctgtcctgggctccctactccactgtggctctggtggcctttgctggatactcgcacatcctgacgccctacatgagctcggtgccagccgtcatcgccaaggcttctgccatccacaatcccattatctacgccatcactcaccccaagtacagggtggccattgcccagcacctgccttgccttggggtgcttctcggtgtatcaggccagcgcagccacccctccctcagctaccgctctacccaccgctccacattgagcagccagtcctcagacctcagctggatctctggacggaagcgtcaagagtccctgggttctgagagtgaagtgggctggacagacacagaaacaaccgctgcatggggagctgcccagcaagcaagtggacagtccttctgcagtcagaacctagaagatggagaactcaaggcctcttccagcccccaggtacagagatctaagactcccaaggtgcctggacccagtacctgccgccctatgaaaggacagggagccaggccaagtagcctaaggggtgaccagaaaggcaggcttgctgtgtgcacaggcctctcagagtgtccccatccccatacatcccagtttccccttgctttcctagaggatgatgtgactctcagacatctgtagcagggtctaagtatgatctgtatctaggggaatatctgcatgtgactgtgtagctctgcgcatgacatgctgtcagctatgttgtaccatatgtatatgtagagtatgcatataacttatgtgcccttgaagatatgtggcctacagcagagaacaactcatgcgtgtgtggaccatgttcctggcatatatgctctctgtcactgtgatgcctctgtgttgtgtgggtgacagagtgtgatggtgttcacctctctgcgcgggttttgatgctgggcaaacacggggaagggagctgcaagccatgtactagctcactgccgatggcctgtgctcaagatgtcaccgaggagaacacttgtagctattaaaagaaggccagctgtc

SEQ ID NO: 1403 - DNA, 1119 bp, Mus musculus
atggagctggtgccctctgcccgtgcggagctgcagtcctcgcccctcgtcaacctctcggacgcctttcccagcgccttccccagcgcgggcgccaatgcgtcggggtcgccgggagcccgtagtgcctcgtccctcgccctagccatcgccatcaccgcgctctactcggctgtgtgcgcagtggggcttctgggcaacgtgctcgtcatgtttggcatcgtccggtacaccaaattgaagaccgccaccaacatctacatcttcaatctggctttggctgatgcgctggccaccagcacgctgcccttccagagcgccaagtacttgatggaaacgtggccgtttggcgagctgctgtgcaaggctgtgctctccattgactactacaacatgttcactagcatcttcaccctcaccatgatgagcgtggaccgctacattgctgtctgccatcctgtcaaagccctggacttccggacaccagccaaggccaagctgatcaatatatgcatctgggtcttggcttcaggtgtcggggtccccatcatggtcatggcagtgacccaaccccgggatggtgcagtggtatgcatgctccagttccccagtcccagctggtactgggacactgtgaccaagatctgcgtgttcctctttgccttcgtggtgccgatcctcatcatcacggtgtgctatggcctcatgctactgcgcctgcgcagcgtgcgtctgctgtccggttccaaggagaaggaccgcagcctgcggcgcatcacgcgcatggtgctggtggtggtgggcgccttcgtggtgtgctgggcgcccatccacatcttcgtcatcgtctggacgctggtggacatcaatcggcgcgacccacttgtggtggccgcactgcacctgtgcattgcgctgggctacgccaacagcagcctcaacccggttctctacgccttcctggacgagaacttcaagcgctgcttccgccagctctgtcgcacgccctgcggccgccaagaacccggcagtctccgtcgtccccgccaggccaccacgcgtgagcgtgtcactgcctgcaccccctccgacggcccgggcggtggcgctgccgcctga

SEQ ID NO: 1404 - DNA, 1143 bp, Mus musculus
atggagtcccccattcagatcttccgaggagatccaggccctacctgctctcccagtgcttgccttctccccaacagcagctcttggttccccaactgggcagaatccgacagtaatggcagtgtgggctcagaggatcagcagctggagtccgcgcacatctctccggccatccctgttatcatcaccgctgtctactctgtggtatttgtggtgggcttagtgggcaattctctggtcatgtttgtcatcatccgatacacgaagatgaagaccgcaaccaacatctacatatttaacctggctttggcagatgctttggttactaccactatgccctttcagagtgctgtctacttgatgaattcttggccttttggagatgtgctatgcaagattgtcatttccattgactactacaacatgtttaccagcatattcaccttgaccatgatgagtgtggaccgctacattgctgtgtgccaccctgtgaaagctttggacttccgaacacctttgaaagcaaagatcatcaacatctgcatttggctcctggcatcatctgttggtatatcagcgatagtccttggaggcaccaaagtcagggaagatgtggatgtcattgaatgctccttgcagtttcctgatgatgaatattcctggtgggatctcttcatgaagatctgtgtcttcgtctttgcctttgtgatcccagtcctcatcatcattgtctgctacaccctgatgatcctgcgcctgaagagtgtccggctcctgtctggctcccgagagaaggaccgaaatctccgccgcatcaccaagctggtgctggtagtagttgcagtcttcatcatctgttggacccccattcacatctttatcctggtggaggctctgggaagcacctcccacagcacagctgccctctccagctattatttctgtattgccttgggttataccaacagcagcctgaatcctgttctctatgcctttctggatgaaaacttcaagcggtgttttagggacttctgcttccctattaagatgcgaatggagcgccagagcaccaatagagttagaaacacagttcaggatcctgcttccatgagagatgtgggagggatgaataagccagtatga

SEQ ID NO: 1405 - DNA, 1104 bp, Mus musculus
atggagtccctctttcctgccccattctgggaggtcttgtatggcagccactttcaagggaacctgtctctcctaaatgagaccgtaccccatcacctgctcctcaatgctagccacagtgccttcctgccccttggactcaaggtcaccatcgtggggctctacttggctgtgtgcatcggggggctcctggggaactgcctcgtcatgtatgtcatcctcaggcacaccaagatgaagactgctaccaacatttacatatttaatctggcactggctgataccctggtcttgctgacactgcccttccagggcacagacatccttctgggcttctggccatttgggaatgcactgtgcaagacggtcattgctatcgactactacaacatgtttaccagcactttcactttgactgccatgagtgtagaccgttatgtagctatctgccaccctatccgtgcccttgatgttcggacatccagtaaagcccaggccgttaatgtggccatatgggccctggcttcggtggttggtgttcctgttgccatcatgggctcagcacaagtggaggatgaagagatcgagtgcctggtggagatccccgcccctcaggactattggggccctgtatttgccatctgcatcttccttttttccttcatcatcccggttctgatcatctctgtctgctacagcctcatgattcgacgacttcgtggtgtccggctgctttcaggctcccgagagaaggaccggaacctgcgacgcatcacacggctggtactggtagttgtggctgtgtttgtgggctgctggacacctgtgcaggtctttgtcctggttcaaggactgggtgttcagccaggtagtgagactgcagtagccattctgcgcttctgcacagccctgggctatgtcaacagttgtctcaatcccattctctatgctttcttggatgagaacttcaaggcctgctttagaaagttctgctgtgcttctgccctgcaccgggagatgcaggtttctgatcgtgtgcgcagcattgccaaggatgtaggccttggttgcaagacctctgagacagtaccacggccggcatga

SEQ ID NO: 1406 - DNA, 1197 bp, Mus musculus
atggacagcagcgccggcccagggaacatcagcgactgctctgaccccttagctcctgcaagttggtccccagcacctggctcctggctcaacttgtcccacgttgatggcaaccagtccgacccatgcggtcctaaccgcacggggcttggcgggagccacagcctgtgccctcagaccggcagcccttccatggtcacagccatcaccatcatggccctctattctatcgtgtgtgtagtgggcctctttggaaacttcctggtcatgtatgtgattgtaagatataccaaaatgaagactgccaccaacatctacattttcaaccttgctctggcagatgccttagccactagcacgctgccctttcagagtgttaactacctgatgggaacgtggccctttggaaacatcctctgcaagatcgtgatctcaatagactactacaacatgttcaccagtatcttcaccctctgcaccatgagtgtagaccgctacattgccgtctgccacccggtcaaggccctggatttccgtaccccccgaaatgccaaaattgtcaatgtctgcaactggatcctctcttctgccattggtctgcccgtaatgttcatggcaaccacaaaatacaggcaggggtccatagattgcaccctcactttctctcatcccacatggtactgggagaacctgctcaaaatctgtgtcttcatcttcgccttcatcatgccggtcctcatcatcactgtgtgttatggactgatgatcttacgactcaagagtgtccgcatgctgtcgggctccaaagaaaaggacaggaacctgcgcaggatcacccggatggtgctggtggtcgtggctgtatttattgtctgctggacccccatccacatctatgtcatcatcaaagcactgatcacgattccagaaaccactttccagactgtttcctggcacttctgcattgccttgggttacacaaacagctgcctgaacccagttctttatgcgttcctggatgaaaacttcaaacgatgttttagagagttctgcatcccaacttcctccacaatcgaacagcaaaactctgctcgaatccgtcaaaacactagggaacacccctccacggctaatacagtggatcgaactaaccaccagctagaaaatctggaagcagaaactgctccattgccctaa

SEQ ID NO: 1407 - DNA, 1167 bp, Mus musculus
atggagggcacgcccgcagccaactggagtatcgagttggacctcgggagtggagtgccaccaggggcggagggtaacctcacggccgggccgccacgacgcaacgaggccctggcgcgcgtggaggtggcggtcctgtgtctcatactgttcctggctctgagtggcaacgcgtgcgtgctgctggcgctgcgtacgacgcgccacaagcactcgcgcctcttctttttcatgaagcacctgagcatcgccgacctggtggtggccgtgttccaggttctcccgcagctgctgtgggacatcaccttccgcttctacgggcccgacctgctgtgtcgtctggtcaaatacttgcaggtggtgggcatgttcgcctccacctacctgctgttgctgatgtcgctcgaccgctgcctggccatctgccagccgctgcgctcactgcgccgccgaaccgaccgcctggcggtgctggcgacgtggctcggctgcctggtggccagcgtgccgcaggtgcacattttctcgctgcgcgaagtggcggacggcgtcttcgattgctgggcggtcttcatccagccctggggacccaaggcctacgtcacgtggatcacgctcgccgtctacattgtaccggtcatcgtgctggccgcctgctatggtctcatcagcttcaagatctggcagaatctgcgactcaagacggcagccgcggcggcagctgccgaggggagtgacgcagccggtggagctggccgtgcggcgttggcacgggtcagtagtgtcaagcttatctccaaggccaaaatccgcacagtgaagatgaccttcatcattgttctggccttcatcgtgtgctggacgcctttcttcttcgtgcagatgtggagcgtctgggacgtcaatgcgcccaaagaagcttctgccttcatcattgccatgctcttggccagcctcaacagctgctgcaacccatggatctacatgctcttcacgggccatctcttccacgaactcgtgcagcgcttcctctgctgctctgctcggtacctgaagggcagccggcctggagagacgagcattagcaagaaaagcaactcctccaccttcgtcctgagtcgttgcagctcgagtcagaggagctgttctcaaccatcctcggcatga

SEQ ID NO: 1408 - DNA, 1122 bp, Mus musculus
atgaccgaggtgccttggtcggttgtccccaacgggacggatgctgcctttctggcgggcctgggctcgctttggggaaacagtactgtcgcctcaactgcagcagtttcctcttcattccaatgtgccctgaccaagaccggtttccagttctactacctgccggctgtctacattttagtgttcatcataggcttcctaggcaacagcgtggctatctggatgttcgttttccacatgaagccttggagcggcatctccgtgtacatgttcaatttggctctggctgactttttgtatgtgctcaccctaccagccctcatcttctactacttcaacaagactgactggatcttcggggatgctatgtgcaagctgcagagattcatcttccacgtaaatctctatggtagcatcttgttcctcacctgcatcagcgcacacaggtacagtggcgtggtgtaccctctcaagtctctgggcaggctcaagaagaagaatgccatttatgtcagcgtgctggtgtggctcattgtggtggtggccatctcccctattctcttctactctggcactgggactcggaaaaacaaaactgtcacctgctatgacaccacgtccaatgattacctgcgaagttatttcatctacagtatgtgcacgactgtggccatgttctgcatccctttggtgctgatcttgggctgttatggattaattgttaaagctttgatttacaatgacctggacaactctccgctccggaggaaatccatttacctggtgataattgtcctgacggtgtttgctgtgtcttatatccctttccatgtgatgaaaacgatgaatttgcgagcacggttggatttccagaccccagaaatgtgtgatttcaacgacagggtttatgccacttatcaggtaacaagaggtctagcaagtctcaacagctgtgtggaccccattctttatttcttggctggagatacattcagaaggagactgtcccgagccaccaggaaagcttccaggaggagtgaggccaatttacaatccaagagtgaagaaatgactctcaatattttgtctgagttcaagcagaatggagacacgagtttgtga

SEQ ID NO: 1409 - DNA, 1044 bp, Mus musculus
atggatgtgcctggtgtcaacaccacctcagccaataccaccttctcccctgggaccagcaccctgtgcgtcagagactacaagatcacccaggttctcttcccattgctgtacaccgtcctgttctttgctgggctcatcacgaacagcttggcaatgaggattttctttcagatccgcagtaaatccaacttcatcatttttcttaagaacacggtcatctctgatctactaatgattctaacttttccatttaaaattcttagtgatgctaaactgggagccgggcctctgagaaccttggtgtgccaagttacttcagtcacattttattttacaatgtatatcagtatatcgttcctggggttgataaccattgaccgctacctgaagaccaccaggccatttaaaacgtccagccccagcaatctcttgggtgcaaagattctttctgttgtcatctgggccttcatgttcttaatttcactgcctaacatgattctcaccaacaggaggccaaaagataaggacgtaacaaaatgttctttcttaaagtcagagtttggtctagtttggcacgaaatagtcaattacatctgccaagtcattttctggattaattttttaattgtcatcgtttgttatagcctcattaccaaagaactctatcggtcttatgtcagaacaaggggttcagccaaagttcccaagaaaaaggtaaacgtcaaggttttcatcatcattgctgtattctttatttgctttgttcccttccactttgcacggattccctacaccctgagccaaactcgggccgtctttgactgcagtgctgagaacaccctgttctacgtgaaggagagcaccctatggctgacgtcactgaacgcctgccttgatccattcatctacttttttctttgcaagtctttcagaaattccttgacaagcatgctgaggtgctcaaactctacatcaacatctgggacaaacaagaagaaaggacaagaaggtggcgaaccaagcgaagagaccccaatgtag

SEQ ID NO: 1410 - DNA, 1122 bp, Mus musculus
atggcagcagacctggaaccctggaatagcaccatcaatggcacctgggagggggacgaactgggatacaagtgtcgcttcaacgaggacttcaagtacgtgctgttgcccgtgtcctatggcgtggtgtgcgtgctcgggttgtgcctgaacgtcgtggctctctatatcttcctatgccgcctcaaaacctggaacgcctccaccacctacatgtttcacctggcagtttcggactctctctacgcagcgtccctgccgctgttggtttattactacgcccggggtgaccactggccatttagcacggtgctctgcaagctggtgcgtttcctcttctacaccaacctctactgcagcatcctcttcctcacctgcatcagcgtgcaccggtgcctgggagtcctgcgccctctgcactccctgcgttggggccgggcccgttatgcccgccgggtggctgcggttgtgtgggtgctggtgctggcctgccaggcacccgtgctctacttcgtcaccaccagcgtgcggggaacccggatcacttgccatgacacctcggcccgagagctctttagccattttgtggcttacagctccgtcatgctgggtctgctttttgctgtgcccttttccgtaatcctggtctgttacgtgcttatggccaggcggctgctcaaaccggcttatgggaccacaggaggtctgcctcgggccaagcgcaagtctgtgcgcaccattgccttggtactggccgtcttcgccctctgctttctgcctttccacgtcacgcgcaccctctactactccttccgatcacttgacctcagctgccacaccctcaacgccatcaacatggcatataagatcacccggccgctggccagcgccaacagttgtcttgacccggtactctacttcctggcagggcagagacttgtccgctttgcccgagatgccaagccacccacggagcctacccccagcccacaggctcgtcgcaagctgggcctgcacaggcctaacagaactgtgaggaaagatttgtcagtcagcagtgacgactcaagacggacagagtccacaccagctggaagtgagactaaggacattcggctatag

SEQ ID NO: 1411 - DNA, 1086 bp, Mus musculus
atgaccagtgcagactccttgctattcacatcactaggtcccagcccaagttctggagatggtgattgtaagtttaatgaggaattcaagttcatcctgttgcctctgagctatgcagttgtctttgtgctgggcctggccctcaatgccccaaccctttggctgttcctcttccgccttcgaccctgggatgcaacagccacttacatgttccatttggcattgtcagacaccttgtatgtgctgtcactgcccaccctcgtctactactatgctgccagaaaccactggccctttggcactggcttctgcaagttcgtccgctttcttttctactggaacctctactgcagtgtccttttcctcacctgcatcagtgtgcaccgctacatgggcatctgccatccactgcgggcaatacgctggggccgccctcgatttgcaggtcttctctgcctaggtgtttggttggtagtagctggctgcctcgtgcccaacctcttctttgtgacaaccaatgccaatggaaccaccatcctgtgccatgacacgactctgcctgaggagtttgaccactacgtatacttcagttccacaatcatggtgctgctctttggctttcccttcttgatcactctggtctgctatggactcatggcccggcgactgtatcgacctttgccaggagctggacagtcatcttctcggctccgttctctccgcaccattgctgtggtgctgactgtctttgctgtctgctttgtgcctttccacatcacccgcacaatttattacctggcaagactgttgaacgccgaatgccgggtgctgaacattgtcaatgtggtttacaaagtgactcgtcccctggccagtgctaatagctgtcttgatccagtgctctatctgttcacgggggacaagtatcgaaaccagctccagcagctatgcagaggtagcacacctaagcgccgaacaactgcttcctccctggcattggtgaccctacatgaagaaagcatcagcaggtgggcggacatccaccaagacagcatcttccctgcttatgagggtgaccgattataa

SEQ ID NO: 1412 - DNA, 987 bp, Mus musculus
atggagcaggacaatggcaccatccaggctccaggcttgccgcccaccacctgcgtctaccgtgaggatttcaagcgactgctgctaaccccggtatactcggtggtgctggtggtcggcctgccactgaacatctgcgtcattgcccagatctgcgcatcccgccggaccctgacccgttccgctgtgtacaccctgaacctggcactggcggacctgatgtatgcctgttcactacccctacttatctataactacgccagaggggaccactggcccttcggagacctcgcctgccgctttgtacgcttcctcttctatgccaatctacatggcagcatcctgttcctcacctgcattagcttccagcgctacctgggcatctgccaccccctggcttcctggcacaagcgtggaggtcgccgtgctgcttgggtagtgtgtggagtcgtgtggctggctgtgacagcccagtgcctgcccacggcagtctttgctgccacaggcatccagcgcaaccgcactgtgtgctacgacctgagcccacccatcctgtctactcgctacctgccctatggtatggccctcacggtcatcggcttcttgctgcccttcatagccttactggcttgttattgtcgcatggcccgccgcctgtgtcgccaggatggcccagcaggtcctgtggcccaagagcggcgcagcaaggcggctcgtatggctgtggtggtggcagctgtctttgccatcagcttcctgcctttccacatcaccaagacagcctacttggctgtgcgctccacgcccggtgtctcttgccctgtgctggagaccttcgctgctgcctacaaaggcactcggcccttcgccagtgtcaacagtgttctggaccccattctcttctacttcacacaacagaagttccggcggcaaccccacgatctcttacagaggctcacagccaagtggcagaggcagagagtctga

SEQ ID NO: 1413 - DNA, 2704 bp, Mus musculus
aaagtctaagtgtggttctttcacatgcctgtagaggtttgtactactttttatcagcaggatatgtgcttgctgcccagagttgtacctttttactctcatctctttgcaaatatacaagactctatcccagctcagcatcagggagccataattccacagttttccttgccaaacatactgaaatattcaagatgggcagcaacagtaccagcagtgctgagagcaattgcaatgccacttatttgccatttcagtactctctgtatgcaactacctatatcttcatattcatcccgggtctcctggctaacagtgcagccctgtgggttctgtgccgcttcatcagcaagaagaacaaggccatcattttcatgatcaacctctcagtggcagaccttgctcatatcctgtccttacctcttcggatttactattatatcaatcgtcactggccattccagagggccctttgcctgctgtgtttctatctgaaatatctcaacatgtatgccagcatttttttcttgacatgcattagccttcagaggtgcctctttctcctcaaaccattcagagccagaaactggaagcgtaggtacgatgtgggcatcagtgctgtcatctggattgttgtagggactgcctgtttgccatttcccatcctgagaaatgctggcttagccaatagcacagattcttgctttgctgatcttgggtacaaacagatggatgcagtggttctggtcaccatggttgtaattgctgaacttgctggatttgtgattccagtgatcaccattgcatgttgtacctggaaaacaactgtatccttgaaacacccaccaattgcttttcaagggattagtgagaggaaaaaagcattgcggatggttttcatgtgtgctgcagtcttcgttatctgcttcactccttatcacattaacttcattttttacaccatggtaaaggaaagcatcattaccagttgtcccactgtaaaaagtaccctgtatttccatcctttttccctatgccttgcaagtctctgttgtcttttggacccaattctgtactatttcatggcttcagagtttcgtgaccaactatctcgtcatggaagctctgttactcgttctcgtctcatgagcagggagagtggatcatcaatggttaactaaaatgagaaaattcttcagttaggattctctttacctgacattctgtggcattgcccaaaggcaggaatttccaggcaaataatttctttaactgaaccttggaaatagcagaaataagttttattgtgtgatggttgtggtctccacagatgatggaggcataatgtgaaaaaatgtgggagtagaaagaaaaatgggatccatgtgcttccaatttaaaatttatggcattatattagttacaagtcccaatttaagttcaagtttttagcagatgtttccatccaaatataaattgaatgcatatatttaaatttgtcttcagtaaagagaatagtactgagatgcaaggtatatattaagatgtacagaagaataaatttcccccatggaataattttatttctgaatggagtaaagatttcaagtctttataaaacattacacacagacaaaatgacacaaaagtttcaatatgtgaatgaattttagcactgcactcttgctactgaatggtgtacatgaaaatccacctcatggatgttcgtagatgtccatcattttctaggttggcagtttgctatgtatttttacaaataatatttcatcttacttttccaatacaagcaacagtaaatgaggagattacaaatacaaatgaatgtaaatgtaatggcagagaggttaagcaacatgtctcacaattaacagttacatggcatatacttatgctatttcctctgcttatatttttatatgtattaggtcaatactaagtttgagttgaatgtggaggacacaaacagaagataagcataggaaatagagatagttttaacacaattttcctgtgctcatcgaaaaatctataatttggggattagcatgattctgggtagagtcttctgtgataaatatatcgtcatattagtgtaatcatctatatagtcttgatgagaaaaagctcaataattcattatttcaaaatcaatattatggctaatataagccatgcaaataacatgaataaaaagctatgaaactgagccgcattttagaaaatgtaggcttccttttaaaaattctctttttaaaaaaattcttacacattactatgtcactaaataaaatctcaatggttttcagatatcataactcacataattgcattagaaacagagtattaatcacattgtgaacaaatatgagagaaatatgtgaccttgtttttttctgagtgttatggatactattttaagtgttcatatagatgatacaaatagaacagaacccccatcttctcaagttgacaattcactggtattttaggtctgaaatgaacagagcatagacatttggtatgcaggcaagaaaaggaagtggtagtacttagaacatgcatttgtgtagactaaggaagaggaagggaccaccaaaaggaggaattaaaagaaaatttcttggttttgggggaatgagatagttctgtaattataatgtaataaagtgttttttaaaatttg

SEQ ID NO: 1414 - DNA, 1035 bp, Mus musculus
atggtaagctccaatggctcccagtgcccttatgacgactcctttaagtacactctgtacgggtgcatgttcagcatggtcttcgtgcttgggctgatatccaactgtgttgcgatatacattttcatctgtgccctcaaagtgagaaatgaaactacaacgtacatgattaacctggcaatgtcagatttacttttcgtctttactttgccatttcggattttttactttgcaacacggaattggccatttggagatctactctgtaagatttcagtaatgctgttttacaccaatatgtatggaagcattctgttcttaacctgtatcagtgtagatcgatttctggcaattgtctacccatttaagtcaaagactttaagaacgaaacgaaatgcaaagatcgtttgcattgctgtgtggttcacagtgatgggaggaagtgcgcctgcagttttctttcagtcgacccactctcaggggaacaatacctcagaagcctgctttgagaactttccagcggccacatggaaaacttatctctccaggattgtgattttcattgaaatagtgggcttttttatccctctcattttgaacgtaacttgttctagtatggtgctaagaactttaaataaacctgttacattaagtagaagcaaaatgaacaaaactaaggttttaaaaatgatttttgtccacttggtcatcttctgtttctgttttgtgccctacaacatcaacctcattttgtactcgctcatgaggacacagacctttgttaactgctctgtggtggcggcagtgaggaccatgtacccgatcactctctgcatcgctgtttccaactgctgctttgaccctattgtttactacttcacctcagacacaattcagaactcaataaaaatgaaaaactggtcggttagaagaagtgactccaggttctctgaagttcagggcactgagaattttatccaacacaacctacagaccttaaaaaataagatatttgataatgaatctgcaatataa

SEQ ID NO: 1415 - DNA, 1468 bp, Mus musculus
cccagctgcccgcccgcggccggtgcgcgggccgccgcccagcgagcgctgcgaagctggggtgagctgccatgtggagctgtggcccactcaacagcacagcgtgggctgaggagccgctgtgccggaacctgcgcctggggctgtgggtcctctcgctgctctacctgggggcaggggtccctgtgagcttaggctataatgctcttctggtgctggccaacctggccagcaagaacaccatgaccatgcccgacgtgtacttcgtgaacatggccgtggcggggctggtgctcacggcactggcacctgcgtacctgttgggccctgcccactccaggtgggccctgtggagcctcagcagtgaggcccatgtgacactgctcatcctgttcaacgtggcttccctggtgaccatgtactccactgcactgctgagccttgactactacatcgagcgtgccctgccacgcacctacatggccagtgtgtacaacacccggcacgtgtgtggcttcgtctggggaggggcggtgctcaccagcttctcctccctgctcttctacatctgcagtcacgtgtcttctagaatcgctgagtgtgcccggatgcagaacacggaggcagccgatgctatccttgtggtcatcggctacgtggtgccaggtctggctgtgttgtatgccctggcactcatctcgagaatcgggaaggaagacacacccctggaccaggacaccagcaggctggacccctcggtgcacaggctgctggtggccaccgtgtgcactcagtttggcctctggacaccttactacttgagcctggggcacacagtgctgacgtcacgggggaggaccgtggaggggcattatctgggcatcctacaggttgctaaggacctggccaagttcctggccttctcaagcagttctgtgacaccactgctctaccgttacatcaacaaagccttccccggcaagctccggcggctgatgaagaagatgcactgcgggcgccgccactgctcccccgacccctcggggatacagcaggtgatggcacaggcgtagctaaccctccctgggctgaccacgaggaacactaaaactcaactggacacatagcactttgttccccaggcacatggagcttccagcccaggagacacgctgaagccagagatgcacagcggggcatttctcttgatgtttcctgttttcccctaaaaggccaaccttggtcttatgctgcatggtggaaagcagaggtgccctgtgtgaacaggctgcttctgactaaccttcccaccttctccctcaaggtgtgtgcctttctcccagggacatcttcaaggtccatgtcctcacaagcaggctgaccttcggcctccctggtatttgggctttctaaatgaagcgatgaaatctaaagccagtatttatacttcaaaaaaaaaaaaaaaaaa

SEQ ID NO: 1416 - DNA, 1011 bp, Mus musculus
atgagagctgtcctcctcccgggctctggagagcagcctacagcgttctgctaccaggtgaatgggtcttgccccaggacagtccacccgctggccatccaggtcgtcatctatctggcctgcgcagtgggtgtgctgatcacagtcctggggaatttgtttgtggtgtttgcagtgtcctactttaaagtgctccacacgcccaccaacttcctgctgctctccctggccctggcagacatgttgctaggtctgctggtgctgcccctgagcacagtccgctctgtggagagctgctggttctttggagacttcctgtgccgtctgcatacctatctggacacgctgttctgtctcacctccatcttccatctctgttttatttccattgaccgtcattgtgccatctgtgaccccctgctctatccctccaagttcacagtcaggacagccctccgctacatcgtggcagggtgggggataccagcagcctacactgccttcttcctctacacagatgtggtagagagagcactcagccagtggctagaagagatgccttgtgtgggcagctgccagctgctgttcaataagttctggggttggttaaacttccctgcattttttgttccctgcctaatcatgatcagcttgtacctgaagatctttgtggtcgccaccaggcaggctcagcagatcagaactctgagccaaagcttggctggggctgtcaagcgggaaagaaaagctgccaagacgctgggcattgctgtgggcatctaccttgtgtgttggcttcccttcactgttgacacactagtggacagccttcttaacttcatcaccccacccctggtctttgacatctttatctggtttgcttatttcaattcagcctgtaatcccatcatctacgtcttctcctaccggtggtttaggaaggcactgaaactgctcctgagccgggagatcttctcaccaaggacaccgactgttgatttataccatgac

SEQ ID NO: 1417 - DNA, 1128 bp, Mus musculus
atgaatacctctcatttcttggcccctctcttcccaggatccctacagggtaagaatgggaccaatccattggattccccctataatttctctgatggctgccaggattcggcagaactgttggccttcatcatcaccacctacagcattgagaccatcttaggggtcctgggaaacctctgcttgatatttgtgaccacaagacaaaaggaaaagtccaatgtgaccaacctactcattgccaacctggccttctctgacttcctcatgtgcctcatctgccaaccactcacagtcacctacaccatcatggattactggatctttggtgaagtcctttgcaagatgttaactttcatccagtgtatgtcagtgacagtctccatcctctcactggtccttgtggccctggagagacaccagctcattatcaatccaacaggctggaaacccagtattttccaggcctacctggggattgtggtcatctggttcatctcttgtttcctttccttgccgttcctggccaacagcaccctgaatgacctcttccactacaaccactctaaggttgtagagtttctggaagacaaggtcgtctgctttgtgtcctggtcttcagatcaccaccgtctcatctataccacctttctgctgctctttcagtactgcatccctctagccttcatcctggtctgctacatacgcatctaccagcgcctgcagaggcagaagcatgtgttccatgcgcacgcttgcagctcacgagcggggcagatgaagcggatcaacagcatgctcatgacaatggtgactgcctttgcagttctctggctacccctgcatgtgttcaacactctggaggactggtaccaggaagccatccctgcttgccatggcaacctcatcttcttgatgtgccacctgttggccatggcttccacctgtgtcaaccctttcatctatggctttctcaacatcaacttcaagaaggatatcaaggctctggtgctgacctgccattgcaggtcacctcaaggggagtctgagcatctgcccctgtccactgttcacacggacctctccaagggatcgatgaggatgggtagcaagtctaacttcatatag

SEQ ID NO: 1418 - DNA, 1026 bp, Mus musculus
atggagcacaatggctcctttcgtgtggattctgagtttcgatacacgctctttccgattgtttacagtgtcatctttatactgggggtggttgccaacggctatgtgctatgggtctttgctaacttgtacccttccaagaaactaaatgagataaagatctttatggtgaatctcactatggctgacctgctcttcctgatcaccctcccactgtggattgtctactactacaacgagggcgactggattctacccaacttcctgtgcaacgtggctggctgcctcttcttcatcaatacctactgcagtgtggcctttttgggtgtcatcacttataaccgctaccaggcagtagcctatcccatcaagactgcacaggccaccacccgcaagcgtggcatctctttgtccctgatcatttgggtatccattgtggctactgcatcctatttcctggccacagactccaccaacctagtgcccaataaggatggctcaggcaacatcacccgctgctttgagcattatgagccatacagtgtgcccatccttgttgttcatgtcttcatcgccttctgcttcttcctcgtcttcttccttatcttctactgcaacttggtcatcatccacacgctgctcacgcagcccatgaggcagcagcgcaaagcgggggtgaagcggagggcgctgtggatggtctgcacggtcttggcggtattcatcatctgttttgtgccccatcacgtggtccagctgccctggaccctagcagagttgggctaccagaccaacttccatcaggctattaatgatgcccatcaaatcaccctctgcctcctcagcaccaactgtgtcttagatcccgttatctattgctttcttaccaagaagttccgaaagcacctcagtgagaagttttacagcatgcgcagtagccggaagtgctccagagccacgagtgacacgtgcaccgaggtgatagtgccagccaaccagactcctattgtgtcgctgaaaaattaa

SEQ ID NO: 1419 - DNA, 1074 bp, Mus musculus
atgaacgagtcctatcgctgtcagacatccacctgggtggaaaggggctcctcggcgacgatgggcgctgtgctcttcggtgcggggcttctgggcaatcttctggcgctggtgctgctggcgcgctcgggactggggtcttgccggccagggccactacacccgccgccctcggtcttttatgtgctcgtgtgtggcttgacggtcaccgacttgctgggcaagtgtctgatcagcccgatggtcctggctgcctacgcgcaaaaccagagcctaaaggaactgctgcctgcctcaggcaatcagttatgcgaaacgttcgccttcctgatgtccttctttgggctagcctcgaccttacagctgttggctatggcggtggagtgctggctgtctctgggacaccccttcttctaccaaaggcacgtcaccttgcgccggggagtgctggtggcaccggtcgtggccgccttctgcttggctttctgtgcgctcccctttgctggttttgggaagttcgtgcagtactgtccaggcacctggtgtttcatccagatgatccacaaggagcgttcattttcggtaataggcttctctgtgctctactccagcctcatggcgctgctggtcctcgcaaccgtggtgtgcaacctgggtgccatgtacaacctctatgacatgcacaggcgccagaggcactatcctcaccgctgctccagggaccgcgcccagtcaggctcagactacaggcacgggtccctgcatcctttggaggagctggaccactttgtgctgctggctctcatgacagtgctcttcaccatgtgttccctgcctttaatttatcgtgcgtactatggagcctttaaacttgagaacaaagctgaaggagactcagaagacctccaagccttgcgtttcctgtctgtgatttccatagtggacccctggatcttcatcatcttcaggacttcagtattccggatgttatttcacaaggttttcacaagacctctgatctacagaaactggagcagccattcccagcaaagtaacgtggaatccactttgtga

SEQ ID NO: 1420 - DNA, 1218 bp, Mus musculus
atgagcccctgcgggcttaacctgagcctagcggatgaggcagcaacgtgcgcaacacccaggctccccaatacatctgtggtgctgccaacaggcgataatggcacatcaccagcgctgcctatcttctccatgacgctgggtgctgtgtccaacgtgctggcgctggcgctgctggcccaggttgcaggccgaatgcggcggcgccgctcggctgccaccttcctgttgttcgtcgccagcctgcttgccatcgacctagcaggccatgtgatcccgggcgccctggtgcttcgcctgtatactgcggggcgtgcgcctgctggaggggcgtgtcatttcctgggtggctgcatggtcttcttcggcctgtgcccacttttgcttggctgtggcatggccgtagagcgctgtgtgggtgtcacgcagccactgatccacgcggcgcgcgtatctgtggcccgcgcacgcctggcactagccgtgctggctgccatggctttggcagtggcgctgctgccactggtacacgtgggtcgctacgagttacagtaccctggcacctggtgttttattagccttgggcctcgtggaggttggcgccaggcgttgcttgccggcctcttcgccggccttggcctggccgcgctccttgcggcattagtgtgcaatacgctcagcggcctggcgctcctccgtgcccgctggagacggcgtcgctctcgacgattccgaaagaccgcaggtcccgatgatcgccggcgctggggatctcgtggaccccgcttggcctccgcctcgtctgcctcatccatcacttcagccacagccaccctccgcagctctcggggcggcggctccgcgcgcagggttcacgcacacgatgtggaaatggtgggccagctcgtgggcatcatggtggtgtcgtgcatctgctggagccccctgctggtgttggtggtgttggccatcgggggctggaactctaactccctgcagcggccactctttctggctgtacgcctcgcatcgtggaaccagatcctggacccatgggtgtacatcctgctgcgccaggccatgctgcgccaactgcttcgcctcctacccctgagggtcagtgccaagggtggtccaacggagctgggcctaaccaagagtgcctgggaagccagttcactgcgtagttcccggcacagtggtttcagtcacctctga

SEQ ID NO: 1421 - DNA, 1089 bp, Mus musculus
atggacaattttcttaatgactccaagctaatggaggactgcaagagtcgtcagtggctcctttcgggggaaagcccagccatcagctcggtgatgttctcggccggggttctggggaatctcatcgcactggcactgttggcgcgccgctggcgtggggacaccgggtgtagcgccggcagcaggacctctatctccttgtttcacgtgctggtaacggaattggtgctcactgacctgctgggaacctgcctcatcagcccggtggtgctggcttcatattcaagaaaccagaccctggtggccctggctcccgaaagtcacgcgtgtacctatttcgctttcactatgaccttctttagtctggccacgatgctcatgctcttcgctatggccctggaacgctacctctccatcgggtacccttacttctacaggcgccacttatcgcgccgcgggggtctggcggtgctgcctgtcatctatggggcctccttgctcttctgttccctgccgctgctcaactacggggagtacgtccagtactgtcctgggacatggtgctttatccggcacgggaggactgcataccttcagctgtacgccacgatgctcctgctgcttatcgtggctgtgctcgcctgcaacatcagcgttatcctcaacctcattcgcatgcaccgtcggagcagaagaagccgctgcggattgtctggcagtagcctaagaggccctggatctcgcaggagaggagagaggacttcgatggcagaggagacggaccacctcattctcctggccattatgaccatcaccttcgccatatgctccttgcctttcacaatctttgcctacatggatgaaacctcttccctaaaggaaaagtgggacctccgagctcttcggtttttatcagttaactctataattgacccttgggtctttgccatacttaggccaccggtcctgaggttaatgcgctcagtcctctgttgtcggacttcactgagaacacaagaagctcagcaaacatcctgttctacccagtccagtgccagtaaacagactgacctttgtggacagttgtga

SEQ ID NO: 1422 - DNA, 1098 bp, Mus musculus
atggctagcatgtgggcgccggagcactctgctgaagcgcacagcaacctgtcaagtactaccgacgactgcggctccgtgtccgtggcctttcccatcaccatgatggtcactggcttcgtgggcaacgcgctggccatgctgctcgtgtcgcgcagctaccggcgccgcgagagcaagcgcaagaagtctttcctgctgtgcattggctggctggcgctcaccgacttagtggggcagctcctgaccagcccggtggtcatcctcgtgtacctgtcacagcgacgctgggagcagctcgacccatcggggcgtctgtgcaccttcttcgggctaaccatgacagtgttcgggctatcctcgctcctggtggccagcgccatggccgtggagcgcgccctggccatccgtgcgccgcactggtatgccagccacatgaagactcgcgccacgccggtactgctgggcgtgtggctgtctgtgctcgccttcgcgctgctgccggtgctgggcgtgggccgctacagcgtgcagtggccgggcacgtggtgcttcatcagcaccgggccggcgggcaacgagacagaccctgcgcgcgagccgggcagcgtggcctttgcctccgccttcgcctgcttgggcttgctggctctggtggtgacctttgcctgcaacctggcgaccatcaaagccctggtgtcccgctgtcgggccaaagccgccgtctcgcagtccagcgcccagtggggcagaatcaccacggagacggccatccagctcatggggatcatgtgtgtgctgtccgtctgttggtcgccgctattgataatgatgttgaaaatgatcttcaatcagatgtcggttgagcaatgcaagacacagatgggaaaggagaaggagtgcaattcctttctaattgcagttcgcctggcttcgctgaaccagatcttggatccctgggtttatctgctgctaagaaagatccttcttcggaagttctgccagatcagagaccacaccaactatgcttccagctccacctccttgccctgcccaggctcctcagccctgatgtggagtgaccagctggaaagatga

SEQ ID NO: 1423 - DNA, 1542 bp, Mus musculus
atggctgaggttggaggtaccattcctagatcgaaccgtgagctccaacgctgtgtgttactaaccaccaccatcatgtccatccccggagtcaacgcgtccttctcctccactccggagaggctgaacagcccggtgaccattcccgcagtgatgttcatcttcggggtggtgggcaacctggtggccatcgtagtattgtgcaagtcgcgcaaggagcagaaagagacgaccttttacactctagtatgtgggctggctgtcactgaccttctgggcaccttgttggtaagcccggtgaccatcgccacatacatgaagggccagtggcccggagaccaggcactgtgtgactatagcaccttcatcctacttttcttcggtctgtcgggtctcagcatcatctgtgccatgagcatcgagcgctacctggccatcaaccacgcctacttctacagccactacgtggacaagcggctggccggcctcacactcttcgccatctatgcatctaacgtgctgttctgcgcgctgcccaacatgggcctgggcagatccgagcggcagtacccgggcacctggtgcttcatcgactggaccaccaacgtaacggcctacgccgccttctcttacatgtacgccggcttcagctccttcctcatccttgccaccgtgctctgcaacgtgctggtgtgcggcgcgctgctccgcatgcaccgccagttcatgcgccgcacctcgttgggcacggagcagcaccatgcggctgccgccgccgcggtagcttcggtggcctgtcggggccacgctggggcctccccagccctgcagcgcctcagcgactttcgccgccgcaggagtttccggcgcatcgcgggtgcggagatccagatggtcatcttactcatcgccacctctctggtggtgctcatctgctccattccgctcgtggtgcgagtgttcattaaccagttatatcagccaaacgtggtgaaagacatcagcagaaacccagatttgcaggccatcaggattgcttctgtgaaccccatcctggacccctggatttacatccttcttcggaagactgtgctcagtaaagccatagagaagatcaagtgcctcttctgccgcattggcggttccggcagagacagctcggcccagcactgctcagagagtcggaggacatcttccgccatgtccggccactctcgctccttcctcgcccgggagttaaaggagatcagcagcacgtcccagaccctcctgtacctgccagacctgactgaaagcagcctcggaggcaggaatttgcttccaggttcgcatggcatgggcctgacccaagcagacaccacctcgctgagaactttgcgaatttccgagacctcagactcctcccagggccaggactctgagagtgtcctgttggtggatgaggttagtgggagccacagagaggagcctgcctctaaaggaaactctctgcaagtcacattccccagtgaaactctgaaattatctgaaaaatgtatatag

SEQ ID NO: 1424 - DNA, 1101 bp, Mus musculus
atgtctatgaacagttccaagcagccagtgtctcctgcagctggactcatcgcaaacacaacctgccagacggagaaccggctttcagtatttttttctatcatcttcatgacagtggggatcttatcgaacagcctggccatcgccattctcatgaaggcctaccagagatttagacagaagtcaaaggcttccttcctgcttttggctagtggcctggtgatcacagacttctttggccaccttatcaacggaggcatagctgtctttgtatatgcttctgataaagactggatccgctttgatcagtcaaacatcctgtgcagtatttttggaatctccatggtcttttctggcttgtgcccactttttctaggcagtgcgatggccatcgagaggtgtataggagtcaccaatcctatatttcactctacgaagatcacatctaaacacgtgaaaatgatcctgagtggtgtgtgcatgtttgctgtgttcgtggctgtgctgcccatccttggacaccgagattatcaaatccaagcgtccagaacctggtgtttctacaacacagagcacatcgaagactgggaagacagattttatctcctgttcttttctttcctcggactcttagctcttggtgtttccttctcgtgcaatgccgtcacgggagtcacactcttaagagtgaagttcagaagccagcagcataggcaaggcagatctcaccacctggagatgatcattcagctcctggccataatgtgcgtctcctgcgtctgctggagtccctttctggtaacaatggccaacattgcaataaatggaaataattccccagtgacctgtgaaacgacactttttgctctccgcatggcaacgtggaatcagatcttagatccctgggtctatattctgctacggaaggctgtccttaggaacctgtataaacttgccagtcgttgctgtggagttaacatcatcagcttgcatatctgggaactcagctccatcaagaattccttaaaggttgctgctatttctgagtcaccagctgcagagaaggagagccagcaagcatcgagtgaagctggactgtaa

SEQ ID NO: 1425 - DNA, 1254 bp, Mus musculus
atgaagatgatggccagcgatggacatcctggacccccttctgtcactcctgggagccctctcagtgcaggtggcagagagtggcagggcatggcaggctcctgctggaatatcacctacgttcaagactcggtaggacctgccaccagcacgctgatgttcgtggctggtgtagtgggcaacgggctggcattgggcatcctgggtgcccgacggaggtcacacccatcggcctttgcggtgttggtcactgggctggcggtgacggatctgctgggcacgtgcttcttgagccctgcagtgtttgtggcctatgctcgaaacagctctctgctgggcctggcccacggtgggacgatgctgtgtgacactttcgccttcgccatgacgttcttcggcctggcctccacgctcatcctctttgccatggctgtggagcggtgcctggcactcagtcacccctacctgtacgcccagctggacgggccgcgctgcgcccgctttgccttgccttccatctacgctttctgctgcctcttctgctcactgcccctgctgggcctgggcgagcatcagcagtattgcccagggagctggtgcttcatccgcatgcgttccgcccagcctggcggctgtgccttctccctggcctacgccagtctcatggccctgttggtgacctccatcttcttctgcaacggctccgtcactctcagcctctatcacatgtaccgccaacagagacgccaccatggctcgtttgtaccgacctctcgggcacgagaggatgaagtttaccacctgattctgctggccctcatgaccgtcatcatggccgtgtgctccctgcctctcatgatccgaggcttcactcaggccatcgccccagacagcagagagatgggggacctcctcgccttccgcttcaacgccttcaaccccatcctggacccctgggtcttcatccttttccgaaaggctgtcttccaacgcctcaagttctggttgtgttgcctgtgtgcccgttctgtccatggggatttgcaggcgcccctttccagacctgcatcggggagaagagacccaccggctcctacttctctccaggctaaggaagggagctgggtgcccctgtcgtcctggggcacgggacaggtggcaccattgactgctgtgcctctgactggtggtgacggctgctctgtgggaatgccatccaagtcagaggccatcgctgcctgctccctctgctga

SEQ ID NO: 1426 - DNA, 1776 bp, Mus musculus
atggggaccgcccggatcgcacccagcctggcgctccttctctgctgcccagtgctcagctccgcatatgcgctggtggacgcagacgatgtctttaccaaagaggaacagattttcctgctgcaccgtgcccaggcgcaatgtgacaagctgctcaaggaagttctgcacacagcagccaacataatggagtcagacaaagggtggactccagcatctacgtcagggaagcccaggaaagagaaggcaccgggaaagttctaccccgagtctaaagagaacaaggatgtgcccaccggcagcaggcgccgagggcgtccctgtctgccagagtgggacaacatcgtttgctggccattgggggcaccaggtgaagtggtggcagtaccttgtcccgattacatttatgacttcaaccacaaaggccatgcctacagacgctgcgaccgcaatggcagctgggaggtggttccagggcacaaccggacgtgggccaactacagcgagtgcctcaagttcatgaccaatgagactcgggaacgggaggtatttgaccgcctgggcatgatctacaccgtgggatattccatgtctcttgcctccctcaccgtggctgtgctcatcctagcctattttaggcggctgcactgcacgcgcaactacatccacatgcacatgttcctgtcgtttatgctgcgcgccgcgagcatcttcgtgaaggacgctgtgctctactctggcttcacgctggatgaggccgagcgcctcacggaggaagagttgcatatcatcgcgcaggtgccgcctccgcccgccgctgccgccgttggctacgctggctgccgtgtggccgtgaccttcttcctctacttcctggctaccaactactactggattctggtggagggactgtacttacacagcctcatcttcatggcctttttctcagagaagaagtatctgtggggcttcaccatctttggctggggtctgccggctgtcttcgtggctgtgtgggtcggtgtcagagcaaccttggccaacactgggtgctgggacctgagctctgggcacaagaagtggatcatccaggtgcccatcctggcatctgttgtgctcaacttcatcctctttatcaacatcatccgggtgcttgccactaagcttcgggagaccaatgcgggccggtgtgacaccaggcagcagtaccggaagctgctcaggtccacgttggtgcttgtgccactcttcggtgtccactacaccgtcttcatggccttgccgtacaccgaggtctcagggacactgtggcagatccagatgcactatgagatgctcttcaactccttccagggattttttgttgccatcatatactgtttctgcaatggtgaggtgcaggcagagattaggaagtcttggagccgctggacactggcattggacttcaagcgtaaagcacgaagtgggagtagcagctacagctatggcccaatgggtgcacacacgagtgtgaccaatgtgggcccccgtgcaggactcagccttccccttagcccccgcctgcttcctgccaccaccaatggccactcccagctgcctggccacgccaagccgggcgctccagccattgagaacgaaaccataccagttactatgacagttcccaaggacgacggcttccttaatggctcctgctcgggtctggatgaggaggcctctgggtctgcgcggccacctccattgttgcaggaagaatgggaaacagtcatgtga

SEQ ID NO: 1427 - DNA, 1641 bp, Mus musculus
atggcctggctggagactttcacctacatttgtggatggctgattctcagtagctgtctcctggttagagcgcagctggattctgacggcaccatcactatagaagagcagattgttcttgttatgaaggctaaaatgcagtgtgaacttaacatcacagcccagctccaagaaggagaaggcaattgcttcccagaatgggatgggatcatttgttggcccagaggaacagtggggaaaatgtcagctgtgccttgccctccgtatgtttacgacttcaatcataaaggagttgctttccggcactgcacccccaatgggacgtgggattctattcatggctcaaataaaacctgggctaactattcagactgctttctgcagcctgatatcaacataggaaagcaagagttctttgaaagcctctacatcctgtacactgttggctactccatctcttttggctccttggctgtagccattctcattattggctacttcaggcgattgcattgcacgaggaactatatccatttgcatttgttcgtgtccttcatgctgagagccatgagcatctttgtcaaggacagagtagcccaggctcacctgggagtagaggcactgcagtctctggtgatgcagggtgaccttcagaacttcattggaggaccatctgtggacaaatctcagtatgtggggtgcaagatcgctgtcgtgatgtttatttatttcttggctacaaactattactggatcctggtggaagggctctacctgcacaacttaatctttgtgtctttcttttccgacaccaaatacctgtggggcttcatctcgataggctggggatttccagcggtatttgttgttgcctgggcagtggcacgagccactctggcggataccaggtgttgggaacttagtgctggagacaggtggatttaccaggctccgatcttagctgctattgggctgaattttattctgttcctgaatacagttagagttcttgctaccaaaatttgggaaaccaatgcggttgggcatgacatgagaaagcagtacaggaaactggctaagtcaacactggtcctggtgctggtatttggcgtgcattacatcgtgtttgtctgccagccgcactccttctctgggctctggtgggagatccgcatgcactgtgaactcttcttcaactccttccagggtttcttcgtgtctattgtctattgctactgcaatggagaggtgcaggctgaggtgaagaagatgtggactcgatggaatctgtccatcgactggaaaagggcgccgccttgtggcggccaaaggtacggctcggtgctcaccactgtcactcacagcaccagcagccagtcacagatgggggcaagcacgcgcctggtgctcatctctggcaaacccaccaagaatgcctgcagacagatcgacagccatgtgactctacctggctatgtctggagtagttctgagcaggactgccaaacacactcgccccccgaggagactaaggaaggtcacaggcgacagggagatgatagtccagtgatggagtcttccaggccagtggcgttcaccctagacactgaaggatgcaagggagaaacccatcctatctga

SEQ ID NO: 1428 - DNA, 1068 bp, Mus musculus
atgactactcctagagctgcccctagcggttgccgctcagacctggattccaggtaccacagactttgtgacctggcggaaggctggggcatcgcgttggaaacactggctgccgtcggggctgtggctaccgtggcttgcatgtttgcactcgttttcctcatctgcaaagtgcaggactccaacaaaagaaagatgctccccgcccagttcctcttcctcctgggagtgctaggggtctttggcctcaccttcgccttcatcatcaagctggatggggccacaggacccacgcgcttcttcctcttcggagtcctcttcgccatctgcttctcttgcctcctggcccacgctttcaacttgatcaagctggtccgagggaggaagcccctgtcgtggcttgtgatcctcagcctggcggtgggcttcagcctggtccaggacgtcattgccattgaatacctggtcctcaccatgaacaggaccaacgtcaatgtcttttctgagctgcctgctcctcggcgcaatgaggatttcgtcatgctcctcatttacgtgctcgtcttgatggtgctgaccttcttcgcatccttcttggttttctgtggatccttctctggctggaagagacacgggttccacatatgcttcacctcgttcctctccattgccatctgggtggcctggatcgttctgctcctgattcccgacattgaccggaaatgggatgataccattctcagcacagccttggtggccaacggctgggttttcctggcgttttatatcttgcccgagtttcgacagctcccaaggcaacggagccccactgattacccagttgaagatgctttttgtaaacctcagctcatgaagcagagctatggtgtggagaacagagcctactcccaagaggaaatcacccaaggtcttgagatgggggacacactctatgcaccttattccacccattttcagttacagaatcaccaaaaggatttctctatcccgagggcccaggccccggccagtccgtacaatgactacgaagggcgcaaaggcgacagc

SEQ ID NO: 1429 - DNA, 1089 bp, Mus musculus
atggatgtgcacttgtttgactatgcagagcctggcaactactctgacatcaactggccatgtaacagcagcgactgcattgtggtggacactgtgcagtgtcccaccatgcctaacaagaacgtgcttctgtataccctctccttcatctacattttcatcttcgtgatcggcatgattgccaactctgtggtggtctgggtgaatatccaggctaagaccacaggctacgacacgcactgctacatcttgaacctggccattgcagacctgtgggtcgtcatcaccacccccgtctgggtggtcagtctcgtgcagcataaccagtggcccatgggggagctcacatgcaagatcacacacctcattttctccatcaacctctttgggagcatcttcttcctcgcctgcatgagcgtggaccgctatctctccatcacctacttcaccggcacctccagctataagaagaagatggtacgccgtgttgtatgcatcttggtgtggctgctggccttctttgtgtccctgcctgatacctactacctgaaggcggtcacatctgcttccaacaatgagacctactgcaggtccttctaccccgagcacagcatcaaggagtggctgatcggcatggagctggtctctgtcatcttgggctttgctgtccccttcactatcattgcgatcttctacttcctgctcgctagagccatgtcagcatcaggcgaccaggagaagcacagtagccggaagatcatcttctcctacgtggtggtcttcctggtatgttggctgccgtaccattttgtggttctgctggacatcttctccatcttacactacatcccgtttacctgtcagctggagaatgtgctctttacagcgttgcatgtcacccagtgcctgtccttggtgcactgctgtgtcaaccccgtgctctatagcttcatcaaccgcaactacaggtacgagctgatgaaggccttcatcttcaagtactcggccaaaacaggtctcaccaagctcattgatgcctccagagtgtcagagacagagtactctgccctggaacagaacaccaagtga

SEQ ID NO: 1430 - DNA, 876 bp, Mus musculus
atggcagcaaccagggccctgcctgctggtttgggggaacttgaggtgctggctgtaggaacagtcctgctgatggaagcgctctctggcatcagcctcaatggcctgaccatcttctctttctgcaagactccagatctgcggactcccagcaacctgctggtactgagcctggccctggcagacactgggatcagcctgaatgcccttgttgcagcggtatccagcctcctccggcgctggccacatggttcagagggctgccaggttcatggtttccagggatttgcaacagcactggccagcatctgtggcagtgcagccgttgcctggggacgttatcaccactactgcacccgcagacagttggcatgggacacggccatccctctggtgctgtttgtgtggatgtcatctgccttctgggcatccctgcccctgatgggctggggccactatgactatgagcctgtggggacatgctgtacactggactattcgaggggtgacagaaacttcatcagttttctcttcaccatggcttttttcaacttcctcgtacccctgttcatcacacacacttcataccggttcatggagcagaaattctccaggagtggccatctcccggtgaatactactcttccaggcagaatgctgctgcttggctggggcccctatgccctcctgtacctatacgcagccatcgcagatgtgagcttcatctctcctaaactacagatggtgcctgctctcatcgccaaaaccatgcccacaatcaacgccatcaactatgcgttgcacagggagatggtctgtagaggaacctggcagtgtctgtctccacaaaaaagcaagaaggaccgaacccagtga

SEQ ID NO: 1431 - DNA, 3249 bp, Mus musculus
cgtcagtggctgagctcgccaagcagccttggtctctgtctacgaagagcccgtggggcagcctcgagagccgcagccatgaacggcacagagggccccaatttttatgtgcccttctccaacgtcacaggcgtggtgcggagccccttcgagcagccgcagtactacctggcggaaccatggcagttctccatgctggcagcgtacatgttcctgctcatcgtgctgggcttccccatcaacttcctcacgctctacgtcaccgtacagcacaagaagctgcgcacacccctcaactacatcctgctcaacttggccgtggctgacctcttcatggtcttcggaggattcaccaccaccctctacacatcactccatggctacttcgtctttgggcccacaggctgtaatctcgagggcttctttgccacacttggaggtgaaatcgccctgtggtccctggtggtcctggccattgagcgctacgtggtggtctgcaagccgatgagcaacttccgcttcggggagaatcacgctatcatgggtgtggtcttcacctggatcatggcgttggcctgtgctgctcccccactcgttggctggtccaggtacatccctgagggcatgcaatgttcatgcgggattgactactacacactcaagcctgaggtcaacaacgaatcctttgtcatctacatgttcgtggtccacttcaccattcctatgatcgtcatcttcttctgctatgggcagctggtcttcacagtcaaggaggcggctgcccagcagcaggagtcagccaccactcagaaggcagagaaggaagtcacccgcatggttatcatcatggtcatcttcttcctgatctgctggcttccctacgccagtgtggccttctacatcttcacccaccagggctccaacttcggccccatcttcatgactctgccagctttctttgctaagagctcttccatctataacccggtcatctacatcatgttgaacaagcagttccggaactgtatgctcaccacgctgtgctgcggcaagaatccactgggagatgacgacgcctctgccaccgcttccaagacggagaccagccaggtggctccagcctaagcctggccagagactgtggctgaaagtaggagtctcctgtccccacacaccccagccacagcccccaccaggagcagcacccgttgggatgaggtcatgcaggctccctcagtgttcttttctttgtttttaatgaattcatgaaagcaaaatgaggctccccactcaatggggacagcttgacaaagggcatccatccaccaagaccatcctcaacctggagtccccaattcccggggggccagcgggatctgtacccctccctcagcttgtctatcaggaacatgacaagtgtcccggcttagggctaaatgtctaggacagaatggaacacatagtagctgattaataaatgctagctggatgaagggaggaatgagtgactgactgagtggatatatgagtgaagggattaatggaagggaacatggatgtcctcaggtgcccaacctggcagatccagtcatgtctggctggaatctataagcagttttacatacctgccctggttttctctgcccccacccccaccccagttggatctcccaaatccagggccctgatagaatatggctgcttcaaagacagagagatgaggggagggaggggggagggagagagggagggagggagacacagagagggaatatgtgtgatgcgtgtgtatgtgtgtatgtgtgtgtgtaaacactttgtatataaagagtacagctggtagttatgttacaagtaacaccgactaatataattaattaaccatcctaatggtctctgcttgttagtgactgcttgggaattaggcagggcccaagcactcagataaggtatttccctcagcctcagtaggcttttgcaaatgacccaggccttcaggcctgtgcagggctagagctggattacagagataaatgacagtgacagcaacgtgagctgcagcccttaggactgagaaagcatcgagaccaggggtctccggcaaggcctaggtcctcccttcagtatggaaaccttgcctcatgtctctcagcctccttggcctgtggagatccagcccttcctcttggcttctggatacatttgctcttctacaccagcaaccaagtggcaacagttccaggccagtatggagttttagaagccatgccaatatgcccaccttcagggagcagctgagtccttgatgccacccttgttctgaagagttcagaaacacagtgcaagacatgaccaggcctcatccttaggatgctcatggatccagttcttagctcccttgttggatatgctgttttccttggcctttggtcttttctttatcccagagggttttggctttaaggccaacaggaactatggggtaccagaattgagcagcctcagtctgcatccctcctctatagaaccacagctgggccctcagcaggcccaactctgcatggggacagaggcattaaaagctcagctcctacacttggtggcagtggtggtctgttgctctcaagctctttcaaaatggatggaaactgggacgcttccctgacccctggttatgaaagactagactgtgtggggacaaacagtccagagtcccggggaatgtgatagagcagctccatcatttttagaaacccaatttgaggcagtatagagagatggtgacctctataagcctctgtatctgcaaagaggagcttagacctgcccttgaggggattatatgagatttaagggacttatgtggccagcctacttcctggcatgctgaagacattggcacactctggtattctagaccttggctcagagctgcctttactaggatactgtcacttagcaaaagaatgggatggagcctcagatgtggagtgacaccatcttccaagaaggaaagggtgccagggtctgggatgaaagccctttggtgctatgttgggcaagggcgagtgccagcaaggggttatttgcttgctctctccatcagtgatgaggttccatttggtcacaagaaattcaccccaattgctgaaacagaggctgactattggcttataggcatgaaaccccactcccctccacttcaggctggctagattaaaagctcagacctgtgaaaaaaaaaaaaaa

SEQ ID NO: 1432 - DNA, 1171 bp, Mus musculus
ggcacgaggtggtcttgactttccaaaatgctgagtgaggcttcggattttaacagctcgggctctaggagcgaaggttctgtcttttcaaggactgagcacagcgtcatagcggcttacctgattgtggcaggtatcacgagcattctcagcaacgtagtagtcctgggtatcttcatcaagtacaaggagctgcggacacccaccaatgcagtgattatcaacctggctttcacggatataggggtcagtagcatcggctatcccatgtctgcggcttcagatctgcatggaagttggaaatttggacatgcaggctgtcagatttatgcaggactgaatatcttctttgggatggtgagcattggcttactcacggttgtagctatggatcggtacctgaccatcagttgccctgatgtaggacgaagaatgaccaccaacacttacctcagcatgatcctgggcgcctggatcaatggcctgttttgggctttgatgcccatcatagggtgggctagttatgccccggatcctacaggggccacgtgtaccataaactggcggaataatgatacctcgttcgtgtcttacaccatgatggttatcgtggtgaacttcattgtgcccttgacagtgatgttttactgttactaccacgtcagtcggtccctgagactctacgccgctagtgactgcactgcacacctccacagagactgggcagaccaggcagatgtaacaaagatgtctgtgataatgatactgatgtttctgctggcatggtccccttattccatcgtgtgcttgtgggcttgttttggaaaccccaaaaagattcctccttcaatggctatcatagctccactgtttgcaaaatcctctacgttctacaacccctgtatttacgtggctgcgcataagaagtttcggaaggccatgttggccatgtttaaatgccaacctcacctagcagtgcctgagccaagtactctaccaatggatatgcctcagagctcattggctcctgtgaggatctgaactgcaagaaaagaatataccaccaaacatttgatttgcttattttttgacaatacactaactttgatttaaatatggatccatttgaaccaagtgcagacatagcctatgccttactggatggtaggtt

SEQ ID NO: 1433 - DNA, 1419 bp, Mus musculus
atgcaggtggcttctgcaacccccgcggccaccgtgaggaaagcagctgcgggtgatgagctctcagaattcttcgctctgaccccagacttgctggaagtggccaacgccagcggcaatgcgtcgctgcagcttcaggatctgtggtgggagctggggctagagttgccagacggtgcggcgcctgggcatcctccgggtggcggcggggcagagagcacagacactgaggccagggtacggatcctcatcagcgcggtttactgggtggtttgtgccctgggactggccggcaacctgctggttctctacctgatgaagagcaagcaaggctggcgcaaatcctccatcaacctctttgtcactaacctggcactgactgactttcagttcgtgctcactctgcccttttgggctgtggagaacgcactagacttcaagtggcccttcggcaaggccatgtgtaagatcgtgtccatggtgacatccatgaacatgtacgccagcgtcttcttcctcactgctatgagcgtggcgcgctaccactcggtggcctcggctctcaagagccatcggacccgagggcgtggccgtggcgactgctgcggccagagcttgagggagagctgctgtttttcagccaaggtgctgtgtgggttgatctgggcttcggctgcgctggcctcgctgcccaatgccattttttccaccaccatcagggtgttgggtgaggagctctgcctcatgcactttccagacaagctactgggctgggacaggcagttctggctgggtttgtaccacctgcagaaggtgctgctgggcttcctgctgccgctgagcatcatcagtctgtgttacctgttgcttgtgcgcttcatctccgaccgtcgcgtagttgggacaacagatgcagtaggagcagcagcagcgcctgggggaggcctgagtacagccagcgctaggagacgctccaaggtcaccaagtcggtgaccatcgtcgtcctctccttcttcctgtgttggctgcccaaccaggcgcttaccacctggagcatcctcatcaagttcaacgccgtgcccttcagccaggagtactttcagtgccaagtgtacgcgttcccagtcagcgtgtgcctggcgcactccaacagctgcctcaacccgatcctctactgcttagtgcgccgcgagttccgcaaggcgctcaagaacctgctgtggcggatagcctcgccttcgctcaccaacatgcgccctttcaccgccaccaccaagccagaacctgaagatcacgggctgcaggccctggcgccgcttaatgctgctgccgaacctgacctgatctactatccacccggtgtggtggtctacagcgggggtcgctacgacctgctccctagtagctctgcctactga

SEQ ID NO: 1434 - DNA, 2379 bp, Mus musculus
atggccgctggccgccccgtgcgtgggcccgagctggcgccccggaggctgctgcagttgctgctgctggtactgctggggggcccgggccggggggcggccttgagcgggaacgtgaccgggcctgggcctcacagcgccagcgggagctcgaggagggacgtgccggtgaccagccctccgccgccgctgctgagccactgcggccgggccgcccactgcgagcctttgcgctacaacgtgtgcctgggctcggcgctgccctacggagccaccaccacgctgctggctggggactcggactcgcaggaggaagcgcacggcaagctcgtgctctggtccggcctccggaatgccccccgctgctgggcagtgatccagcccctgctgtgtgctgtctacatgcccaagtgtgagaatgaccgagtggagttgcccagccgtaccctctgccaggccacccgaggcccctgtgccattgtggagcgggagcgagggtggcctgactttctgcgttgcacaccggaccacttccctgaaggctgcccaaacgaggtacaaaacatcaagttcaacagctcaggccaatgtgaagcacccttggtgcgaacagacaaccccaagagctggtatgaggacgtggagggctgtgggattcagtgtcagaacccgctgttcaccgaggccgagcaccaggacatgcacagctacatcgcagccttcggggcggtcactggtctctgcacgctcttcacactggccacctttgtggctgactggcggaactccaatcgctaccctgcggttattctcttctatgtcaatgcgtgtttcttcgtgggcagcattggctggctggcccagttcatggatggtgcccgccgagagattgtttgccgagcagatggcaccatgagatttggggagcccacgtccagtgagaccctgtcctgtgtcatcatctttgtcattgtgtactatgccttgatggctggagtagtctggttcgtggtcctcacctatgcctggcacacctccttcaaagccctgggcaccacctaccagcctctctcgggcaagacatcctatttccacctgctcacgtggtcactcccctttgtcctcacggtggcaatcctggctgtggctcaggtagatggagactccgtgagtggcatctgttttgtaggctacaagaactatcggtaccgtgctggctttgtcctggccccaattggcctggtgcttattgtgggaggctacttcctcatcagaggggtcatgactctgttctccatcaagagcaaccaccctgggcttctgagtgagaaggcagccagcaagatcaacgagaccatgctgcgcctgggcatttttggcttcctggcctttggctttgtgctcatcaccttcagctgccacttctatgacttcttcaaccaggctgagtgggagcgtagcttccgggactatgtgctgtgccaagccaacgtgaccatcgggctgcctaccaagaagcccattcctgactgtgagatcaagaatcggcccagcctcctggtggagaagatcaatctatttgccatgtttggcactggcattgccatgagcacctgggtctggaccaaggccaccctgctcatctggaggcgcacctggtgcaggttgactgggcacagtgatgatgagcccaagagaatcaagaagagcaagatgatcgccaaggccttctctaagcggcgtgagctgctgcagaacccgggccaggagctctccttcagcatgcacactgtctcccatgatggacctgttgcgggtttggcttttgacctcaatgaaccctcagctgacgtctcctctgcctgggctcagcatgtcaccaagatggtggctcggagaggagccatattgccccaggatgtgtccgttacccctgtggcaactccagtgccaccagaagaacaagccaacatgtggctggttgaggcagagatctccccagagttagagaagcgtttgggccggaagaaaaagcggaggaagaggaagaaggaggtgtgccccttgaggccagcccctgagcttcaccactctgcccctgttcctgccaccagtgcagttcctcggctgcctcagctgcctcggcagaagtgcctggtagctgcaaacgcctggggaacaggggagtcctgccgacagggagcctggactctagtctccaaccccttctgcccagagcctagtccccatcaagatccatttctccctggtgcctcagccccccgggtctgggctcagggccgcctccaggggctgggatccattcattcccgcactaacctaatggaggctgagatcttggatgcagactcggacttc

SEQ ID NO: 1435 - DNA, 1176 bp, Mus musculus
atgttccccaatggcaccgcctcctctccctcctcttctccaagccccagcccaggcagctgcggggaaggagcctgcagcaggggtccggggtccggcgctgcggacggcatggaagagcctggacgaaacgcttcccagaatgggaccttaagcgagggacagggtagcgccattctcatctctttcatctactccgtggtatgcttggtgggactgtgtgggaactctatggtcatctatgtgatcctgcgctacgccaagatgaagaccgctaccaacatctacattctaaacctggctattgctgatgagctgctcatgctcagcgtgccctttctggtcacttccacgctgttgcgccactggcccttcggcgcgctactttgccgcctggtgctcagcgtggatgcggtcaacatgttcaccagcatctactgtctgactgtgcttagtgtggaccgctatgtggctgtggtgcacccgatcaaggcagcgcgctaccgtcggcccactgtggccaaagtagtgaacctgggcgtgtgggtcctgtcattactggttatcttgcccatcgtggtcttctcacgcaccgcagccaacagcgatggcacggtagcctgcaacatgctcatgcccgagcccgcccagcgctggttggtgggcttcgtcttatacacatttctcatgggcttcctgctgcctgtcggggccatttgcctgtgttatgtgctcatcattgccaagatgcgcatggtggccctcaaggctggctggcagcagcgcaagcgctcagagcgcaagatcactctaatggtgatgatggtggtgatggtttttgtcatctgctggatgcctttctacgtggtacagctggtcaacgtgttcgccgagcaagacgacgccaccgtgagccagttgtctgtcatcctgggctatgccaacagctgtgccaaccccatactctacggcttcctgtcggacaacttcaagcgctctttccagcgcatcctgtgcctcagctggatggataacgctgcggaggaaccagtcgactactatgccactgccctgaagagtcgagcctacagcgtggaggacttccagcccgagaatctggagtctggaggcgttttccgtaatggcacctgcgcttccaggatcagcacgctttga

SEQ ID NO: 1436 - DNA, 1110 bp, Mus musculus
atggagatgagctctgagcagttgaatgggagccaagtgtgggtgtcctctccatttgacctcaacggctcactggggccaagcaatggctccaaccagaccgagccatactacgacatgacaagcaacgccgtcctcacgttcatctacttcgtggtgtgtgttgtcgggctgtgcggcaacacgctggtcatttatgtcatcctccgctatgccaagatgaagaccatcaccaacatctacatccttaacctggccattgcagatgaactcttcatgctagggcttcccttcttggccatgcaggtggcgctagtccactggccttttggcaaggccatctgccgggtggtcatgactgtagatggcatcaatcagttcaccagtatcttctgcttgacggtcatgagcatcgaccgctacctggccgtggtgcaccccattaagtcagccaaatggaggcgaccccggacagccaagatgatcaatgtagctgtgtggtgtgtgtctctgctcgtcattttgcccatcatgatatacgccggcctccggagcaaccagtggggcaggagcagctgtaccatcaactggccaggcgaatccggggcgtggtacacaggtttcattatctacgccttcatcctggggttcctggtaccccttaccatcatttgtctctgctacctgttcatcatcatcaaggtgaagtcctctggaatccgagtgggatcatccaagaggaaaaagtcagagaaaaaggtgacccgcatggtgtccatcgtagtggctgtcttcatcttctgctggctccccttctacatcttcaacgtctcttccgtgtctgtggccatcagtcccaccccagccctgaaaggcatgtttgactttgtggtgatcctcacctatgccaacagctgcgccaaccccatcctgtacgccttcttgtctgacaacttcaagaagagcttccagaatgttctttgcttggtcaaggtgagtggtacggaggatggggagaggagcgacagtaagcaggacaaatcccggctgaatgagaccacggagacccagaggaccctcctcaatggagacctccaaaccagtatctga

SEQ ID NO: 1437 - DNA, 1287 bp, Mus musculus
atggccactgttacctatccctcatccgagcctatgaccttggaccctgggaacacatcctcgacctggcccctggataccaccctggggaacacatccgctggcgctagcctgacaggcctggctgtcagtggcatcttgatctctctggtgtacctggtggtgtgcgtggtgggtctgctgggcaactcgctggtgatctacgtggtcctgcggcacacgtccagcccatcagtgaccagtgtctatatcctcaacctggctctggctgatgagctcttcatgctagggctacccttcctggctgctcagaacgccctgtcctactggccctttggatctctcatgtgccgtctggtcatggccgtggatggcatcaaccagttcaccagcatcttctgcctcaccgtcatgagtgtggaccgctatctggctgtggtgcaccccacacgctcagcccgctggcgcacggcaccagtggctcgcacggtcagtcgagctgtctgggtggcctcggctgtggtggtgctgcctgtggttgtgttctcaggagtgccccggggcatgagcacgtgccacatgcagtggccagagccagcggctgcctggcgaacagcctttatcatctacatggccgcactgggcttctttgggcccctgctggtcatctgcttgtgctacttgctcattgtggtaaaggtgcggtcgaccacccggcgggtgcgggcgccctcgtgtcagtgggtacaggcacccgcatgccagcggcgacgccgctctgagcgcagggtcacacgcatggtggtggccgtggtggcactcttcgtcctctgctggatgcctttctatctgctcaacatcgtcaatgtggtgtgcccgctgccggaggagcctgccttcttcggcctctacttcctggtggtggcgctgccctatgccaacagctgcgcaaaccccatcctctacggcttcctctcctaccgcttcaagcagggctttcgcaggatcctgctaagaccatcacgtcgcattcggagccaggagccagggtcgggacctccagagaagactgaagaggaggaggatgaagaagaagaagagagaagggaagaggaggagcggaggatgcagagagggcaggagatgaacgggaggctcagtcagatcgcacaggctggcactagtggacaacagccacggccctgcacagggactgctaaggagcagcagcttctgccccaggaggccacagctggggacaaggccagcacactgagccatctgtaa

SEQ ID NO: 1438 - DNA, 1155 bp, Mus musculus
atgaacgcgccagcaactctgctccggggggtcgaggacaccacctggacccctgggatcaacgccagctgggctccggagcaggaggaggatgcgatggggtccgacggcacagggacagcgggcatggtcactatccagtgcatctatgcgctcgtgtgtctggtgggcctggtgggaaacgccctggtcatcttcgtgatcctacgctatgccaagatgaagacagccaccaacatctacctactcaacctggccgtcgccgatgagctcttcatgctcagcgtgccattcgtgcgctcggcggctgccctgcgccactggccgttcggggcggtgctgtgtcgcgcagtgcttagcgtggacggcctgaacatgttcactagtgtcttctgcctcaccgtgctcagcgtggaccgctatgtggctgttgtgcaccctctgcgcaccgccacctaccggcggcccagcgtggccaagctaatcaacctgggagtgtggctagcatccttgctggtcaccctgcccatcgcagtcttcgctgacaccaggccagctcgtgggggtgaggccgtggcttgcaacctgcactggcctcacccggcctggtctgcggtctttgtgatctatacttttttgttgggcttcctacccccggttctggccatcggattatgctacctgcttattgtgggcaagatgcgcgctgtggccctgcgcggtggctggcaacaacggaggcgctcagagaagaagatcactaggctcgtgctaatggtggtgaccgtctttgtgctatgctggatgcctttctatgtggtgcagcttctgaacctgtttgtcaccagcctcgatgccactgtcaaccatgtgtccctcatcctgagctatgccaacagctgtgccaatcccattctctatggcttcctctctgacaacttccggcgctctttccagcgggttctgtgcctgcgctgctgtctcctggaaacaactggaggtgctgaggaagagcccctggactactatgccactgctctcaaaagcagagggggtgcaggatgcatatgccctcctctgccctgccagcaggagcccgtgcaagcagaacctggctgcaagcaagtccctttcaccaagaccactactttctga

SEQ ID NO: 1439 - DNA, 1158 bp, Mus musculus
atgtgcccactagtgacaccctcttctcttgcagagatacatgtgctctggcatcctgaacctgacagcatggagcccctctctttggcttccacacctagctggaatgcctcagctgcttccagcggtagccataactggtcactagtggacccggtgtcacccatgggagcccgggcggtattagtgcctgtgctctacttgttggtatgcaccgtgggactgggtggaaacacactggtcatctatgtggtgttgcggtatgccaagatgaagacagttactaatgtgtacatcctgaacctggccgtggctgacgtgttgtttatgttggggcttcctttcctggcaacgcagaatgctgtctcctactggccctttggctccttcttgtgccgcctggtcatgacgctggacggtatcaaccagttcaccagtatcttctgcctgatggtcatgagtgtcgaccgctacctggccgtggtccaccctctccgctcagcccggtggcgtcgcccacgggtagccaagctggctagtgctgctgtctgggtcttctcgctgctcatgtctctgccgctcttggtctttgcggatgtccaggaaggctggggcacctgcaacctgagctggccagagcctgtgggactgtggggtgcagccttcatcacttacacatctgtgctgggcttctttgggcccctgctggtcatctgcttgtgctatttgctcatcgtagtgaaggtgaaggctgcaggtatgcgtgtgggctcctcacggcggaggcgctcagaacgcaaggtgactcgcatggtggtggtagtggtgctggtgttcgtgggctgctggctgcctttcttcatcgtcaacatcgtcaacctggccttcacgctacccgaggagcccacctctgccggcctctacttctttgtggtggtcctgtcttatgccaatagctgtgccaaccccctgctctatggctttctctctgataacttccgccagagtttccggaaggctctgtgcctacgtagaggatacggtgtggaggatgcagatgccatagagccacggccagacaagagtgggcggccacagaccacactgcccacacgcagctgtgaggccaacgggctcatgcagaccagcaggctttga

SEQ ID NO: 1440 - DNA, 1264 bp, Mus musculus
ttgctgccttgcccgccaaaatggataacgtccttcctgtggactctgatctcttccccaacacctccaccaacacttctgagtctaaccagtttgtgcaacctacctggcaaattgtcctttgggcagccgcctatacggtcatcgtggtgacttccgtggtgggcaacgtagtggtgatatggatcattttggcccacaagagaatgaggacagtgaccaattatttcctggtgaacctggccttcgctgaggcctgcatggctgcattcaatacagtggtgaacttcacctacgcagtccacaacgtgtggtactacggcctcttttactgcaagtttcacaacttcttccccattgctgctctcttcgccagtatctactccatgacagctgtggcctttgacagatacatggccatcatccaccctcttcagccccggctgtcggccactgctaccaaagtggtcatctttgtcatctgggtcctggctctcctgctggcctttccacagggctactactccaccacagagaccatgcccagcagagtagtgtgcatgatagagtggccagaacatcccaacaggacttacgagaaagcgtaccacatctgtgtgactgtgctgatctacttcctgcctctgctggtgattggctatgcatacactgtggtagggattacactgtgggccagtgagatccccggtgactcctctgaccgttaccatgagcaagtctctgccaagcgcaaggtggtcaaaatgatgatcgtggttgtgtgtaccttcgccatctgctggctgcccttccacatcttcttcctcctgccctacatcaacccagatctctaccttaagaagttcatccagcaggtctacctggccagcatgtggctggccatgagttctaccatgtacaaccccatcatctactgctgcctcaatgacaggttccgtctgggcttcaagcatgcctttcgctgctgccctttcatcagtgctggtgattatgaggggctggaaatgaaatccacccgatacctccagacccagagcagcgtgtacaaggtcagccgcctggagaccaccatctccactgtggtgggagcccatgaagatgagccagaggaaggtcccaaggccacaccttcatccttggatctcacctccaatggctcctctcgaagcaactcgaagaccatgacagaaagctccagcttctactctaacattctggcctaagcagcaagacacaacatgct

SEQ ID NO: 1441 - DNA, 1155 bp, Mus musculus
atgggggcccacgccagcgttaccgacaccaacatcttgtctggccttgagagtaacgcaacaggcgttacagccttctctatgcctggctggcagctggcgctatgggccacagcctacctggccctggtgctggtggctgtaacaggcaacgccacagtcatctggatcattctggcccatgagagaatgcgcacggtcaccaactatttcatcatcaacctggccttggcagacctctgcatggcggccttcaatgccaccttcaacttcatctatgccagtcacaacatctggtacttcggcagcaccttctgctacttccagaacctctttcctgtcacagccatgttcgtcagcatctactccatgaccgccatcgccgctgacaggtacatggccattgtccaccctttccagccacggctctccgcccccagcaccaaggcggttattgctgtcatctggctggtagccctggctctcgcctccccacaatgtttctactccaccatcactgtggaccagggggccaccaagtgtgtggtggcctggcccaatgacaacggaggcaagatgctcctactgtatcatctggtggtgtttgtcctcatctacttcctgcctctagtggtgatgtttgcagcttacagtgtcattggcctcacactgtggaaacgcgccgtacccagacaccaggctcatggagctaacctgcgccatctacaggccaagaagaagtttgtgaaggccatggtactggtggtggtgacatttgccatctgctggctgccctaccacctctacttcatcctggggaccttccaagaggacatctactaccgcaagtttatccagcaggtctacctggcactcttctggctggccatgagttccaccatgtacaaccccatcatttattgctgccttaaccacaggtttcgctctggattccggcttgctttccggtgctgcccctgggggacaccaaccgaggaagacaggctggagctgacccacactccgtccatctccaggagagtcaaccggtgtcacaccaaggagactttgttcatgacaggggatatgacccactctgaggctaccaatgggcaggttgggggcccccaggatggggagcctgctggaccctga

SEQ ID NO: 1442 - DNA, 1362 bp, Mus musculus
atggcctcggttcccaccggcgaaaactggacggacgggacggcgggcgtggggtcccatacagggaatctgagcgctgcgctggggatcactgagtggcttgcgctccaggctggcaacttctcctccgcgctgggcttgccagtgacatcccaggcaccttcccaagtccgggccaacctgacgaaccagttcgtgcagccctcctggcgaatcgcgctctggtcgctggcctatggcttagtggtggcggtggcagtcttcggaaacctcatcgttatttggatcatcttggcccacaagcgcatgaggaccgtcaccaactatttcctggtaaacctggctttctccgacgcctccgtggctgccttcaacaccttggtcaatttcatctatggtgttcacagcgagtggtactttggcgccaactactgccgcttccagaacttctttcccatcacagcggtgtttgccagcatctactctatgacagccattgcagtggacaggtatatggccattatcgatcctttgaaacccagactatctgccacagccactaagattgtcatcggaagtatttggattttggcatttctacttgccttccctcaatgtctttattccaaaataaaagtcatgccaggccgtaccctttgctatgtgcagtggccagaaggtcccaagcaacatttcacgtaccacatcattgttatcatcctggtgtactgtttcccattgctcatcatgggtgtcacctacaccatcgttggaattactctctggggaggagagatcccaggagacacctgtgacaagtaccatgagcagcttaaggctaaacgaaaggttgtaaaaatgatgattattgtggtggtgacatttgccatctgctggctaccctaccatgtgtatttcattctcactgcgatctaccaacagttaaacaggtggaaatacatccagcaggtctacctggctagcttctggctggccatgagctcaaccatgtacaaccccatcatctactgctgtttgaacaaaagatttcgtgcaggcttcaagagagcatttcgctggtgtcctttcatccaagtctccagctacgatgagctggagctcaagaccaccaggtttcatcccacacggcagagcagcctgtacaccgtgagcaggatggagtcagtgaccgtgctgtatgaccccagtgaaggggacccggccaagtccagccgcaagaagagggcggtgcccagagaccccagtgccaatggctgctcccacagagagttcaaatctgcctccaccacatcaagtttcataagctcgccctatacctctgtggatgaatattcctaatar

SEQ ID NO: 1443 - DNA, 996 bp, Mus musculus
atgcatctttgccacgctatcacaaacatttcccacagaaacagcgactggtcaagagaagtccaagcttccctgtacagcttaatgtcactcataatcctggccactctggttggcaacttaatagtaataatttccatatcccatttcaagcaacttcatacacccaccaactggctccttcactccatggccattgtcgactttctgctgggctgtctgataatgccctgcagcatggtgagaactgttgagcgctgttggtattttggggaaatcctctgtaaagttcacaccagcaccgatatcatgctgagctccgcctccattttccacttagctttcatttccattgaccgctactgtgctgtgtgtgaccctttgagatacaaagccaagatcaatatctccactattcttgtgatgatcctcgttagttggagccttcctgctgtttatgcatttgggatgatcttcctggaactgaacttaaaaggagtggaagagctgtatcgcagtcaggtcagcgacctgggcggctgttctcccttctttagtaaagtatctggggtactggcgttcatgacttccttctatatacctggatctgttatgttatttgtttactataggatatatttcatagctaaaggacaagcaaggtcaatcaatcgtacgaatgttcaagttggattggaagggaaaagccaagcaccacaaagcaaggaaacaaaagccgcgaagaccttagggatcatggtgggcgttttcctcgtatgctggtgcccgttctttctctgcacggtcctggaccctttcctgggctatgttatcccaccctctctgaatgacgcactgtattggtttgggtacttgaattctgccctcaatccgatggtttatgcctttttctatccctggttcagaagagccttgaagatggttctccttggtaaaattttccaaaaagattcatctaggtctaagctatttttg

SEQ ID NO: 1444 - DNA, 1035 bp, Mus musculus
atgggcagtaactcgtctccgcccaccgtcctgcagctctgctatgagaatgtgaccgggtcttgtgtgaaaaccccctactctcctgggtcgagggtcatcctctatgcagtctttggctttggggctgtgctggcagtgtttggaaacctcatggtgatgatatccatcctccatttcaagcagctgcactctcccaccaatttcctcattgcatccttggcctgtgctgactttggtgtgggcatctctgtgatgcccttcagcatggtcaggtccatcgagagctgctggtactttggtagaagtttctgcactttccacacctgctgtgatgtggcgttctgttactcttctctcttccacctgagcttcatctccatcgacaggtacatcgctgtcacggaccctctggtctatcccaccaagttcacggtgtctgtgtctggaatttgcatcggcgtctcctggattctgcccctggtgtacagcggcgctgtgttctacacaggggtttatgatgacggcctggaggaattatccagtgccctcaactgcgtagggggctgtcaggtagttgtgaatcagaactgggtgctgatagattttctttccttcttaatacctacacttgttatgataattctgtatggtaatatttttctggtagctagacaacaggctaaaaagatagaaaatattgggagcaaaacagaatcatcctctgagagctacaaagccagagtggcgagaagagaaagaaaagcagccaaaaccctggggattaccgtggtagcattcatgatatcatggttgccctacagcattgattcattagttgatgcttttatgggcttcatcacccctgcctacatttatgaaatctgtgtttggtgtgcttattacaactcagccatgaaccctctgatctacgctttattttatccatggtttaagaaagctattaaggttattatgagtggccaggtgttcaagaacagctcagccactatgaacttgttctctgagcaaata

SEQ ID NO: 1445 - DNA, 1026 bp, Mus musculus
atgtggcccaatggcacctcgctgggggcctgctttcgcccggtgaacatcacgctgcaggagcgacgtgccatcgcgtcgccatggttcgctgcgtccttttgcgcgctgggcctggggtccaacctgctggcactgagtgtgctggctggggcgcggcccggcgcgggaccccgctcctccttcctcgctctgctgtgcggccttgttctcaccgacttcctggggctgctagtcaccggcgccatcgtggcgtcgcaacacgctgccttgttggactggcgagccactgaccccagctgccgcctgtgctacttcatgggggtagctatggtgttcttcgggctgtgtcccctgctcctgggggccgccatggcctctgagcgcttcgtgggcatcacacggcccttctcacgacccacggccacatcgcgccgcgcctgggctactgtcgggctggtgtgggtggcggccggggcactcgggctgctgccactactggggcttggccgctacagtgtgcagtaccccggctcttggtgcttcctgacactcgggacacagcgcggtgacgtggtcttcgggctcatattcgcactcctgggcagcgcgtccgtggggctgtccctcctgctcaacaccgttagtgtggccacactctgccgggtctaccacacgcgcgaggccacacagcgcccacgggactgcgaggtggagatgatggttcagctcgtgggcatcatggtggtggccacggtgtgttggatgcccttgctggtcttcatcatgcagactttgttgcagacaccacctgtcatgagcttctctgggcagctgttgcgggccacagagcaccagctgctcatctacctgcgtgtggccacctggaaccagatcttggacccctgggtctatatcctctttcgccggtctgtgctccggcgcctgcatccgcggttcagttcacagctccaggctgtgtccttgcgccggcctccagcccaggccatgctcagtggaccctga

SEQ ID NO: 1446 - DNA, 5520 bp, Mus musculus
gggcgcccgggactcccgctgagcactcctcccgcacgcccgggtccctccggccggcgagccgtccggcccctgcgctgtaggtccccgcggggcgatgggttgatgggcgcggggggacgcaggatgccggtgcctcccgcgcgtttgctgctgctgccgctgctgccttgtcttctgctcctggctcctggaactcggggtgcgcctggctgcccggtccctatccgcggttgcaagtgctctggggagcggcccaagggactaagtggcggcgcccacaacccggctcgaaggagggtggtgtgcggcggtggggatctccccgaacctccagatcccggccttctgccaaacggcaccatcaccttgctcttgagcaacaacaagattactgggctccgcaatggatccttcttgggactgtccctgttggagaagttggacctgaggagcaatgtcatcagcactgtgcagcctggagccttcctaggtctgggagagctaaaacgcttagatctctccaacaatcggattggctgtctcacctctgagacatttcaagggctccctagacttctcagactaaacatatctggaaacatctactctagtctgcaacctggggtctttgatgagctgccagcccttaagattgtggactttggtactgagtttctgacctgtgactgccgcctgcgctggctgctgccctgggcccggaatcactccctgcagctgtctgagcgcacactctgtgcctaccccagtgccctgcacgcccatgccctgagcagcctccaggagtcccagcttcgctgtgaaggggccctggaactgcacacccactacctcatcccatcccttcgccaagtggtgttccagggtgaccgcctgcccttccagtgctcagccagctacttgggcaacgatacccggatccactggtaccacaatggggctcctatggagagcgatgagcaggccggcatcgtccttgctgaaaaccttatccatgattgcaccttcatcaccagtgagctgaccctgtctcacattggtgtgtgggcctctggtgaatgggagtgctccgtgtccacagtccaaggcaacaccagcaagaaggtggagatagtagtgctggagacctctgcctcctactgccctgcagagcgggtgaccaacaaccgtggggacttcaggtggccccgaaccttggctggcatcacggcttaccagtcctgtttacagtaccccttcacctctgtgcccttgagtgggggagccccgggtacccgagcctcacgcaggtgtgaccgagctggccgctgggagccaggggactactcgcactgtctgtacaccaatgacatcactcgggtgctctacacctttgtgctgatgcccatcaacgcctccaatgcattgacgttggcccaccagctgcgagtgtataccgcagaggccgccagcttctcagacatgatggacgtggtctatgtggctcagatgatccagaagtttttgggttacgttgaccagatcaaggagctggtggaggtgatggtggacatggccagcaacctgatgctggtggatgagcaccttctgtggctggcccagagagaagacaaagcctgcagtggcattgtgggtgccctggagcgaatcggaggagctgctcttagcccccatgcccagcacatctctgtgaattcaagaaatgtggcactggaggcctacctcatcaagcctcacagctacgtgggtctgacttgcacggctttccagaggagggaggtaggagtgtcgggtgcacagccaagcagcgtcggccaggatgccccagtggagcccgaacccctagctgatcagcagcttaggttccgctgcaccactgggaggcccaacatttctctgtcatccttccacatcaagaatagcgtggccctggcctccatccagctgccccccagcctgttctcaacccttccggctgccctggctcccccagtccctccagattgcaccctgcaactgctggtcttcagaaatggccgtcttttccgcagccacggcaacaacacttcccgtcctggagcagctgggcctggcaagaggcgtggtgtggccaccccagtcatatttgcaggaaccagtggctgtggtgtgggaaacttgacggagcccgtggctgtgtcactgaggcactgggctgaaggagctgaccccatggcagcttggtggaaccaggacgggcctggaggctggagttctgaaggctgcaggctccgctacagccagcccaacgtcagctccctgtactgccagcacttgggcaatgtggccgtgcttatggagctgaatgcattcccgcgggaggcaggaggctctggggctgggttgcatcccgtcgtgtacccctgcacggctttgctgctactctgtctcttctccaccatcatcacgtacatcctcaaccacagctccatccacgtgtcccggaagggttggcacatgctgctgaacctttgtttccatatggccatgacctctgctgtcttcgtggggggcgtcacgctcaccaactaccaaatggtttgtcaagcggtgggcatcactctgcactactcttccttgtcgtcactgctctggatgggggtcaaggctcgagtcctccacaaggagcttagttggagggcaccccctctggaagaaggggaagcagctccgcctggtcctcgccccatgctccggttctacttgattgctggagggatccccctcataatctgcggcatcaccgctgcggtcaacatccacaactaccgggaccacagtccctattgttggctggtgtggcgtccaagccttggtgccttctacataccggtggcgttgattctgcctatcacctggatctacttcttgtgtgcaggccttcacttacggagccatgtggcccagaatccaaagcagggtaacaggatctctctggagccaggggaagagctgaggggttccaccaggctcaggagtagtggcgtcctcctgaatgactctggttctcttttggctacagttagcgcaggagtagggacacctgcgcccccagaggatggtgatggcgtatattctcctggagtccagctgggggcgctgatgaccacgcatttcctgtacctggctatgtgggcttgtggtgccttggcggtgtctcagcgctggctgccccgagtggtgtgtagctgtctgtacggcgtggcagcttcagctcttggtctgtttgtcttcactcaccactgtgccagacgtagagatgtccgggcttcctggcgcgcctgctgccctcctgcttcgccctcggcctcccatgtcccagcccgggccctgccgactgctacagaggatggatccccagtgttgggggagggaccagcctctctcaagtcctccccaagtggcagcagtggccgcgcgccgccacccccctgcaaactcaccaatctgcaggtggcccagagtcaggtgtgcgaggcaagcgtggccgcccgcggagatggagagccagagcccaccggctcccgtggcagcctagctccccggcaccataacaacctgcatcatgggcgccgagtacacaagagtcgggccaaggggcaccgagccggagagactggtggtaagagccggctcaaggcgttgcgcgcgggcacgtccccaggagctcccgagctgttgtccagtgagagcggcagtttgcacaacagcccgtctgacagctacccgggcagcagccgcaacagtccaggcgacggtcttccactcgagggtgagcccatgcttacgccgtcggagggcagtgacacaagcgccgcgccaatcgctgagacggggcgccccgggcagcgccgcagcgccagccgtgacaacctcaagggcagcggcagcgcgctggagagggagagcaagcgccgctcctatccgctcaacactaccagtcttaacggtgcccccaaagggggcaagtatgaggatgccagtgtaactggtgcagaggccatagcgggaggctccatgaagactggcctctggaaaagcgagaccaccgtctaggtccagatttaggatgggcgggtcacgcgggcttgtttactcccaaatcctcttgggcggtccaagccgtctactgatgtgtatgtaggtttaaggcggccatgctgatgctgcccttgagtccaccatcattagttacccaggctagggaaaggggagggaggcagatgcttgcccctactgtggactatccctcagcagtagcgacagacaatcccagaccagttttggtggccaagttcttggtatcctgccaggtaggcataaaacatccatcggtccctagggtaacccataaactgagttgaagagcccagcccaggtaggctcaggaaatgagagggagaccggggaactgggttctccacaccagcccggcaaggtatcctgtgactgccaagatcccaggcctctctcccagttttggcttgggaaaccatcccagcaggtgagccagggggcgtaacaggtgctgcctttcagattaactatgcaagggggatgggggtgggaggggtagggcagtgtggtgggcagctctagagatgagcttgtccctcaggaggcaggcaggtgggaaaaggtgcattagggagacagaatccctaactatgggagtggtacacagtttttccagcagagttcacagcaaaccctgaacccccacacacctgggaagtgatactgccagcaggtgccttaagactcaaggggagggagctgatatgtggatctcacaacctatacagtggtctgcaagtggctccacttagctgcttaattataatacccactgtctgttcccagccctccaactccgggggactgaggggaaatgcctccatgaggctcctgtggcaaagccatgctaataatctgacttctaacctcagttagaaacccaaaatgccaaaccacctcctaactcgctgaaacccaaccacactctgaggcagcgcctgggtccaggctgctcaagagcctatgcttccagcccccattttcctcaactcaagatgccttttaatacagaactacatggaagtagaggaacccttgggcactgggaagtagcagggatcccagctctgatcaagtgagaggacagagcagggaagacgccatactcgctgagatgggtcccattatttatgctttgctgcacagacactattagaggaaaagctttgtattactctcccacgtgagctgctgctgtttaccctgccaatgccttagcactggagagctttttgcaatatgctggggaaaggggagggaggggatgaagtgccaaagaaaacacattttaaaagctctggttttatacaatagaatgttttccagcagatgcctctttgttttaatatattaaaatcttgcaaaaaaaaaaaaaaaaaaaaa

SEQ ID NO: 1447 - DNA, 1956 bp, Mus musculus
ggctaggctctggaggcgcgggcgcggcgcgatgcgcgggtacccgggagcgaacggctgcaagccccgatgaagctcgagcagccccagcctgatggaggcgcctccgtgggagccggtgcgcaatgactccctgcctcccacgctgagccccgcggtgccgccctacgtgaagctcggcctcaccgcggtctacaccgtcttctacgcgctcctcttcgtgttcatctatgcgcagctctggctggtgctgcgctaccgtcacaagcggctcagctaccagagcgtcttcctcttcctttgcctcttctgggcctcgctgcgtaccgtgctcttctccttttacttccgagacttcgtggcagccaactcgttcagccccttcgtcttctggctgctctactgcttccccgtgtgtctacagttcttcaccctcacgctcatgaacttgtacttcacgcaggtgattttcaaggccaagtcaaaatattctccagagctactcaaataccggttacccctctacctggcctcacttttcatcagcctcgttttcctgttggtgaatctgacctgtgctgtgctggtgaagacgggagactgggacaggaaggttatcgtctctgtgagagtggccatcaatgacacactctttgtgctgtgtgctatctctctctccatctgcctctacaaaatctccaagatgtccctggcgaacatctacttggagtcaaagggctcatcagtgtgtcaggtaactgccattggtgtcaccgtcatcttgctctacgcctctcgggcctgctacaacctgttcatcttgtcattttctcagatcaagaacgtccattcctttgattatgactggtacaatgtatccgaccaggcagatctgaagagccagctgggtgatgccggctacgtagtgtttggcgtggtgcttttcgtgtgggagctcctacccaccaccttggtggtttatttctttcgagtcagaaatcccacgaaggatcttaccaatcctgggatggtccccagccatggattcagtcccagatcttacttctttgacaacccccgaagatatgacagtgatgatgaccttgcctggaacattgcccctcagggacttcagggaagttttgctccagactactgtgattggggacaacaaaataacagcttcctggcacaagcaggaactttgcatcaagactccactttggatccagacaaagcaagccaagggtagcagcagctgacacagccctatggaagagttctctgttgacagccttcagccagacagaccggatgacagctgagttgctaaggcagttttccttaggaaacagaactctagtttttgctatagctttctcatggctccacagggctaagcaataatttagagcaataaactctttagtactagcagagaatctggctatttcagtgggtataatttaaacttatgaaagagattctgtacttttataaagatgtattttatataacttaaatactaatgctaaagtatactaggtttttccttgattgttaatttgttaattgcaacgtatgttgtagtttgcacagactttcacgcagaattcactttaaaacgtatagaatgcgtggtctaatagtttaaagctttgggaaaactttccacaaatcttacctctgaaggttcctcttgtgagtgccacgtggtgggctcctttcaccgccactcaagcattccaagttaaggggaagcagagtaccacggtctgtacgtaacaggctcaacagcagcagcagcagcagcagcagcagcagcaatttctcgtaaactctgtcctaagcctggtccttcttcatctgaaagcactactacaagcactccagtaacaagtggatactgttaagatgtagttgctgacactattaaacctcctctgctgtgtgtgt

SEQ ID NO: 1448 - DNA, 1371 bp, Mus musculus
atggagagtaacctgtctggtctggtgcctgcagctgggctggtacctgcactgccgcctacagtgaccctggggctgaccgctgcctacactgccctatatgctctgctcttcttctctgtctatgcccagctctggctggtgcttctgtatgggcacaagcgcctcagctatcagacagtattcctggcgctctgtctgctctgggcagccttgcgtaccacacttttctccttctacttccgagatactcccagggccaaccgcctggggcccttgcctttttggcttctctattgctgccctgtctgcctgcagttcttcacactgacgcttatgaacctctactttgtgcaggtactggctgtccgaggggccttcgtgggtgcttcactgctctttttgctggtgaatgtactgtgtgcagtgctgtctcgccagcgccaggcacagccctgggtccttctgctggtacgtgtcctggtgagcgactctctcttcgtcatctgtgccctctcgcttgctgcctgcctctgccttgtggcccgtcgagccccttccaccagcatctacttagaggccaaggggaccagcgtgtgtcaggcagctgctatagggggtgccatggtccttctctatgccagccgggcctgttacaacctggcagctctggccttggcccctcggagccggctagatgccttcgattacgactggtacaacgtatctgaccaggcagatctggtgaatgacctagggaacaaaggctacctggtgtttggtctcatcctcttcgtttgggaactgctgcccaccacattgctggtgggcttcttccgggtacaccggcccccacaggatctgagcaccagtcgaatcctcaatgggcaggtttttggctcccgatcctacttctttgaccgggctggccactgtgaggatgagggctgctcctgggagcatagccggagtgagagcaccaggtgccaggacctggtagtcaccaccacagcctctattctacaccacagacgtgatctgcttttactccccttagaatacccaggccccagctcccctgatccctggcccctgtgccaagtacgtctgctgcttcttgcccaggttgccaggagactgtggctgcttctctcctctggccggctccttgccgctcctattgtagtgagcttgtgccatccccctaaaatggaaacaaggccccaggataccagatgcccacagtgccctggcatgacctgccacctctgcttccacactggagccggctacctctcctgtgcctaccactcaataaacagaggctgtgccctgtcctccctcctgtcactcgtctgttccttctcacct

SEQ ID NO: 1449 - DNA, 1946 bp, Mus musculus
atgtggcggctgcgcctgctggtcctagcggtgctggcggcgggcagcgccgaggcccaggcgaactccagcgacggtttccttgagttttctgtgggaaaatttacatactttgtgctcagcaagtcctctccgcaggaggccgtcctgcgccatatttcaagcaatgtgacctttcttcttttccaaatacactcacagtatcagaataccacggtttcatttactaagactctccttcccagcacgtcaggaacaggcaacgacagagggctggtcttcattcttagaccggagcaggcagtgtgtacttggtacttggagacgggagacaccaagcctgtccaaagcgtggcccttacgctctcctactcagaaagagatcccattcctggaggctgcaatttggagtttgatttagatattgaccccaacctctatttggactataatttttttgagacaactatcaagttcgcaccagcaaacataggctatgcaagggctacagagcccccaccgtgtgatgtgagcaccagccgagagtccaggtggaggctgcgctatgacgtgtaccagtacttcctgcccgagggcgacctcaccgaggcctctctgctccatcatcttcagaggatggcccaggtggctcaggtgaaggccagtgccatcaaggtggccaccctaacagctgacgataaaacagccgtgtccttctcttccctcccgggacaaggagtcatctataatgtcatcgtttgggatccgtccctcaatacttctgctgcttatgtgcccgtgcacacatacgcctgcagctttgagtcagtggatggtaactgtgcttttcctggaagagtatctacgaaagtgttctccactttggttgccctgcttgggctcttcgtttgtttctttggacacagattctggaaaacagatttattcttcattggcttcatcttcctggggttcttcttctacatcctgatcaccagactgacaccccttcagtatgacgttcgcctggctctcaccgctgtagctggcagctttggtggcctcctcctggtggcttcatggtggcgattcgggatcctcacactctgcatgctgtgtgtgggactcgtgctgggcttcctcgtgtcttctgggactttcttcacgcctctgggaaacctaaatgtttttcatgatgatggagtgttctgggtgacgttctcctgcatagcgctgcttgttccagtcatcttcatgggctgcctaagaatcttgaacatcctggcttgtggagtcgtgggctcctactccgtggtgttggctgttaacagttacatgttcacaagcctctcctacatcaccctgaacgtcctcaggagagctctcaacacagatttccgaggggctgtcattagagtgcctttccagaccaacgactacatcatcctggccgtgtgggggatgctggctgtcagtggaattacacttcagattcgaagagaaagaggacagccgcctttccctccccacccctacaagctatggaagcaagagagagaacgcagagtgaccaacatcctggaccccagccatcacatccctcccctgagagagaggctttatggtcgggttgctcggatcaaagagctcttccagaaggaacagccggctggagagaggacacccttgcttctgtagaaggctgagggtcagtgtgcttgccctggagttctcgtctagactgcccagttgtcccaggtccatgcagggccagccagggtgggtgacagggtgacgcccccgtggatgtacagcagtggagttagaggattctaagtgatatggtgagaaaagtctccaaaaagttggccgtagatgtttttcctcattttccacagtcttgagaagttaccttttgatgattgatgtcttttataaaatacacc

SEQ ID NO: 1450 - DNA, 1230 bp, Mus musculus
gccactgccggtggaatggccagcctgcaggaggccaatggaagcacagcgtggccaccgcccacagcatccaatatcagtgagccccaccagtgcctgctgctgctatatgaggatattggctcctccagggtccggtactgggacctcctgctgctcattcccaatgtgctcttcttcatcttcctgctctggaagcttcccttagctcgggccaagatccgtgtcacctccagccccatttttatcaccttctacatcctggtgtttgtggtagccctggtaggcattgccagggctgtggtttctatgacagtcagcgcctctgatgctgcgacagttgctgacaagatcctgtgggaaatcacccgcttcttcctgctggccattgagctgagtgtgatcatcctgggtcttgcctttggtcacctagagagcaagtccagcatcaagcgggtgctggctatcaccacagtattgtctctggcctactcagtcacccaggggaccttggagatcctgtaccctgactcccatctttcagctgaggatttcaacatctatggccatggtggccggcagttctggctcgtcagctcttgctttttcttcctggtctactcactggtggtaattctccccaagaccccactgaaggagcgtgtatccctgccctcacggaggagtttctacgtgtatgcaggcatcctggccacactcaacctgctgcagggtttggggagtgctctgctctgcgctaacatcattgtggggctctgctgtgtagatgccaccaccttcctgtacttcagcttctttgcaccactcatctatgtggccttcctccgtggcttctttggctctgaacccaagatccttttctcttacaaatgccaagtggacgaggctgaagagccagacatgcacctgccgcagccctacgctgtggcccggcgcgagggcatagagtctgcaggacctgcctgcgcctctgccgccaactactccagcacacagtttgactctgctggggtggcctacttagatgacattgcctccatgccctgccacacgggcagcatcaacagcacagacagcgagcgctggaaagccatcaatgcctgagtgggcacctaagcctcggggaggcctgtaaagacagatgggaactcgtgtggatagccctgggcaggtgtgcctgcacccccagcctcttcctgatctccaccc

SEQ ID NO: 1451 - DNA, 1182 bp, Mus musculus
atggagaatgatactgtcagtgaaatgaaccaaaccgagctccagccacaagcagctgtggccctcgagtaccaggtggttaccatcttacttgtggtcattatttgtggactgggcattgtgggcaacatcatggtagtcctggtggtcatgagaacaaagcacatgagaacccctacaaactgttacctggtaagtctggctgtggcagatctcatggttctggtggctgcaggactccccaacataaccgacagtatctatggttcctgggtctatggctatgttggctgcctctgcattacatatctccagtacctaggcattaatgcatcttcatgttcaataacggcctttaccattgaaaggtacatagcaatctgtcaccccatcaaagcccagtttctctgcacgttttccagagccaaaaaaatcatcatctttgtctgggccttcacatccatttactgtatgctctggttcttcctgctggatctcaacatcagcacctacaaaaacgctgttgtggtttcctgtggctacaagatctccaggaactactactcacctatttacctaatggactttggtgtcttttatgttgtgccaatgatcctggccactgtgctttatggatttatagctagaatcctcttcttaaaccccattccttcagaccctaaagaaaactctaagatgtggaaaaatgactcaatccatcagaacaagaatttgaatttaaatgccaccaacagatgcttcaacagcactgtatcttccaggaagcaggtcaccaagatgctcgcagtggttgtaattctgtttgcccttttatggatgccctacaggactcttgtggttgtcaactcatttctctccagccctttccaggaaaattggttcttgctcttttgcagaatttgcatttatctcaacagtgccatcaacccagtgatttacaacctcatgtctcagaaatttcgtgcagccttcaggaagctctgcaattgcaagcagaagcccacagaaaaagctgctaactacagtgtggccctaaattacagtgtcatcaaggagtcagaccgcttcagcacagagctagaagatatcaccgtcaccgatacgtatgtgtcaaccacaaaagtgtcctttgatgacacctgcttggcctctgagaactaa

SEQ ID NO: 1452 - DNA, 2295 bp, Mus musculus
atgaggccagggtccctgctgctgcttgttctgctgctcgccctgtccaggagcctgcggggcaaagagtgtgcgtctccaccctgtgagtgtcaccaggaggacgacttcagagtcacctgcaaggagctccaccgaatccccagcctgccgcccagcacccagactctgaagctcatcgagactcatctgaagaccatacccagtcttgcattttcgagtctgcccaatatttccaggatctatttatctatagatgcaactctgcagcggctggaaccacattctttctacaatttgagtaaaatgactcacatagaaatccggaacaccagaagcttaacctatatagaccctgatgccttgacagagctccccttgctcaagtttcttggcattttcaatactggacttagaatattccctgacttgaccaaaatttattccacggacatattctttatacttgaaatcacagacaacccttacatgacttcggtccctgaaaacgcattccagggcctatgcaatgaaaccttgaccctgaaactgtacaacaatggatttacttcagtccaaggacatgctttcaatggaacaaagctggatgctgtttacctaaacaagaataaatacctgacagctatagacaacgatgcctttggaggagtatacagtggaccaactttgctagatgtgtcttccaccagcgtcactgcccttccttccaaaggcctggagcacctcaaagaactgatcgcaaaagacacctggactctcaaaaagctcccgctgtcgttgagtttcctccacctcactcgggctgacctctcttacccgagccactgctgcgcttttaagaaccagaagaaaatcaggggaatcctggagtctttgatgtgtaatgagagcagtatccggaaccttcgtcaaaggaaatcagtgaacatcttgaggggtcccatctaccaggaatatgaagaagatccgggtgacaacagtgttgggtacaaacaaaactccaagttccaggagagcccaagcaactctcactattacgtcttctttgaagaacaagaggatgaggtcgttggtttcggccaagagctcaaaaatcctcaggaagagactctccaagccttcgagagccactatgactacacggtgtgtggggacaacgaggacatggtgtgtacccccaagtcggacgagtttaacccctgtgaagatatcatgggctacaggttcctgagaatcgtggtgtggtttgtcagtctgctggctctcctgggcaatatcttcgtcctgctcattctgctaaccagccactacaaattgaccgtgccgcggttcctcatgtgcaacttggcctttgcagatttctgcatgggggtatacctgcttctcattgcctctgtagacctgtacacacactctgagtactacaaccacgccatcgactggcagacgggccctgggtgcaacacggctggcttcttcactgttttcgccagtgagttatcagtgtacacactgacggtcatcaccctggagcgatggtacgccatcaccttcgccatgcgcctggataggaagatccgcctcaggcacgcgtacaccatcatggctgggggctgggtttcctgcttccttctcgccctgctctcgatggtgggaatcagcagctatgccaaggtcagcatctgcctgccaatggacaccgacacccctcttgcactcgcatacattgtcctcgttctgctgctcaatgttgttgcctttgttgtcgtctgttcctgctatgtgaagatctacatcacggtccgaaatccccagtacaaccctcgagataaagacaccaagattgccaagaggatggctgtgttgatcttcactgacttcatgtgcatggcgcccatctccttctatgcgctgtcggcacttatgaacaagcctctaatcactgttactaactccaaaatcttgttggttctcttctaccccctcaactcctgtgccaatccgtttctctatgctattttcaccaaggccttccagagggacgtgttcatcctgctcagcaagtttggcatctgcaaacgccaggcccaggcctatcagggtcagagagtctgtcccaacaatagcactggtattcagatccaaaagattccccaggacacgaggcagagtctccccaacatgcaagatacctatgaactgcttggaaactcccagctagctccaaaactgcagggacaaatctcagaagagtataagcaaacagccttgtaa

SEQ ID NO: 1453 - DNA, 1380 bp, Mus musculus
atgcgccctccgagcctaccgcctgcccgctggctctgcgtgctggcaggagccctcgcctgcgccctcggacccgcgggcagccgggcagccagcccacaccaggagtgtgagtacctgcagatgattgagaaacagcgtcagcagtgcctggaggaggcccagctggagaatgaaaccacaggctgcagcaagatgtgggacaacctcacctgctggccaacgaccccttggggccaggtggtagtcctggactgccccctcatctttcaactgttttcccccattcacggctataacatcagccgtaactgcactgaagaaggctggtcacaactggaacctggcccctaccacattgcctgcggcctgaatgacagggcatctagtatggatgagcagcaacagactgagttctacgatgcagtgaagaccggctacaccatcggctacagcttgtcccttgccagcctcctggttgccatggctatcttgagcctgttcaggaagctgcactgtactcgaaactacatccacatgcatctcttcatgtccttcatcctgagggccaccgccgtcttcatcaaggacatggccctcttcaacaacggggagacagaccactgctctgaggcctcggtgagctgcaaggcagcagtggttttcttccagtattgtgtcatggccaacttcttctggctgctggtcgagggcctctacctacacaccctgctggccgtctccttcttctctgagcggaagtacttctgggggtacatactcatcggctggggagtgcccagtgtgttcatcatgatatggacgattgtcaggatccattttgaggatttcgggtgctgggacaccatcatcaactcctcactgtggtggatcataaagggccccatcctcatctccatcttggtgaacttcatcctgtttatctgcatcatccgaatcctggttcagaagctacggccacccgacattgggaagaatgatagcagcccatactcgaggctggccaagtccacacttctgctcatccctctgttcggagttcactatgtcatgtttgccttcttccccgacaactttaaggcccaggtgaaaatggtcttcgaactcgtcgtagggtctttccagggttttgtggtggccatcctctactgcttcctcaatggcgaggtgcaggcagagctgcgacggaagtggcggcgttggcatctgcagggcgtcctgggctggagctccaaatcccaacacccgtggggaggcagcaacggcgtctcgtgcagcacgcaggtgtccatgctgacccgcgtcagcccgagcgcgcgccgctcctccagcttccaagcggaggtctccctggtctga

SEQ ID NO: 1454 - DNA, 1314 bp, Mus musculus
atgagggcgtcggtggtgctgacctgctactgctggttgctggtgcgggtgagcagcatccatccagaatgtcgctttcatctagaaatacaagaagaagagacaaaatgtgcagagctgctaagcagccaaacggagaatcagagagcctgcagcggtgtctgggacaacatcacatgctggcgcccggcagacgttggggaaactgtcacagtgccctgccccaaagtattcagcaatttctacagcagaccaggaaacataagcaaaaactgcactagcgatggatggtcagagacatttccagatttcatagatgcgtgtggctacaacgaccccgaggatgagagtaagatctcgttttatattttggtgaaggccatttataccttgggctacagtgtttctctgatgtctcttacaacaggaagcataattatctgcctcttcaggaagctgcactgcacaaggaactacatccacctaaacctcttcctctccttcatgctgagagccatctctgtgctggtcaaggacagcgtgctctactccagctcaggtctactgcgctgccacgaccagccagcctcctgggttggctgcaagctcagcctggtattcttccagtactgtatcatggcaaacttctactggcttctggtggagggtctctacctgcacaccctcctggtagccatccttcctcccagcaggtgcttcctggcctaccttctgatcggatggggcatccccagtgtgtgtataggtgcatggacagcaactcgcctctctttagaagacacaggttgctgggacacaaacgaccacagcatcccctggtgggtcattcggatgcccattctaatttctattgtagtcaactttgccctcttcatcagcattgtaaggatcttacttcagaaactaacttctccagatgttggtggcaatgaccagtcacagtacaagaggcttgccaagtccacactgctgctaatccccctgtttggcgtccactacatggtgtttgctgccttccctattggcatctcatccacataccagatcctgtttgagttatgtgttggttccttccagggcctggtggtagcagttctatactgcttcctgaacagtgaggtacagtgtgaactgaaaagaagatggcgaggcctgtgcctgacccaagctgggagccgggactaccggctgcacagctggtccatgtcccggaatggctcagaaagtgccctacagatacaccgtggctcccgcacccagtccttcctgcagtcagagacttcagtcatttag

SEQ ID NO: 1455 - DNA, 9439 bp, Mus musculus
aatgaacatggcattggtggtgtggtatgagccaacagtattgaatattctgcatgtgtcaggaggaaggaagaactcttgataatatagtcacaaacctttgagacagctctcctagctctatgaatagatggttctgacattgcacccccagagatgtccactgctgtatacatgtctgcactcaatgcttcccttatccttataccctgtgtttcagccaccacccacggtggcatgtttcaaagctgaagttctccctgtttcactttttttggttctgaaagtcattaacagctgtatgtcttatgtgaccttctgcctgatgccgaggcaggtgtgcatgacaagtggtcctagggagccggcttgccccgatgcttagcttatttttgtgacctcctgggccctgtgagcattttaatctatcatcttttagctgagtagccttcaagttcaagattcctcagagcagatgctggtagggctgggaaaacctgtttgatgcaggctttgtttttctttacactgcttttctacattctcatttaaaaaaatcatctatagtatattggtgctaggaatacacactgtaagagtacaatctgagctgatgtgctgtggcatttagcgtttctagggcggtacttttaccaagtcctccctctctctgattgatcaatgcctgattgtctctgctcttctcaatagccctcatcaatctcggtgattgaaccaaggagcagaaatgcatctgtacctcttactctcatcagagaaaaagggacctatggaatggtcaccgtgacttttgatgtatcaggtggcccaaatccccctgaggaagacttgaatccagttagaggaaatatcaccttcccacctggcagagcaactgtgatttacaacgtgacagttcttgatgatgaggtaccagaaaatgatgaactatttttgattcaactgagaagtgtagaaggaggagcagagattaatgcttctaggagctcggttgaaatcattgtgaagaaaaatgatagtcctgtgaacttcatgcagagtgtttacgtggttcccgaggacgaccacgtactcactattcccgtgcttcgtgggaaggatagtgatggaaatctcattggatctgatgaaacccaagtgtcaatcagatacaaagtaatgacttgggattcaacagcacatgcccagcaaaacgttgactttattgatcttcagccggatactactcttgtctttcccccttttgttcatgaatcacacctgaaatttcagataatcgatgaccttatacccgagatagctgagtcatttcacatcatgttactaaagaacaccttacagggagatgctgtgctaatgggcccttctacagtacaggtcaccattaagccaaatgacaagccctatggagttctttcattcaatagtattttgtttgaaagaccagttataattgatgaagatacagcatccagttctagatttgaagaaattgcagtggttagaaatggtggcacacatgggaatgtctctgtgagctgggtgttgacacggaacagcagtgatccctcaccagtgaccgcagacatcacccctgcttctgggactctgcagttcgcacaagggcagatgctggcgccaatttctctagtggtctttgacgatgatcttccagaagaggctgaagcttacttacttacaatcttgcctcacaccatacaaggaggcgctgaagtgagcgagccagcgcagcttctgttctacattcaggacagcgataatgtttatggagaaatagccttttttcctggggaaagccagaagattgaaagcagccctagtgagcgatccttatccctgagtttggcgagacgtgggggaagtaaaggagacgtgagggtgatttattctgcactttatattcctgctggagctatggaccccttgcgagcaaaagatggcatcttaaatacatctaggagaagcagcctccttttcccagaacagaaccaacaagtttctataaaattaccgataaggaatgatgcattcctccagaatggggcccacttcctagtgcagttggaagctgtggtgttggtgaacatattccctccgattccaccagtaagtcccagattcggagaaatcagaaatatttcattactggttaccccagccattgcaaatggagaaattggctttcttagcaaccttccaattattttgcatgaacccaaagattcttctgctgaggtggtatctatccccttgcatcgagatggaactgatggccaggctaccgtgtactggagtttgcggccctctggctttaattcaaaagcagtgactttggatgacgcaggtccttttaatggctctgttgtgtttttatctggacaaaacgaaacatcaatcaacattactgtcaaaggcgatgacataccggagttgaatgaaactgtaaccctttctctagatagggtgagcgtggacagtgacgtcctaaaatcaggctatactagccgagacttgattattttggaaaatgatgaccctggaggcatttttgaattttcttatgattctagaggaccctatgttataaaagaaggagatgccgtggagctccggattactcggtccagggggtcgcttgttaaacagttcctccgctttcacgtggaacccagagagagcaatgaattctatggaaacatgggggtgctagaattcaccccaggagaacgggaagtagtgatcaccctcctcaccagactggatggcacaccagagttggacgagcacttctgggcgatcctcagcagccatggtgagagagagagcaagctgggccgtgctacactcgtcaacataacgattctcaaaaacgactatcctcatgggattatagaatttgtttccgatggtttgagtgcatcgataaaagagagcaaaggggaggatatctatcatgctgtttatggtgtaatacgaactcgaggcaactttggtgctgttaatgtatcatggatggttagtccagactttacgcaagatgtatttcctgtgcaaggaactgtttgttttggagaccaagaattttttaaaaacatcactgtctactcccttgtagatgaaattccagaggagatggaagaattcaccattatcctacttaatgccactggaggagctcaaacagggatcaggacaactgcctccctgaggattctcaggaacgatgaccccgtttactttgcagagccttgtgttttgagggtccaggagggtgagactgccaactttacagttctcagaaatggatctgttgacggggcctgcactgtccagtatgctaccgtggatgggaaggcttcaggagaagagggagacttcgctcctgtggagaagggagaaactcttgtgtttgaagttggaagcagagagcagagtatatctgtacatgtcaaggatgacggaatcccagaaacagatgagcctttttatatagtcctgttcaactcaacaggtgacacagtggtttatgagtacggggtagctacagtcataattgaagccaacgatgacccaaatggtgttttctctctggagcccatagacaaagcagtggaagaaggaaagacaaatgcattttggattttacggcaccgaggacacttcggcaatgtttctgtggcttggcagctgttccagaatgcttctctgcagcctggacaagagttctatgaaacatcagggactgttaacttcacagatggagaagaaacaaaaccagtcattctccgtgctttcccagataggattcctgaattcaatgaattttatattctaaggcttgtaaatatttcaggtcctggaggtcaactagcagaaaccaactttcaggtgacagtcatgattccattcaatgacgatccgtttggaattttcatcttagatccagagtgtctagagagagaagtagctgaagatgtcctctcagaagacgacatgtcttacatcaccagcttcaccattttgagacaacagggtgtctttggtgatgtacgggttggctggaaagtcctgtccagagagtttactgctggccttccaccaatgatagactttatactgctaggaagttttccaagcactgtgcctttgcaaccacatatgcgacgtcaccacagtggaacagacgtcctgtacttcagtggactagagggtgcatttgggactgttgatcccaagtaccaacccttcagaaataacacaattgccaactttacgttttcagcttgggtaatgcctaatgccaacacaaatgggtttctcatagcaaaggatgacagtcatggtagcatctactatggagtaaaaatccaaacaaatgaaacccacgtgaccctttcccttcattataaaacttttggatcaaatgttacatatattgccaagagcactgtcatgaaatatttagaggaaggtgtttggcttcatgttttaatcatcttagatgatggcataattgaattctatctggacggaaaggcaatgcccagaggcataaagagtctgaaaggagaagctattactgatggtcctgggatcctgagaattggagcagggatggatggtggtgccagattcacaggttggatgcaggatgtgaggacctatgagcgcaagctgactcccgaggagatttacgaacttcatgctgtgcctgcaaggactgatttacacccgatttctgagtatctggagttcagacaaggagaaagtaacaagtcgttcattgttgctgcaagagatgacagtgaagaggaaggagaagaattattccttcttaagctggtctctgtggatggtggggctcagatttctaaggaaaacactactgctcggctaagaatacagaaaagtgacaatgccaatggcctgtttggcttcactggggcttgtataccagagatgacagaggaggggtccactgtttcctgtgtggttgagcgaacgaggggagctctgggttacgtgcatgttttctacaccatctcccagatcgagtcagaaggcatcaattacctcgttgatgattttgccaatgccagtggcactatcaccttcttgccttggcagcggtctgaggtcctgaatctgtacgttcttgatgaggacatgcctgagctaaatgaatattttcgggtgacgttggtgtctgcagttccaggagatggaaaacttggttcaactcccatcagtggtgccagcatagatcctgagaaggaaaccacaggcatcactgtcaaagctagtgaccatccttacggcttgatgcagttctccacagggttgcctcctcagcctgaagattcaatgagtctgcctgctagcagtgtgccacatatcacagtgcaggaagaggatggcgaaatccgtttactggtcattcgtgcacaagggctccttggtcgggtgactgtaggatttagaacagtatccctgacagcatttagtccagaggactaccagagcactgctggcacattagaatttcaatcaggagaaagatataaatatatatttgtcaacatcactgataattctatccctgaactggaaaaatcttttaaagttgagttgttaaacttggttggaggagtgtctgacctctttagggttgatggcagtgggagtggagaagcggacacggatttcttccttccacctgtcctcccgcatgccagtctaggagtggcttcccagattctggtgaccattgctgcctctgaccatgctcatggggtgtttgaattcagccctgaatcactcttcgtcagtggaactgaaccagaggatggatacagtactgtcgtgttaaatgttacacggactcggggagccctgtctgcagtgactttgcagtggaaggtagactcggacctggatggggatctcgccattacatctggcaacatcacatttgagactgggcagaggattgcttccatcactgtggagatactgccagatgaagagccagagctagacaaggcactcaccgtgtcgatcctcaacgtgtccagtggctccatgggagttcttacaaatgccacattgacaattttggctagtgatgatccttatggggtctttatttttcctaacaaaactagacctttgagtgttgaagaagcaacccagaatgtcacattatcgataataaggttgaaaggcctcatgggagaagttgcagtctcatatgcaaccatagatgatatggaaaagccaccgtatttcccacctaatttagctagagcaactcaaggaggagattacatatcagcatctggattggctcttttcagagctaatcagactgaggctacaatcactatttcaatcctagatgatgctgaaccagaacgctcagaatctgtgttcattgaacttttcaattcctctttagtagacaaagtacagaatcgcccaatcccacattctccacgccttgggcctaaggtggagactgtggcccatctcgttattgttgccaatgacgatgcatttggaactgtgcagctgtctgcaacatctgttcatgtagcagaaaatcatgttggacccattatcaatgtgactcgaactggaggaacatttgcagatgtttctgttaagtttaaagctgtgccaataactgcagcagcgggtgaggactatagtatagcatcttcagacgtggtcttgctggaaggggaaaccactaaagctgtgccaatatatatcattaacgacatctaccctgagctggaagaaacctttcttgtgcagctactaaacgaaacaacaggtggagccacactggggcctctgagagaggcagtcattaccatagaggcgtctgatgacccctacggactgtttggttttcagaatactaaatttattgtagaggaacctgagtttaactcagtgagggtaagcgcgccaataattcgaaattctgggacactcggcaatgttactgttcaatgggttgccatcattaatggacagtttgctactggcgacctgcgagttgtctcaggtaatgtgacctttgcccctggggaaaccattcaaaccttgttgttagaggtcctggctgacgacgttccggagattgaagaggttgtccaggtgcaactagctgctgcctctggcggaggtacaattgggttagatcgagtggcaaatattgttattcctgccaatgataacccttacggttcagtagcctttgttcagtccgtttttcgtgtccaagagcctctagagagaagttcctatgctaacataactgtcaggagaagcggaggacactttggtcgcctgctgttgtgctatggtacttctgatattgatgtagtggctcgtgcagttgaggaaggtgaagatgtgttatcctactatgaatcaccgactcaaggggtgcccgacccactctggagaacttgggtgaacgtgtctgcggtggaggagacacagtatacctgtgccactttgtgtctcaaagaacgtgcctgctcagcgttttcagttgtcagtggtgccgagggccctcggtgcttctggatgacgtcgtgggtcagcggaactgtgaacagctctgacttccaaacctacaagaagaacatgactagggtggcctctcttttcagtggccaggcagttgctggtagtgactacgagcctgtgacaagacagtgggccgtgatactggaaggtgatgagtttgcaaatctcactgtttctgtacttcctgacgatgctcccgagatggatgaaagtttcctaatttctctccttgaagttcaccttatgaacatctcagacagttttaaaaaccagccaaccataggacatccgaatacttccgctgtggtcataggactgaatggcgatgcctttggagtattcattatctacagtgttagtcccaatacctcggaagatggcttatgtgtggaagtgcaggaacagccacaaacttctgtggaactggttatctacaggacaggaggcagcctggggcaggtcatggtcgaatggcgcgttgttggtggaacggctactgaaggtttagattttatgggtgctggagacattcttacttttgcagaaggtgaaaccaaaaagatggccattttaaccattttggatgattctgagccagaggacaatgaaagcatccttgtccgtctggtggccacagagggcggaagcagaatcctgcccagctcagacaccgtgacagtcaacatcttggcaaacgacaatgtggcaggaattgtcagctttcagacagcttccagatctgtcataggccacgaaggagaaatgttgcagttccatgtggtaagaacacccccaggtcgaggaaatgtcactgtcaactggaaagttgttggacaaaatctagaagtcaattttgctaactttacgggccaactcttcttctctgagggtacattgaataaaacaatatttgtacatttgttggatgacaatattcctgaggagaaagaagtataccaggttgttctgtatgatgtcaagacccaaggagtgtcgccagcaggagttgctctacttgatgcccagggatatgcagctgtactgacagtggaagcaagcgatgagccacacggtgttttaaactttgctctctcctcaagatttgttgtgctccaggaggctaatgtaacaattcagctcttcgtcaacagagagttcggatctctaggagccatcaatgtcacgtatgctactgttcctggaatagtaagtctgaaaaacaacacagaaggcaacctagcagagccagagtctgacttcatccctgtggtgggctctctggttttggaggaaggggaaacaacagcagctatcagtatcactgtcctcgaggatgatataccagagctaaaagaatatttcttggtgaatttaactcatgttgatctcattatggctcctctgacttcatctcctcccagactaggtatggggctctcctttatgaaccttttgactaactgtgagagtcagaggacttcattgttttaatcagagtgagttgttatgggaacgtaacaccgccccttgttttgtttgctaatttcagccgtgtgtgaggatgtgatgagcatttagacttgttctagttagagactgtcattgtaagcagtgtaaggcaataattactctggtgctttttaaattttacaactatgttactgccagatatgcaacctgcaaggtggtattacttttttcaaatgtatttttccttcattttcttttaaaatgtaactagctatcttcataagtcaacagttttcttttaagtttaatatttattttgtga

SEQ ID NO: 1456 - DNA, 1071 bp, Mus musculus
atggagattccagctgtcacagagccctcctacaacacagttgccaagaatgacttcatgtctggattcttatgcttcagcataaatgtgagggcatttggaatcacagtgccgactcccctgtactccctggtgttcatcattggcgtgataggccatgtcttggtggttctggtgctcatacaacacaagaggcttcgaaacatgaccagcatctacctgttcaacctggctatctctgatctggtcttcctctccacattacctttctgggttgactatatcatgaaaggagactggatttttggtaacgccatgtgtaagtttgtgtctggattttattacctgggcttgtatagtgacatgtttttcatcaccctgcttacgattgatagatacctagctgttgtccatgtcgtgtttgccctgagagcccggactgtcacttttggcatcatcagtagcatcattacctgggtcctggctgccttggtttctattccttgtctctatgttttcaaatcccagatggagttcacttaccatacctgcagagcaattttgcccaggaagagcctgatacgttttttaaggtttcaggctctaacaatgaacatccttgggctaattttgcctctgttggccatgattatctgctacacacggatcatcaatgttttacacagaagacccaataagaagaaggccaaagtcatgcgcctgatttttgttattacgcttctcttcttcctcctcttggccccttattatctggctgcctttgtttctgcttttgaagacgtcctattcacccctagttgtttgagaagccaacaggtggacctgtccttgatgataactgaagcacttgcctacacccactgctgtgtcaacccagtcatttatgtctttgtgggtaaacggttccggaagtacctctggcagttgtttcggaggcatacagctataaccctgccacaatggctgccctttctctcggaggacagagcacagagggccagtgcacgcctcccatccacagtggaaattgagacctctgccgacttataa

SEQ ID NO: 1457 - DNA, 1083 bp, Mus musculus
atggataactacacagtggccccggacgatgaatatgatgtcctaatcttagacgactacctggacaacagtgggccggaccaagttccggcccccgagttcctctccccccagcaggtgctgcagttctgctgcgcggtgtttgcggtgggtctcttggacaacgtgctggcggtgtttatcttggtgaaatacaaaggactcaagaatctggggaacatctacttcctaaacctggcactttcaaacctgtgtttcctgcttcccctgccgttctgggcccatactgcagcacacggggaaagccctggcaacgggacctgtaaagttcttgtcggactccactcctcgggcttatacagcgaggtgttttccaacatcctcctccttgtgcaaggatacagggtgttttcccaagggcgactggcctccatcttcacgacagtgtcttgtggtattgttgcgtgcgtcctggcatgggccatggctactgcgctctctttgcccgagtctgtgttttatgagcctcggatggaaagacagaaacacaagtgtgcctttggcaaacctcacttcttgccaatcgaagcgccgctctggaagtacgttctgacgtcaaaaatgatcatcttggtacttgcttttcctctgctggtttttataatctgctgcaggcaactgaggagaaggcagagcttcagggagagacagtacgacctccacaagccggctcttgtcataacgggcgtgttccttttgatgtgggcgccttacaacactgtgcttttcctgtctgctttccaggaacacttgtccctgcaggatgagaagagcagctaccacctggacgcaagtgttcaggtcacacagctggtagcgaccacccactgctgcgtcaacccgctgctctatttgcttcttgaccggaaggcctttatgagataccttcgcagcctgttcccacggtgcaatgatatcccctatcaaagtagtggaggctctcagcaagcgccgccaaggaaaggtcatggcaggcccattgaactgtacagcaatttgcatcaaaggcaggatataatataa

SEQ ID NO: 1458 - DNA, 1044 bp, Mus musculus
atggaaaccaactactctatccctttgaatggatcagatgtggtgatctatgattctaccatctccagggttctatggatcctctcaatggtggttgtctccatcactttcttccttggtgtgctaggaaatggactagtgatctgggtagctggattccggatgccacacactgtcaccactatctggtatctgaatctagcattggctgacttctctttcacagcaactctaccattccttcttgttgaaatggctatgaaagaaaaatggccttttggctggttcctgtgtaaattagttcacattgcagtagatgtaaacctatttggaagtgtcttcttgattgctgtcattgccttggaccgctgtatttgtgtcctgcatccagtctgggctcagaaccaccgcactgtgagcctggttgttgggtcctggatttttgctctcattctcactttgccccttttcctcttcttgactacagttagagatgctagaggggatgtgcactgtagattgagctttgtatcctggggcaactctgttgaggaaaggttgaacacagctatcacgtttgtaacaactagagggatcatcaggttcattgttagcttcagcttgcccatgtcctttgttgccatctgctatggactcatcacctacaaaattcacaaaaaagcctttgttaattccagccgtccttcccgagttcttacaggagttgtggcttccttctttatctgttggtttcctttccaattggtggcccttttaggcacagtctggctcaaagagatgcagtttagtggtagttataaaattattggcaggttggttaatccaaccagttcattggcctttttcaatagctgcctcaatccaatgctctatgttttcatgggccaggactttcaagaaagactgattcattccctgtcttctcgtctaccgagagccctgagtgaggactctggtcatatcagtgataccagaaccaatttggcttcacttcctgaagacattgaaataaaggcaatatga

SEQ ID NO: 1459 - DNA, 1056 bp, Mus musculus
atggaatccaactactccatccatctgaatggatcagaagtggtggtttatgattctaccatctccagagttctgtggatcctctcaatggtggttgtctccatcactttcttccttggtgtgctgggcaatggactagtgatttgggtagctggattccggatgccacacactgtcaccactatctggtatctgaatctagcattggctgacttttctttcacagcaactctaccattccttcttgttgaaatggctatgaaagaaaaatggccttttggctggttcctgtgtaaattagttcacattgtggtagatgtaaacctgtttggaagtgtcttcttgattgctctcattgccttggaccgctgcatttgtgttctgcatccagtctgggctcagaaccaccgcactgtgagcctggctaggaaggtggttgttgggccctggatttttgctctgattctcactttgcccatttttattttcttgactactgttagaattcctggaggagatgtgtattgtacattcaactttggatcctgggctcaaactgatgaagaaaagttgaacacagctatcacttttgtaacaactagagggatcatcaggttccttattggtttcagcatgcccatgtcaattgttgctgtttgctatggactcattgctgtcaagatcaacagaagaaaccttgttaattccagccgtcctttacgagtccttacagcagttgtggcttccttctttatctgctggtttccctttcagcttgtggcccttttgggcacagtctggtttaaagagacattgcttagtggtagttataaaattcttgacatgtttgttaacccaacaagctcattggcttacttcaatagttgtctcaatccgatgctctatgttttcatgggccaggactttcgtgagagatttattcattccctgccttatagtcttgagagagccctgagtgaggattctggtcaaaccagtgattcaagcaccagttctacttcacctcctgcagacattgagttaaaggccccatga

SEQ ID NO: 1460 - DNA, 1032 bp, Mus musculus
atggaagccaactcctccatcccactgaatggctcagaagtggtgttttatgattctaccacctccagagttctatggatcctctcagtgatagttctctccataacctttgtccttggtgtgctaggtaatgggcttgtgatttgggtggctgggttccggatggcacacactgtgaccaccatctgttatctgaacctggctttgggtgacttctctttcatggttactttaccactacacatcatctcaatggtcatgaaaggaaaatggctttttggttggttcctttgcaaatttgttctcagcattgtgcacataaacctttttgtaagtgttttcttaatcactctcattgccatggatcgttgtacttgtgtcctgcacccagtatgggttcagaatcaccgaactgtgagtctggccaggaaagtgattgttggagcttggattctttctctgctgcttacattgccacattttctcttcttgactacagtgagagatgcaagaggcgaggtgcactgtacatgtaactttgaatctgtggttgcaaaccctgaggagcaattaaaggtgtcaattaccgtgagcacagcaacaggaatcatcagttttattaattgcttcagcctacccatgtccttcattgccgtctgctatggactcatggctgccaagatttgtagaaaaggctttctgaactccagccgtcctttacgtgttctcactgctgtagcaatttccttctttatgtgttggttcccttttcaactgattattcttctaggtaatatctggaataaggagacaccaagcagcattcacattttgttgaacccagcaagcacactggcttccttcaacagctgtctcaacccaatactctatgtctttcttggtcaagaatttagagagaaactgatatattccctgtctgccagtctggagagggcgctgcgagaagactcagtcctaagcagtggcaaaagcagcaacttttcttcatgtcctgccgactctgaactatag

SEQ ID NO: 1461 - DNA, 972 bp, Mus musculus
atggaagtcaacatttcaatgcctctgaatggatcagaagttgtgttttatgattctaccacctcaagtgttctatggatcctctcattagtggttctctttataacctttgtcctcggtgttctaggtaatgggcttgtgatttgggtggctgggttccagatggcacacactgtgaccactgtctcttatctgaacttggctttgagtgatttatctttcatggttactctaccacttcacatcatctcaatggtcatgagaggaaaatggctttttggttggtttctttgcaaattagttcacataattgcaaacataaacctttttgtaagtatcttcctaatcactcttattgccatggatcgctgtatttgtgtcctgtgcccagtatggtctcagaatcaccgaactgtgagtctggccagaaaagtggttcttggagcttggatatttgctctgctgcttaccttgccacattttctcttcttgactacagtgagagatgcaagaggggatgtgtactgtatatctaaatttgaatcctgggttgcaacctctgaagagcagttaaagatgtctgttattgctgccacagcttcaggaatcatcaatttcattattggattcagcatgcccatgtctttcattgctatctgctatggactcatggctgccaagatctgcagaagaggctttgtgaattccagtcgtcctttacgtgtcctcactgctgtagcgatttccttctttgtctgttggttcccttttcaattaattatgcttttaggcaacatctttaacaatgagacactgagcattattcatatgttggttaacccagcaaataccttggcttcctttaacagctgcctcaacccaatactctatgtattcctgggtcaggaattcagagacagactaatctattctctgtatgccagtctagagagggccctgagggaagactag

SEQ ID NO: 1462 - DNA, 1020 bp, Mus musculus
atggatttgatcaactcctccactcatgtgatcaatgtgtctacctcgttaacaaacagcactggtgttccaactcctgcccccaaaacaatcattgctgcttctttgttcatggcatttataattggtgtcatcagcaacggcctctatctatggatgctgcaattcaagatgcaaaggactgtcaatactcttttatttttccatctcattctctcctattttatttccacattgattctgcccttcatggccacctccttccttcaggacaatcactgggtctttggaagtgtcttgtgcaaagccttcaacagcactttgtcggtgagcatgtttgcctctgttttcttcctctccgccatcagtgttgctcgttattacctcattcttcatccagtgtggtcccagcagcaccgaaccccacactgggcttcccggattgccttgcaaatctggatttctgccactatcctcagcataccctatttagttttcaggacaacacatgatgaccacaaaggaagaattaaatgccagaataactacattgtgtctactgactgggagagcaaagagcatcaaacactagggcaatggattcatgcagcctgtttcgtcggccgcttcttgctgggtttccttctgcctttccttgtcatcatcttttgctacaaacgagtggccaccaagatgaaagagaagggactctttaaatccagcaagcccttcaaagtcatggtgactgctgtcatctctttctttgtgtgttggatgccctaccatgtacacagtggcttggtcctcactaagagtcagccattacctttacacttgacactgggacttgcagtggtgactatttcttttaatactgtggtttctcctgttctctatctattcactggggagaatttcaaggttttcaagaaatctattcttgctctctttaactcaacattcagtgatatctcttctacagaaaggacacaaaccctgaactcagaaactgaaatttaa

SEQ ID NO: 1463 - DNA, 966 bp, Mus musculus
atggagccattggcaatgaccttgtatcctctggaatccacacaacccaccagaaacaaaaccccaaatgaaaccacctggtcttcagagcatacggatgaccacacttacttcttagtctccctggtcatttgttccctgggactggctgggaatggccttttgatatggttcctaatcttctgtatcaagaggaagccattcaccatctacatcctccatctcgccattgcagacttcatggtcctcctctgttcgtccatcatgaagctagtgaacacttttcacatctacaatatgaccttagagagctacgccatcctcttcatgatctttggctacaacacagggctccacctcctcacggccatcagcgtagagcggtgcctctccgtgctttatccaatctggtaccagtgccaacgcccaaaacaccagtccgctgtggcctgtatgctgctgtgggccctctctgttctcgtgtctggtttggaaaacttcttctgcattctggaagtgaagccccaattcccagaatgccgatacgtgtacatattctcctgtatcttgactttcctggtcttcgttcctctcatgatcttctctaatttgatcctcttcatccaagtctgctgtaacctgaagccacgtcaaccgaccaagctctatgtgatcatcatgaccacggtcatcctgtttcttgtcttcgccatgcccatgaaggtgttgcttatcatcggctactattctagttctcttgatgattctgtatgggactccctcccctacctgaacatgctgtccactataaactgcagcatcaacccaattgtctactttgtggtaggcagcctgaggaggaagaggagtaggaagtccctaaaagaagcactgcagaaagtcttcgaggaaaagccagtggtggcctcgagggagaatgtgacacagttctcgctgccttcatga

SEQ ID NO: 1464 - DNA, 1113 bp, Mus musculus
atggaagtttctaacctctcaggcgccactcccggccttgcctttcctccgggacctgagagctgcagtgacagcccaagttccggcaggagcatgggatccaccccaggtgggctcatcttgcccggccgcgagccgcccttctctgctttcaccgtgcttgtggtgactctactggtgttgctgatcgctgccactttcttatggaatctgctagttctggtgactatcctgcgcgtccgcgccttccaccgcgtgccacataacttggtggcctcgacagccgtctcggatgtcctggtggcggttctggtgatgcctctgagcctggtgagcgagttgtccgctgggcgacgttggcagctaggcaggagtctgtgccacgtgtggatctccttcgacgtgttgtgctgcaccgccagcatctggaacgtggcggccatcgccctggatcgctactggactatcacgcgccacctgcagtacacgctgcgcacccggagccgtgcttctgcgctcatgatcgcgatcacctgggcactgtccgcgctcattgctctcgccccgctgctttttggctggggcgaagcctatgatgctcggctgcagcgttgccaggtgagccaggagccctcctatgctgtcttctccacctgcggagccttctacctgcctctagcggtggtgctcttcgtctactggaaaatatacaaagccgccaagtttcgattcggtcgcagacggcgggcggtggtaccgcttcctgccaccacgcaggcaaaggaagcacctccggagtctgagatggtgttcacagcccgtcgccgagcaacagtgaccttccagacaagcggagactcctggcgggagcagaaggagaagcgggcagccatgatggtcgggatcttgattggcgtgtttgtgctttgttggatccccttcttcctgacggagctcatcagcccgctctgtgcctgcagcctgccacccatctggaaaagcatattcctgtggcttggatattccaattcgttcttcaaccccttgatttacactgcctttaataagaattacaacaatgccttcaagagcctctttactaagcagagataa

SEQ ID NO: 1465 - DNA, 1088 bp, Mus musculus
acagaagccagagagctacatccagcaagaggaatgggggaaagcagcacctgtgcagggtttctagccctaaacacatcggcctcgccaacagcacccacaacaactaatccaatggacaataccatccctggaggtatcaacatcacgattctgatcccaaacttgatgatcatcatcttcggactggtcgggctgacaggaaatggcattgtgttctggctcctgggcttctgtttgcacaggaacgccttctcagtctacatcctaaacttagctctagctgacttcttcttcctcctaggtcacatcatagattccatactgcttcttctcaatgttttctacccaattacctttctcttgtgcttttacacgatcatgatggttctctatatcgcaggcctgagcatgctcagtgccatcagcactgagcgctgcctgtctgtactgtgccccatctggtatcactgtcaccgcccagaacacacatcaactgtcatgtgtgctgtcatctgggtcctgtccctgttgatctgcattctgaatagttatttctgcggtttcttaaatacccaatataaaaatgaaaatgggtgtctggcattgaacttctttactgctgcatacctgatgtttttgtttgtggtcctctgtctgtccagcctggctctggtggccaggttgttctgtggtactgggcagataaagcttaccagattgtatgtaaccattattctgagcattttggtttttctcctttgcggattgccctttggcatccactggtttctgttattcaagattaaggatgattttcatgtatttgatcttggattttatctggcatcagttgtcctgactgctattaatagctgtgccaaccccatcatttacttcttcgtgggatccttcaggcatcggttgaagcaccagaccctcaaaatggttctccagaatgcactgcaagacactcctgagacagccaaaatcatggtggagatgtcaagaagcaaatcagagccatgatgaagagcctttgcctggcccttagaagtggctttggggtgagcattgccctgctgcac

SEQ ID NO: 1466 - DNA, 1234 bp, Mus musculus
tctgtagtgactgtatctttccttctacacaagccagtgagctacatccaacaagaggattggggaaagcaatggtgaagcatttcttgcctttaagacctcagcctcaccaacagcaccagtgacaacaaatccaatggacgaaaccctccctggaagtatcaacattaggattctgatcccaaaattgatgatcatcatcttcggactggtcggactgatgggaaacgccattgtgttctggctcctgggcttccacttgcgcaggaatgccttctcagtctacatcctaaacttggccctggctgacttccttttcctcctcagtagtatcatagcttccaccctgtttcttctcaaagtttcctacctcagcatcatctttcacttgtgctttaacaccattatgatggttgtctacatcacagggataagcatgctcagtgccatcagcactgagtgctgcctgtctgtcctgtgccccacctggtatcgctgccaccgtccagtacatacatcaactgtcatgtgtgctgtgatctgggtcctatccctgttgatctgcattctgaatagctatttctgtgctgtcttacataccagatatgataatgacaatgagtgtctggcaactaacatctttaccgcctcgtacatgatatttttgcttgtggtcctctgtctgtccagcctggctctgctggccaggttgttctgtggcgctgggcagatgaagcttaccagatttcatgtgaccatcttgctgacccttttggtttttctcctctgcgggttgccctttgtcatctactgcatcctgttattcaagattaaggatgatttccatgtattagatgttaatttttatctagcattagaagtcctgactgctattaacagctgtgccaaccccatcatctacttcttcgtgggctctttcagacatcagttgaagcaccagaccctcaaaatggttctccagagtgcactgcaggacactcctgagacagctgaaaacatggtagagatgtcaagtaacaaagcagagccttgatgaagagcctctacctggacctcagaggtggctttggagtgagcactgccctgctgcacttgaccactgtccactcttctctcagcttactgatttgacatgcctcagtggtccaccaacaacttcaacatctctccactaacttagtttttctacccctcctgaataaaagcattaatc

SEQ ID NO: 1467 - DNA, 1296 bp, Mus musculus
agaaatattctgtagtgactgtatccttccttctacacaagccagcaagctacatccagcaagaggaatgggagaaagcaacaccagtgcagggtttctggcccgaaacacctcagcctcgacaatgacacccacaacaacaaattcaatgaacgaaaccatccctggaagtattgacatcgagaccctgatcccagacttgatgatcatcatcttcggactggtcgggctgacaggaaatgcgattgtgttctggctccttggcttccgcatgcacaggactgccttcttagtctacatcctaaacttggccctggctgacttcctcttccttctctgtcacatcataaattccacagtggatcttctcaagtttaccctacccaaaggaatttttgccttttgttttcacactatcaaaagggttctctatatcacaggcctgagcatgctcagtgccatcagcactgagcgctgcctgtctgtcctgtgccccatctggtatcactgccgccgcccagaacacacatcaactgtcatgtgtgctgtgatctgggtcctgtccctgttgatctgcattctggatggttatttctgcggttacttagataaccattatttcaattactctgtgtgtcaggcatgggacatctttatcggagcatacctgatgtttttgtttgtagtcctctgtctgtccaccctggctctactggccaggttgttctgtggtgctaggaatatgaaatttaccagattattcgtgaccatcatgctgaccgttttggtttttcttctctgtgggttgccctggggcatcacctggttcctgttattctggattgcacctggtgtgtttgtactagattatagccctcttctggtcctaactgctattaacagctgtgccaaccccattatttacttcttcgtgggctccttcaggcaacggttgaataaacagaccctcaaaatggttctccagaaagccctgcaggacactcctgagacacctgaaaacatggtggagatgtcaagaaacaaagcagagccgtgatgaagagcctctgcctagacttcagaggtggatttggagtgagcactgccctgctgcacttgaccactgtccactctcctctcagcttactgacttgacatgcctcactggtccaccaacaccttccaaagctctccactgacttagtatttatacctctcccaaacaatagcattattcaaaaactataatttctgcatccttctttacattaataaaattcccatactaagttcaaa

SEQ ID NO: 1468 - DNA, 1503 bp, Mus musculus
tgaactcctagggactaagccatcaacaaaagagtacacatggctccagatgcatatgttgcagaggatggccatatcatgcattgatggaagaggtccttgaacctatgaaggttctattgatgccccagtgtaagggaatcgagggcagagaggtggaagtgggtgtgtgggttgagcaacaccctcacagaagcagggggagggaggatgagatgggggtttccaggaaggggggaagcaggaaaggggataacattttaaatttaaatatagaaaatatccaatacaaaacattttgaacaaacaacaaaaaactcacaaaaacaacaacaacaaaaaaaagaaattaaaagttgtgttcatagtgaaggcctcatttcttctttgtgttcccagcaacaccagtgcagggtttctggccctaaacacctcagcctcggcaatggcacccacaacaacaaatccaatgaacgaaaccatccctggaagtattgacatcgagaccctgatcccaaacttgatgatcatcatcttcggactggtcgggctgacaggaaatgtcattttgttttggctcctgggcttccacttgcacaggaatgccttcttagtctacatcctaaacttggccctggctgacttcctcttccttctctgtcacatcataaattccacaatgcttcttctcaaggttcacctacccaacaatattttgaaccattgctttgacatcatcatgacagttctctacatcacaggcctgagcatgctcagtgccatcagcactgagcgctgcctgtctgtcctgtgccccatctggtatcggtgccgccgcccagaacacacatcaactgtcctgtgtgctgtgatctggttcctgcccctgttgatctgcattctgaatggatatttctgtcatttctttggtcccaaatatgtaattgactctgtgtgtctggcaacgaacttctttatcagaacatacccgatgtttttgtttatagtcctctgtctgtccaccctggctctgctggccaggttgttctgtggtggtgggaagacgaaatttaccagattattcgtgaccatcatgctgaccgttttggtttttcttctctgtgggttgcccctgggcttcttctggtttctggtgccgtggattaaccgtgatttcagtgtactagattatatactttttcagacatcacttgtcctaacttctgttaacagctgtgccaaccccatcatttacttctttgtgggctccttcaggcatcggttgaagcacaagaccctcaaaatggttctccagagtgcattgcaggacactcctgagacacctgaaaacatggtggagatgtcaagaagcaaagcagagccgtgatgaagagcctctacctggacctcagaggtggctttggattgagcactgccctgctgcacttgaccactgtccactctcctctcagcttactgactttggatgcctcagtggtccaa

SEQ ID NO: 1469 - DNA, 970 bp, Mus musculus
gtgtcaccaacagcacccacaacaaatccaatggacaaacctctttggaagtatggacatctggattctgacccgaaactagatgatcatcatattcagactggttgggatgacaggaaatgccattgtgttctggctcctgggcttcagcttgcacaggaatgccttctcagtctacattttaaacttggcccttgctgacttcgtcttcctcctctgtcacatcatagattccatgctgcttcttctcactgttttctaccccaacaatatcttttctgggtacttttacaccatcatgacggttccctacatcgcaggcctgagcatgctcagtgccatcagcactgagctctgcctgtctgtcctgtgccccatctggtatcgctgccaccacccagaacacacatcaactgtcatgtgtgctgcgatatgggtcctgcccctgttggtctgcattctgaataggtatttctgcagtttcttagatatcaattataacaatgacaaacagtgtctggcatcaaacttctttactagagcatacctgatgtttttgtttgtggtcctttgtctgtccagcatggctctgctggccaggttgttctgtggcactgggcagatgaagcttaccagattgtacgtgaccatcatgctgactgttttgggttttctcctctgtgggttgccctttgtcatctactacttcctgttattcaatattaaggatggtttttgtttatttgattttagattttatatgtcaacacatgtcctgactgctattaacaactgtgccaaccccataatttactttttcgagggctccttcaggcatcagttgaagcaccagaccctcaaaatggttctccagagtgtactgcaggacactcctgagatagctgaaaatatggtggagatgtcaagaaacataccaaagccatgatgaaaagcctttgcctggacctca

SEQ ID NO: 1470 - DNA, 1024 bp, Mus musculus
ccagtgcacgaaaccatgcatagaagtatcagcatcaggattctgataacaaacttgatgatcgtcatcctcggactagtcgggctgacaggaaacgccattgtgttctggctcctgctcttccgcttgcgcaggaacgccttctcaatctacatcctaaacttggccctggctgacttcctcttcctcctctgccacatcatagcttccacagagcatattctcacgttttcctcccccaacagtatctttatcaattgcctttacaccttcagggtgcttctctacatcgcaggcctgagcatgctcagtgccatcagcattgagcgctgcctgtctgtcatgtgccccatctggtatcgctgccacagcccagaacacacatcaactgtcatgtgtgctatgatctgggtcctgtctctattgctctgcattctgtataggtatttctgcggcttcttggataccaaatatgaagatgactatgggtgtctagcaatgaacttccttactaccgcatacctgatgtttttgtttgtagtcctctgtgtgtccagcctggctctgctggccaggttgttctgtggcgctggacggatgaagcttaccagattatacgtgaccatcacgctgacccttttggtttttctcctctgcgggttgccctgtggcttctactggttcctgttatccaaaattaagaatgtttttactgtatttgaatttagtctttatctggcatcagttgtcctgactgctattaacagctgtgccaaccccatcatttacttctttgtgggctcattcaggcatcggttgaagcaccagaccctcaaaatggttctccagagtgcactgcaggacactcctgagacacctgaaaacatggtggagatgtcaagaaacaaagcagagctgtgatgaagagcctctgcccggacctcagaggtggctttggagtgagcactgccctgctgcacttggccactgtccactctcctctcagcttactcacttggcatgc

SEQ ID NO: 1471 - DNA, 1045 bp, Mus musculus
tttgtgttcatagtgaatgactaatttcttctttgtgttcccagtgcagagtttctggccctaaacacctcagcctcagcaatgtcacccacgacaacaagtccaatggacgaaaccagccctagaagtattgacatcgagtcactgatcccaaacttgatgatcatcatctttggactggttgggctgacaggaaatgccattgtgctctggctcctgggcttctgcttgcacaggaatgccttcttagtctacatcctaaacttggccctggctgacttcctcttccttctctgtcacttcataaattcagcaatgtttcttctcaaggttcctatacccaacggtatctttgtctattgcttttacaccatcaaaatggttctctacatcacaggcctgagcatgctcagtgccatcagcactgagcgctgcctttctgtcctgtgccccatctggtatcactgccgccgcccagaacacacatcaactgtcatgtgtgctgtgatttggatcttttccgtgttgatctgcattctgaaagaatatttctgtgatttctttggtaccaaattgggaaattactatgtgtgtcaggcatccaacttctttatgggagcatacctaatgtttttgtttgtagtcctctgtctgtccaccctggctctgctggccaggttgttctgtggtgctgagaagatgaaatttaccagattattcgtgaccatcatgctgaccattttggtttttctcctctgtgggttgccatggggcttcttctggttcctgttaatctggattaagggtggttttagtgtactagattatagactttatttggcatcaattgtcctaactgttgttaacagctgtgccaaccccatcatttacttcttcgtgggatcattcaggcatcggttgaagcaccagaccctcaaaatggttctccagagtgcactgcaggacactcctgagacacatgaaaacatggtggagatgtcaagaatcaaagcagagcagtgatgaagagcctctgcctggacct

SEQ ID NO: 1472 - DNA, 980 bp, Mus musculus
tagacacctcagcatatgcaatggcacccacgaccacaaatccaatggacaaaaccatccttggaagtattgacatcgagaccctgatccgacatttgatgatcatcatcttcggactggtcgggctgacaggaaatgccattgtgttctggctcctgggcttccacttgcacaggaatgccttcttagtctacatcctaaacttggccctggctgacttcttctatctgctctgtcacatcataaattccataatgtttcttctcaaggttccctcacccaacattatcttggaccattgcttttacaccatcatgatagttctctacatcacaggcctgagcatgctcagcgccatcagcactgagcgctgcctgtctgtcctgtgccccatctggtatcgctgccaccgtccagaacacacatcaactgccatgtgtgctgtgatctgggtaatgtccctgttgatctctattctcaatggatatttctgtaatttctctagtcccaaatatgtaaataactctgtgtgtcaggcatcagacatctttatcagaacatacccaatatttttgtttgtactcctctgtctgtccacccttgctctgctggccaggttgttctctggtgctgggaagaggaaatttaccagattattcgtgaccatcatgctggccattttggtttttcttctctgtgggttacccctgggcttcttctggtttctgtcaccctggattgaggatcgtttcattgtactagattatagacttttttttgcatcagttgtcctaactgttgttaacagctgtgccaaccccatcatttacttctttgtgggctccttcaggcatcggttgaagcaacagaccctcaaaatgtttctccagagagcactgcaggacacccctgagacacctgaaaacatggtggagatgtcaagaagcaaagcagagccgtgatgaagagcctcttccagg

SEQ ID NO: 1473 - DNA, 1361 bp, Mus musculus
tcttttttttttttcattgcagaactgagattgcaccactcctgaaaatggacttagtcatccaagactggaccattaatattacagcactgaaagaaagcaatgacaatggaatatcattttgtgaagttgtgtctcgtaccatgacttttctttccctcatcattgccttagttgggctggttggaaatgccacagtgttatggtttctgggcttccagatgagcaggaatgccttctctgtctacatcctcaaccttgctggtgctgactttgtcttcatgtgctttcaaattgtacattgtttttatattatcttagacatctacttcatccccactaattttttttcatcttacactatggtgttaaacattgcttaccttagtggtctgagcatcctcactgtcattagcactgaacgcttcctatctgtcatgtggcccatctggtaccgctgccaacgcccaaggcacacatcagctgtcatatgtactgtgctttgggtcttgtccctggtgttgagcctcctggaaggaaaggaatgtggcttcctatattacactagtggccctggtttgtgtaagacatttgatttaatcactactgcatggttaattgttttatttgtggttctcttgggatccagtctggccttggtgcttaccatcttctgtggcttacacaaggttcctgtgaccaggttgtatgtgaccattgtgtttacagtgcttgtcttcctgatctttggtctgccctatgggatctactggttcctcttagagtggattagggaatttcatgataataaaccttgtggttttcgtaacgtgacaatatttctgtcctgtattaacagctgtgccaaccccatcatttacttccttgttggctccattaggcaccatcggtttcaacggaagactctcaagcttcttctgcagagagccatgcaagactctcctgaggaggaagaatgtggagagatgggttcctcaagaagacctagagaaataaaaactgtctggaagggactgagagctgctttgatcaggcataaatagctttgaagagaactatgtttttatcactttgtggcattttcataatgttgtttagttgatgacccaaggttaactcagttggggaagtagtcaatgttgtagaagttgattgatattgaacttgttataaatactgagtacagtatttttgcagctatcttgctcagagctttaccaactccatttgatgggactccttataagctctatggggtccaggagaggtgttgaccacaattgacaaatccctcttcagaagaaaactcaagaaagtgcaatgaaaagttatatttcttt

SEQ ID NO: 1474 - DNA, 1300 bp, Mus musculus
tgtttcaggaacatgagtggagatttcctaatcaagaatctaagcacctcagcctggaaaacgaacatcacagtgctgaatggaagctactacatcgatacttcagtttgtgtcaccaggaaccaagccatgattttgctttccatcatcatttccctggttgggatgggactaaatgccatagtgctgtggttcctgggcatccgtatgcacacgaatgccttcactgtctacattctcaacctggctatggctgactttctttacctgtgctctcagtttgtaatttgtcttcttattgccttttatatcttctactcaattgacatcaacatccctttggttctttatgttgtgccaatatttgcttatctttcaggtctgagcattctcagcaccattagcattgagcgctgcttgtctgtaatatggcccatttggtatcgctgtaaacgtccaagacacacatcagctatcacatgttttgtgctttgggttatgtccttattgttgggtctcctggaagggaaggcatgtggcttactgtttaatagctttgactcttattggtgtgaaacatttgatgttatcactaatatatggtcagttgttttttttggtgttctctgtgggtctagcctcaccctgcttgtcaggatcttctgtggctcacagcgaattcctatgaccaggctgtatgtgactattacactcacagtcttggtcttcctgatctttggtcttccctttgggatctattggatactctatcagtggattagcaatttttattatgttgaaatttgtaatttttatcttgagatactattcctatcctgtgttaacagctgtatgaaccccatcatttatttccttgttggctccattaggcaccgaaggttcaggcggaagactctcaagctacttctgcagagagccatgcaagacacccctgaggaggaacaaagtggaaataagagttcttcagaacaccctgaagaactggaaactgttcagagctgcagctgacaactgcttgatcagacaaaaatggttttgatggaaatactttttcttatccgtgtggaccatttttacaacctttattcagtttgttatctcatcttcaattgtttaattaggacaataatttttgtaaaagttgagagaaatgggtcttgtcatactaatactgaatgtagcatttctgaagctgtgttacttagggatttaccatctccttttcatgggactccttgtaagtattctgtggtagagaacttctcctattgttgacaaa

SEQ ID NO: 1475 - DNA, 1009 bp, Mus musculus
ttttctaagcatggctctaagaacctcactaataaccaccacagcaccggataaaaccagccttccaatttcaatttgtatcatcaagttccaagtcatgaatttgctttccatcaccatttcccctgttgggatggtactgaatatcatagtgctgtggttcctgggcttccagatatgcaggaatgccttctctgcctacatcctcaacctggctgtggctgattttctcttcctgtgttctcattctatattttcttttcttattgtctgcaaactgcactattttttattctacattagacagcttttggatactgtgacaatgtttgcttatgtttttggcctgagcattaccaccatcattagcattgagtgctgcctgtctatcatgtggcccatctggtatcactgccaacgtccaagacacacatcagctgtcatttgtgtcttgctttgggctctatctctgctgtttcctgctctgcagatggaaaaatgtagcgtcctgtttaatacttttgaatattcttggtgtgggataatcaatataatctctggtgcatggttagttgttttatttgtggttctctgtgggttcagcctcatcctgctcctcaggatctcctgtggatcacagcagattcctgtgaccaggctgaatgtaactattgcactcagagtgctactcctcctgatctttggtattccctttgggatcttctggatagttgacaaatggaatgaagaaaattttttcgttagagcttgtggtttttcacatcatatactatacgtatactgtattaacatctgtgtcaatgctaccatatacttccttgttggctccattaggcatggcaagtttcagaagatgactctgaagctgattctgcagagagctatacagggcacccccgaggaagaaggtggagagaggggtccttaaggaaatactgaagaactgggaacagtctagtgcagcaaccgagagctgctttaataataa

SEQ ID NO: 1476 - DNA, 1219 bp, Mus musculus
tttatggacctgtgccagatattcctacataatcacatggtcctgactgagactatcttgtgttcatatctcgatttctttgcaggaatgccagtggaaaattcctaagcatgggtacaaccaccctggcctggaacattaacaacaccgctgaaaatggaagttacactgaaatgttctcctgtatcaccaagttcaataccctgaattttcttactgtcatcatagctgtggttggcctggcaggaaacggcatagtgctatggcttctagccttccacctgcataggaatgccttctctgtctatgtcctcaatctggctggtgctgatttcttgtaccttttcactcaagttgtgcattccctggaatgtgtccttcagttagataataactccttttatattctcctcattgtaacaatgtttgcttaccttgcaggtttgtgtatgattgcagccatcagtgctgaacgctgcctatctgttatgtggcctatctggtatcactgccaaagaccaagacacacatcagccatcatgtgtgctctggtctgggtttcctctctattgttgagcctcgtggtagggctaggctgtggttttctgttcagttattatgattattatttctgtattactttgaattttatcactgctgcatttttaatagtgttatctgtggttctttctgtatctagcctggccctgttggtgaagattgtgtgggggtcacacaggattcctgtgaccaggttctttgtgaccattgctctcacagtggtggtcttcatatactttggcatgccctttggtatctgctggttcctcttatcaaggattatggagtttgatagcattttctttaacaatgtttatgaaataatagaattcctgtcctgtgttaacagctgtgccaatcccatcatttacttccttgttggctccattagacaacacaggttgcgatggcagtctctgaagctacttcttcagagagccatgcaggacactcctgaggaagagagtggagagaggggtccttcgcaaaggtctggggaactggaaacagtctagtacagtagttgagtgagtccctggtcaaacatagtttctgtgagagtcaattttgcctttatctatataagcaattttcataatttgtttaatcagtagagaatatagtcattttatagaaattaggagaaatgagcttgtta

SEQ ID NO: 1477 - DNA, 1281 bp, Mus musculus
atggtcctgacagagagtatcatgtgttcatatctctatttttttgcgggaacaccactggaaacttcctaaacatgggtctaaccactccagcctggaacattaacaacacagtagtgaatggaagtaacaatactgaacatttctcctgtgtcagcaagttcaataccctgaactttcttactgtcatcattgccatgtttggcctggcaggaaatgccatagtcctatggcttctagccttccacctgcctaggaatgccttctctgtctatgtctgcaacttggcttgtgctgatttcttgcaactttgcactcagattttaggttccctggaatgtttccttcagttaaataggagacacactttttttctcaccgttgtatttatgtttgcttaccttgcaggtttgtgtatgattgcagccatcagtgttgagcgctctctatctgttatgtggcccatctggtatcactgccaaagaccaagacatacatcatccatcatgtgtgctctgctctgggctttctgtctactgttgaatttcctattaggggaaggctgtggccttctgttcagtgatcctaaatattatttctgtattacttgtgccttaatcactactgcacttataatattattaactgtggttccttctgtgtccagcctggccctgttggtcaagatgatctgtggatcacacaggattcctgtgaccaggttctatgtgaccattgctctcacattggtggtcttcatattcttgggtctgccctttgggatttactcatctttcttgataatgtttaaggagtttcaaagcattttctcttaccatgtccttgaagtgacaatattcctgtcctgtgttaacagctgtgccaatcccatcatttactttcttgttggctccattaggcagcacaggttgcaatggcagtctctgaagctacttcttcagagagccatgcaggacactcctgaggaagatagtggagagagggttccctcacaaaggtctggggaactggaaagtgtttagtgcagtagttgagtgagtctttgatcagacatggttactctgagagtcagttttgcctttgtttatgtaagcaattttcacaatcttgtacaatttgtaaagaaatagtcattttatagaaattgggagaaaggggcttgttacacagaaactgagtgcaacaccataaagctgtcttatgtgggtctcattacattctcttgtgatataagccttgtaatcacttgggaacaaaact

SEQ ID NO: 1478 - DNA, 1149 bp, Mus musculus
atggatggtcccagcaatgtctcactcgttcacggtgacaccacactgggcctcccagagtacaaagtagtctcggtcctcctggtcctcctggtgtgcaccgtgggcatcgtgggcaatgccatggtggtcctggtggtgctgacctcacgtgacatgcacacacccaccaactgctacctggtcagcctggctctcgctgacctcattgtgctgctggctgcggggctgcccaatgtctctgacagcctggtggggcactggatctatggacatgctggctgcttgggcatcacctacttccagtacctaggcatcaatgtctcctcctgctccatcctggccttcactgtggagaggtacatcgccatttgccacccaatgagagcacagaccgtgtgcactgtggcccgggccagacggatcatcgcaggcatttggggggtcacgtccctctattgcttactctggttctttctggtggacctcaatgtccgtgacaaccagcgcctggaatgtggctacaaggtgtcccgaggcctctacctgcccatctacctgctggactttgctgtcttcttcattgcacccttgctggggaccctcgtgctctatgggttcattggaaggatcttatttcagagcccattgtcccaggaggcctggcagaaggagaggcagtcccatgggcagagcgagggtacaccaggcaactgctctaggtccaagagctcaatgtcctccaggaagcaggccaccaggatgctggccgtgattgtgttgctctttgcagtgctctggaccccctaccgcacactggtgctgctcaactccttcctggcccggcctttcctggacccctgggtcctgctgttctgccgcacctgcgtctacaccaacagtgccatcaaccctgtcatctacagcctcatgtcgcagaaattccgggcagccttcctgaaactgtgctggtgccgggcagctgggtcccagagacgtgcagcatgcgcccccaccagcaactacagtgctgcccaggagacctccctaggaactgagaagatgcaactgggctcccgtgaggtctcaggtccagcagcagctgcttccctgcgttgccagcatgagccccacttcagtgtgctctga

SEQ ID NO: 1479 - protein, 359 aa, Homo sapiens
MQVPNSTGPDNATLQMLRNPAIAVALPVVYSLVAAVSIPGNLFSLWVLCRRMGPRSPSVIFMINLSVTDLMLASVLPFQIYYHCNRHHWVFGVLLCNVVTVAFYANMYSSILTMTCISVERFLGVLYPLSSKRWRRRRYAVAACAGTWLLLLTALCPLARTDLTYPVHALGIITCFDVLKWTMLPSVAMWAVFLFTIFILLFLIPFVITVACYTATILKLLRTEEAHGREQRRRAVGLAAVVLLAFVTCFAPNNFVLLAHIVSRLFYGKSYYHVYKLTLCLSCLNNCLDPFVYYFASREFQLRLREYLGCRRVPRDTLDTRRESLFSARTTSVRSEAGAHPEGMEGATRPGLQRNESVF

SEQ ID NO: 1480 - DNA, 1077 bp, Homo sapiens
atgcaggtcccgaacagcaccggcccggacaacgcgacgctgcagatgctgcggaacccggcgatcgcggtggccctgcccgtggtgtactcgctggtggcggcggtcagcatcccgggcaacctcttctctctgtgggtgctgtgccggcgcatggggcccagatccccgtcggtcatcttcatgatcaacctgagcgtcacggacctgatgctggccagcgtgttgcctttccaaatctactaccattgcaaccgccaccactgggtattcggggtgctgctttgcaacgtggtgaccgtggccttttacgcaaacatgtattccagcatcctcaccatgacctgtatcagcgtggagcgcttcctgggggtcctgtacccgctcagctccaagcgctggcgccgccgtcgttacgcggtggccgcgtgtgcagggacctggctgctgctcctgaccgccctgtccccgctggcgcgcaccgatctcacctacccggtgcacgccctgggcatcatcacctgcttcgacgtcctcaagtggacgatgctccccagcgtggccatgtgggccgtgttcctcttcaccatcttcatcctgctgttcctcatcccgttcgtgatcaccgtggcttgttacacggccaccatcctcaagctgttgcgcacggaggaggcgcacggccgggagcagcggaggcgcgcggtgggcctggccgcggtggtcttgctggcctttgtcacctgcttcgcccccaacaacttcgtgctcctggcgcacatcgtgagccgcctgttctacggcaagagctactaccacgtgtacaagctcacgctgtgtctcagctgcctcaacaactgtctggacccgtttgtttattactttgcgtcccgggaattccagctgcgcctgcgggaatatttgggctgccgccgggtgcccagagacaccctggacacgcgccgcgagagcctcttctccgccaggaccacgtccgtgcgctccgaggccggtgcgcaccctgaagggatggagggagccaccaggcccggcctccagaggcaggagagtgtgttc

SEQ ID NO: 1481 - protein, 344 aa, Mus musculus
MTSNFSQPALQLCYENTNGSCIKTPYSPGPRVILYMVYGFGAVLAVCGNLLVVISVLHFKQLHSPANFLIASLASADFLVGISVMPFSMVRSIESCWYFGDAFCSLHSCCDVAFCYSSALHLCFISVDRYIAVTDPLVYPTKFTVSVSGICISISWILPLVYSSAVFYTGISAKGIESLVSALNCVGGCQVVVNQDWVLISFLLFFIPTVVMIILYSKIFLVAKQQAVKIETSVSGNRGESSSESHKARVAKRERKAAKTLGVTVVAFMVSWLPYTIDALVDAFMGFITPAYVYEICCWSAYYNSAMNPLIYAFFYPWFRKAIKLILSGKILKGHSSTTNLFSE

SEQ ID NO: 1482 - DNA, 1032 bp, Mus musculus
atgaccagcaacttttcccaaccagccctgcagctctgctatgagaacacgaatggatcctgtattaaaactccctattctccagggccccgggtcatcctgtacatggtctatggctttggggctgtgctggcagtgtgtgggaacctcctggtggtgatttcagttctccatttcaagcagctgcactctccagccaattttctcatcgcctctctggccagtgctgacttcttggtgggcatctctgtgatgcccttcagcatggtcaggtccattgagagctgctggtactttggagatgcattttgtagccttcacagttgctgtgatgtggctttgtgttactcttctgccctccacctgtgcttcatctcagtggacaggtacatagctgtcacggaccctctggtctatcccaccaagttcacagtgtctgtgtctggaatttgcatcagcatctcctggattctgcccctggtatacagcagtgcagtgttctacacaggcatcagtgctaaggggattgaaagcttagtaagtgctctgaattgtgtagggggctgccaagttgttgtcaatcaagactgggttttgataagttttcttttattcttcatacctaccgttgttatgatcattctttacagcaaaatatttttggtagccaaacagcaagctgtaaaaattgaaacttctgtaagtggcaacagaggtgaatcatcctcagagagtcacaaagccagagtggccaagagagagaggaaggctgcaaaaaccttgggggtcactgtggtggcttttatggtctcgtggctcccatacacaattgatgcattggttgatgctttcatgggcttcatcactcctgcctatgtctatgaaatctgttgctggagtgcctattataactcagccatgaaccctttgatttatgctttcttttatccttggtttaggaaagccataaagcttattttaagtgggaaaattctaaagggacattcatcaactacaaatttattttcagag

SEQ ID NO: 1483 - protein, 344 aa, Mus musculus
MTSNFSQPALQLCYENTNGSCIKTPYSPGPRVILYMVFGFGAVLAVCGNLLVVISVLHFKQLHSPANFLIASLASADFLVGISVMPFSMVRSIESCWYFGDAFCSLHSCCDVAFCYSSALHLCFISVDRYIAVTDPLVYPTKFTVSVSGICISISWILPLVYSSAVFYTGISAKGIESLVSALNCVGGCQIVVNQDWVLIDFLLFFIPTLVMIILYSKIFLVAKQQAVKIETSVSDNRGESSSESHKARVAKRERKAAKTLGVTVVAFMVSWLPYTIDSLVDAFVGFITPAYVYEICCWSAYYNSAMNPLIYAFFYPWFRKAIKLILSGEILKSHSSTMSLFSE

SEQ ID NO: 1484 - DNA, 1033 bp, Mus musculus
atgaccagcaacttttcccaaccagccctgcagctctgctatgagaacacgaatggatcctgtattaaaactccctattctccagggccccgggtcatcctgtacatggtctttggctttggggctgtgctggcagtgtgtgggaacctcctggtggtgatttcagttctccatttcaagcagctgcactctccagccaattttctcatcgcctctctggccagcgctgacttcttgggtgggcatctctgtgatgcccttcagcatggtcaggtccattgagagctgctggtactttggagatgcattttgtagccttcacagttgctgtgatgtggctttttgttactcttctgccctccacctgtgcttcatctcagtggacaggtacattgctgtcacagaccctctggtctatcccaccaagttcacagtgtctgtgtctggaatttgcatcagcatctcctggattctgcccctggtatacagcagtgcagtgttctacacaggcatcagtgctaaggggattgaaagcttagtaagtgctctgaattgtgtagggggctgccaaatcgttgtcaatcaagactgggttttgatagattttcttctatttttcatacctacccttgttatgatcattctttacagcaaaatatttttggtagccaaacagcaagctgtaaaaattgaaacttctgtaagtgacaacagaggtgaatcatcctcagagagtcacaaagccagagtggccaagagagagaggaaggctgcaaaaaccttgggggtcactgtggtggcttttatggtctcgtggctcccatacacaattgactcattggttgatgctttcgtgggcttcattactcctgcctatgtctatgaaatctgttgctggagtgcctattataactcagccatgaaccctttgatttatgctttcttttatccttggtttaggaaagccataaagcttattttaagtggggagattctaaagagtcattcatctaccatgagtttgttttcagag

SEQ ID NO: 1485 - protein, 358 aa, Mus musculus
MATGDDSFPWDQDSILSRDLFSATSTELCYENLNRSCVRSPYSPGPRLILYAVFGFGAVLAVCGNLLVMTSILHFRQLHSPANFLVASLACADFLVGVMVMPFSMVRSVEGCWYFGESYCKFHSCFEGSFCYSSLFHLCFISVDRYIAVSDPLTYPTRFTASVSGKCITFSWLLSIIYSFSLLYTGANDAGLEDLVSALTCVGGCQIAVNQTWVFINFLLFLIPTLVMITVYSKIFLIAKQQAQNIEKMSKQTARASESYKDRVTKRERKAAKTLGIAVAAFLLSWLPYFIDSIIDAFLGFITPTYVYEILVWIVYYNSAMNPLIYAFFYSWFRKAIKLIVSGKILRENSSTTNLFPE

SEQ ID NO: 1486 - DNA, 2148 bp, Mus musculus
atggctacaggtgatgacagttttccctgggaccaagacagcatcctgagcagagatctgttctctgccacatctacagagctgtgctatgagaacctgaacagatcctgtgtcaggagcccatactctccaggccctcgcctcatcctctatgcagtctttggctttggggctgtgctggctgtgtgtggaaacctcctggtgatgacatcaattcttcatttcaggcagctgcactctcctgccaacttcctggtggcatccctggcctgtgctgacttcttggtaggggtgatggtgatgccttttagcatggtgaggtctgtggagggctgctggtactttggggagagttactgtaaattccattcttgctttgaagggtcattctgctattcctctctcttccacttgtgcttcatctctgttgatagatacattgcagtcagtgatcctctgacctaccccaccaggtttactgcatctgtttctggcaagtgcatcaccttctcctggctcctgtccatcatctacagcttttccctcctttacacaggagccaatgatgctgggctggaggatctagtgagtgccctcacctgtgtgggtgggtgtcaaatcgcagtgaatcaaacctgggtcttcatcaatttcctattatttcttatccccacccttgtgatgataactgtctactctaagattttcctcattgctaaacagcaggctcagaacattgagaagatgagcaagcagactgccagagcatcagaaagctacaaggacagggtgaccaagagggaaaggaaagcagccaaaaccctgggcatcgcagtggctgccttcctcctttcatggctgccatacttcattgactccatcattgatgccttccttgggttcatcacgcccacgtatgtgtatgaaatcctagtttggatcgtttactataactcagccatgaaccctttgatttatgctttcttttattcttggtttcgaaaagccatcaaactcattgtctctggcaaaatcttgagggagaattcctcaaccaccaacctgtttcctgaaatggctacaggtgatgacagttttccctgggaccaagacagcatcctgagcagagatctgttctctgccacatctacagagctgtgctatgagaacctgaacagatcctgtgtcaggagcccatactctccaggccctcgcctcatcctctatgcagtctttggctttggggctgtgctggctgtgtgtggaaacctcctggtgatgacatcaattcttcatttcaggcagctgcactctcctgccaacttcctggtggcatccctggcctgtgctgacttcttggtaggggtgatggtgatgccttttagcatggtgaggtctgtggagggctgctggtactttggggagagttactgtaaattccattcttgctttgaagggtcattctgctattcctctctcttccacttgtgcttcatctctgttgatagatacattgcagtcagtgatcctctgacctaccccaccaggtttactgcatctgtttctggcaagtgcatcaccttctcctggctcctgtccatcatctacagcttttccctcctttacacaggagccaatgatgctgggctggaggatctagtgagtgccctcacctgtgtgggtgggtgtcaaatcgcagtgaatcaaacctgggtcttcatcaatttcctattatttcttatccccacccttgtgatgataactgtctactctaagattttcctcattgctaaacagcaggctcagaacattgagaagatgagcaagcagactgccagagcatcagaaagctacaaggacagggtgaccaagagggaaaggaaagcagccaaaaccctgggcatcgcagtggctgccttcctcctttcatggctgccatacttcattgactccatcattgatgccttccttgggttcatcacgcccacgtatgtgtatgaaatcctagtttggatcgtttactataactcagccatgaaccctttgatttatgctttcttttattcttggtttcgaaaagccatcaaactcattgtctctggcaaaatcttgagggagaattcctcaaccaccaacctgtttcctgaa

SEQ ID NO: 1487 - protein, 358 aa, Mus musculus
MATDNDSFPWDQDSILSSDMFSATSTELCYENLNRSCVRSPYSPGPRLILYAVFGFGAALAVCGNLLVMTSILHFRQLHSPANFLVVSLACADFLVGLTVMPFSTVRSVEGCWYFGESYCKLHTCFDVSFCYCSIFHLCFISVDRYIAVSDPLTYPTRFTAFVSGKCITFSWLLSTIYGFSLLYTGANEAGLEDLVSALTCVGGCQLAVNQSWVFINFLLFLIPTLVMITVYSKIFLIAKQQAQNIEKMSKQTARASDSYKDRVAKRERKAAKTLGIAVAAFLLSWLPYFIDSIIDAFLGFITPTYVYEILVWIAYYNSAMNPLIYAFFYPWFRKAIKLIVSGKVLRENSSTTNLFPE

SEQ ID NO: 1488 - DNA, 1076 bp, Mus musculus
atggctacagataatgacagttttccctgggatcaagacagcatcctgagcagtgatatgttctctgccacatctacagagctgtgctatgagaacctgaacaggtcctgtgtcaggagcccatattccccaggccctcgcctcatcctctatgcagtctttggctttggggctgcgctggctgtgtgtggaaacctcctggtgatgacatcaattcttcatttcaggcagctacactcccctgccaacttcctggtggtgtccttggcctgtgctgatttcttggtgggattgactgtgatgcccttcagcacagtgaggtctgtggagggatgctggtactttgggggagagttagctgtaaattacacacttgttttgatgtatctttctgctattgttctatcttccacttgtgcttcatctctgttgatagatatattgcagtcagtgaccccctgacctaccccaccaggtttactgcatttgtttctggcaagtgcatcaccttctcctggctcctgtccaccatttatgggttttctctcctttatacaggggctaatgaagctgggctggaggatctagtgagtgccctcacctgtgtgggtggctgtcaacttgcagtgaatcaaagctgggtcttcatcaatttcctattatttcttatccccacccttgtgatgataactgtctactctaagattttcctcattgctaaacagcaggctcagaacattgagaagatgagcaagcagactgccagggcatcagacagctacaaggacagggtggccaagagagagaggaaagcagccaaaaccctgggcatcgcagtggctgccttcctcctttcatggctgccatacttcattgactccatcattgatgccttcctagggttcatcacgcccacgtatgtgtatgaaatcctagtttggatcgcttactataactcagccatgaaccctttgatttatgctttcttttatccttggtttcgaaaagccatcaaactcattgtctctggcaaagtcttgagggagaattcctcaaccaccaacttgtttcctgag

SEQ ID NO: 1489 - protein, 358 aa, Mus musculus
MSIADETVSWNQDSILSRDLFSATSAELCYENLNRSCVRSPYSPGPRLILYAVFGFGAVLAVCGNLLVMTSILHFRQLHSPANFLVASLACADFLVGVMVMPFSMVRSVEGCWYFGDSYCKLHTCFDVSFCYCSLFHLCFISVDRYIAVSDPLAYPTRFTASVSGKCITFSWLLSISYGFSLIYTGASEAGLEDLVSSLTCVGGCQIAVNQTWVFINFSVFLIPTLVMITVYSKIFLIAKQQAQNIEKMSKQTARASDSYKDRVAKRERKAAKTLGIAVAAFLLSWLPYFIDSFIDAFLGFITPTYVYEILVWIVYYNSAMNPLIYAFFYPWFRKAIKLTVTGKILRENSSTTNLFSE

SEQ ID NO: 1490 - DNA, 1075 bp, Mus musculus
atgtctatagctgatgaaactgtttcctggaaccaagacagcatcctgagcagagatctgttctctgccacatctgcagagctgtgctatgagaacctgaacaggtcctgtgtcagaagcccatactcctccaggccctcgcctcatcctctatgcagtctttggctttggggctgtgctggctgtgtgtggaaacctcctggtgatgacatcaattcttcatttcaggcagctgcactctcctgccaacttcctggtggcatccctggcctgtgctgacttcttggtaggggtgatggtgatgccctttagcatggtgaggtctgtggagggctgctggtactttggagacagttactgtaaattacacacttgttttgatgtatctttctgctattgttctctcttccacttgtgcttcatctctgttgatagatatattgcagtcagtgaccccctggcctaccccaccaggtttactgcatctgtttctggcaagtgcatcaccttctcctggctcctgtccatcagctatgggttttccctcatttacacaggagcaagtgaagctgggctggaggatctagtgagttccctcacctgtgtgggtggctgtcaaatcgcagtgaatcaaacctgggtctttatcaacttctcagtatttctcattcccacccttgtgatgataactgtctactctaagattttcctcattgctaaacagcaggctcagaacattgagaagatgagcaagcagactgccagggcatcagacagctacaaggacagggtggccaagagggagaggaaagcagccaaaaccctgggcatcgcagtggctgccttcctcctttcatggctgccatacttcattgactcctttattgatgccttcctagggttcatcacgcccacgtatgtgtatgaaatcctagtttggattgtttactataactcagccatgaaccctttgatttatgctttcttttatccttggtttcgaaaagccatcaaactcactgttactggcaaaatcttgagggaaaattcctcaaccaccaatctgttttctgag

SEQ ID NO: 1491 - protein, 456 aa, Mus musculus
MNTSFKGVSPFLSQMESAIDWLGENISWVPSIEDQSCNHTTQNGTNISSAEWGGPTGSVRRWLGGNPHIMAKIVLTFAYAVIIVISLFGNSLVCQVFVKHKEIKKSTGLLIFNLAISDILIILLNSPFALVRFLSGQWVFGRIMCHVSRFAQYCSLHVSTLTLMAVAMDRHRVILHPMKPRLTHSQCLFVVAMIWSIAVFLALPHAIYQNLFTLVNMDGDTRSYCLPSFPGPSILVSKYVDLGTFILLYILPLLVIVVTYSHLGKRLWIQNAIGDASARQLMAHYQKRKKSIRMLILIVLVFAVCWFPLNFYVVLISSAGVENDSVLFYAFHWFAMSSTCYNPFIYCWLNRSFRAKLRSISSFRMQSLFVCSNSQVQQIKPQESHELRELQTSSLLRVPLAVPEPQVFEDPSLATGDNSQVSVQGEWEDPDPTLDEEPGPSTRDTYFCIHMQTSSH

SEQ ID NO: 1492 - DNA, 1368 bp, Mus musculus
atgaacacttccttcaagggagtgtctcctttcctgtcacaaatggaaagtgccattgattggctcggagaaaatatcagttgggttccatcaatagaggatcaaagctgcaatcacacaacccagaatggaaccaatatctccagtgcagaatggggagggccaacaggatcagtcaggagatggctggggggcaatccccacatcatggcaaagattgtgctgacatttgcatacgctgtcatcatagtgatatctctctttggcaactccctggtatgccaagtttttgtcaagcacaaggaaatcaagaaatcaacaggccttctcatcttcaatctggcaatatctgacattttgataatcctgctcaacagtccatttgctctggctcgttttctgagtggacagtgggttttcggtaggatcatgtgccatgtcagtcggtttgcccagtactgctccctccatgtttcaactcttacactgatggcagttgctatggaccggcaccgggtaattctgcacccaatgaaaccaaggctaacccactcccaatgcctatttgttgttgccatgatctggagtattgcagtgttccttgctctgcctcatgcgatttaccaaaatctgttcactctcgtcaacatggatggtgataccaggagctactgcctcccttcttttcctggacccagcatactggtttcaaagtatgtggacctcgggacatttatcttgttgtatatcctgccacttctggtgattgttgtaacctactctcacctaggaaagaggttgtggattcaaaatgctattggtgatgcatctgctcgtcaactcatggcacactaccagaagcgcaagaagagcatccggatgttgatacttattgtattggtctttgcagtttgttggtttccacttaacttctatgtggttcttatttccagtgcaggtgtagaaaatgacagtgtgcttttctatgcctttcactggtttgcaatgagcagcacctgctacaatcctttcatatactgttggctcaacaggagcttccgtgccaaactaagatctatatcatctttcaggatgcaatcactgtttgtgtgtagtaactcccaggttcagcaaataaaaccacaggagagtcatgagcttagggagctccagacatcttcactgctacgagttcccctggctgtcccagagccccaggtttttgaagatcccagtttggctacaggggataattcccaggtctctgtccaaggagaatgggaagatccagatcccactctagatgaagaaccagggccttcaactcgggatacttacttttgtatccacatgcagactagcagtcac

SEQ ID NO: 1493 - protein, 344 aa, Mus musculus
MTSNFSQPALQLCYENTNGSCIKTPYSPGPRVILYMVYGFGAVLAVCGNLLVVISVLHFKQLHSPANFLIASLASADFLVGISVMPFSMVRSIESCWYFGDAFCSLHSCCDVAFCYSSVLHLCFISVDRYIAVTDPLVYPTKFTVSVSGICISISWILPLVYSSAVFYTGISAKGIESLVSALNCVGGCQIVINQDFVLISFLLFFIPTLVMIILYSKIFLVAKQQAVKIETSVSGNRGESSSESHKARVAKRERKAAKTLGVTVVAFMVSWLPYTIDALVDAFMGFITPAYVYEICCWGTYYNSAMNPLIYAFFFPWFKKAIKLILSGEILKGHSSTANLFSE

SEQ ID NO: 1494 - DNA, 1032 bp, Mus musculus
atgaccagcaacttttcccaaccagccctgcagctctgctatgagaacacgaatggatcctgtattaaaactccctattctccagggccccgggtcatcctgtacatggtctatggctttggggctgtgctggcagtgtgtgggaacctcctggtggtgatttcagttctccatttcaagcagctgcactctccagccaattttctcatcgcctctctggccagtgctgacttcttggtgggcatctctgtgatgcccttcagcatggtcaggtccattgagagctgctggtactttggagatgcattttgtagccttcacagttgttgtgatgtggctttttgttactcttctgtcctccacctctgcttcatctcagtggacaggtacatcgctgtcacggaccctctggtctatcccaccaagttcacagtgtctgtgtctggaatttgcatcagcatctcctggattctgcccctggtgtacagcagtgcagtgttttacacaggcatcagtgctaaggggattgaaagcttagtaagtgctctaaattgtgtagggggctgccaaattgttatcaatcaagactttgttttgataagttttcttctattcttcatacctacccttgttatgatcattctttacagcaaaatatttttggtagccaaacagcaagctgtaaaaattgaaacttctgtaagtggcaacagaggtgaatcatcctcagagagtcacaaagccagagtggccaagagagagaggaaggctgcaaaaaccttgggggtcactgtggtggcttttatggtctcgtggctcccatacacaattgacgcattggttgatgctttcatgggcttcatcactcctgcctatgtctatgaaatctgttgctggggtacctattataactcagccatgaaccctttgatttatgctttcttttttccttggtttaagaaagccataaagcttattttaagtggggaaattctaaagggacattcatcaactgcaaatttattttcagag

SEQ ID NO: 1495 - protein, 358 aa, Mus musculus
MDKLVDHFLSDQSRTMNEDLFSATSTELCYENLNRSCVRSPYSPGPRLILYAVFGFGAALAVCGNLLVMTSILHFRQLHSPANFLVASLACADFLVGLTVMPFSTVRSVEGCWYFGESYCKFHSCFEGSFCYSSIFHLCFISVDRYIAVSDPLTYPTRFTASVSGKCITFSWLLSIIYSFSLLYTGANEAGLEDLVSVLTCVGGCQIAVNQSWVFINFLLFLIPTLVMMTVYSKIFLIAKQQAQNIEKMSKQTARASESYKDRVAKRERKAAKTLGIAVAAFLLSWLPYFIDSIIDAFLGFITPTYVYEILVWIAYYNSAMNPLIYAFFYPWFRKAIKLIVTGKILRENSSTTNLFPE

SEQ ID NO: 1496 - DNA, 1074 bp, Mus musculus
atggacaaattggttgaccattttctcagtgatcaatctagaaccatgaatgaagatctgttctctgccacatctacagagctgtgctatgagaacctgaacaggtcctgtgtcaggagcccatactccccaggccctcgcctcatcctctatgcagtctttggctttggggctgcgctggctgtgtgtggaaacctcctggtgatgacatcaattcttcatttcaggcagctgcactctcctgccaacttcctggtggcatccctggcctgtgctgatttcttagtgggtctgactgtgatgcccttcagcacggtgaggtctgtggagggctgctggtactttggagagagttattgtaaattccattcttgttttgaagggtcattctgttactcttctatcttccacttgtgcttcatctctgttgatagatatattgcagtcagtgaccccctgacctaccccaccaggttcactgcttctgtttctggcaagtgcatcaccttctcctggctcctgtccatcatctacagcttttccctcctttacacaggagccaacgaagctgggctggaggatctagtgagtgtcctcacctgtgtgggtggctgtcaaattgcagtgaatcaaagctgggtctttatcaactttctattatttcttatccccactcttgtgatgatgactgtctactctaagattttcctcattgctaaacagcaggctcagaacattgagaagatgagcaagcagactgccagggcatcagaaagctacaaggacagggtggccaagagggagaggaaagcagccaaaaccctgggcattgcagtggctgccttcctcctttcatggctgccatacttcattgactccatcattgatgccttcctagggttcatcacgcccacgtatgtgtatgaaatcctagtttggatcgcttactataactcagccatgaaccctttgatttatgctttcttttatccttggtttcgaaaagccatcaagctcattgtcactggcaaaatcttgagggagaattcctcaaccaccaacttgtttcctgag

SEQ ID NO: 1497 - protein, 339 aa, Homo sapiens
MLSILLPSRGSRSGSRRGALLLEGASRDMEKVDMNTSQEQGLCQFSEKYKQVYLSLAYSIIFILGLPLNGTVLWHSWGQTKRWSCATTYLVNLMVADLLYVLLPFLIITYSLDDRWPFGELLCKLVHFLFYINLYGSILLLTCISVHQFLGVWHPLCSLPYRTRRHAWLGTSTTWALVVLQLLPTLAFSHTDYINGQMIWYDMTSQENFDRLFAYGIVLTLSGFLSPSLVILVCYSLMVRSLIKPEENLMRTGNTARARSIRTILLVCGLFTLCFVPFHITRSFYLTICFLLSQDCQLLMAPSVAYKIWRPLVSVSSCLNPVLYFLSRGAKIESGSSRN

SEQ ID NO: 1498 - DNA, 1076 bp, Homo sapiens
caaagttgaatgccgggttggggcagaggctgatgccgtgctgaggtcatgatgttatgctgtccattttgcttccttccaggggaagcagaagcgggagccgtcgtggagctctgctcctggagggagcctcccgggacatggagaaggtggacatgaatacatcacaggaacaaggtctctgccagttctcagagaagtacaagcaagtctacctctccctggcctacagtatcatctttatcctagggctgccactaaatggcactgtcttgtggcactcctggggccaaaccaagcgctggagctgtgccaccacctatctggtgaacctgatggtggccgacctgctttatgtgctattgcccttcctcatcatcacctactcactagatgacaggtggcccttcggggagctgctctgcaagctggtgcacttcctgttctatatcaacctttacggcagcatcctgctgctgacctgcatctctgtgcaccagttcctaggtgtgtggcacccactgtgttcgctgccctaccggacccgcaggcatgcctggctgggcaccagcaccacctgggccctggtggtcctccagctgctgcccacactggccttctcccacacggactacatcaatggccagatgatctggtatgacatgaccagccaagagaattttgatcggctttttgcctacggcatagttctgacattgtctggctttctttccccctccttggtcattttggtgtgctattcactgatggtcaggagcctgatcaagccagaggagaacctcatgaggacaggcaacacagcccgagccaggtccatccggaccatcctactggtgtgtggcctcttcaccctctgttttgtgcccttccatatcactcgctccttctacctcaccatctgctttctgctttctcaggactgccagctcttgatggcacccagtgtggcctacaagatatggaggcctctggtgagtgtgagcagctgcctcaacccagtcctgtactttctttcaaggggggcaaaaatagagtcaggctcctccagaaactga

SEQ ID NO: 1499 - protein, 302 aa, Mus musculus
MEKLDMNVSKGRGACHFSESYKQVYLSLTYSLIFMLGMPLNGAVLWLSWCQTKRWSCATIYLMNLVVADLLYMLSLPLLIITYAVGDTWLFGEMLCRLVRFLFYTNLYSSILLLTCISLHRFLGVCHPLSSLSYRTHRHAWQAAAATWTLVVLQLLPTLVFSHTDYVNGQVICYDTASPEQFDHFFAYSIVLTLSGFVFPSLIILGCYSLMVRSLTNPVEDLPTTGHTARAKSIRTILLVCGLFTLCFVPFHIARFFYLIIRFLKSQDCQLLWAASMAYKVCRPLVSMSSCLNPVLYFLSQG

SEQ ID NO: 1500 - DNA, 906 bp, Mus musculus
atggagaagctagatatgaatgtctcaaagggtcgtggcgcctgccacttctcagagagctacaagcaagtctacctatcattaacctacagtctcatctttatgctagggatgcccctcaatggggctgtcttatggctctcctggtgccaaaccaagcgctggagctgtgccaccatctacctgatgaacctggtggtggctgacctgctttatatgctaagcctgcccttgctcatcatcacctacgcggtgggtgacacctggctctttggggagatgctgtgcaggttggtgcggttcctgttctacaccaacctctacagcagcatcctgctgctgacctgcatctctctacaccgcttcctaggagtgtgccaccctctgagctcactgtcctaccggactcaccggcacgcctggcaggcagctgctgccacctggaccctggtagttctccaattgctgccgactctggtcttctcccacacagactatgtaaatggccaggtgatctgctatgacacagccagcccggagcagtttgatcatttcttcgcctacagcatagtactgacgttatctgggtttgtcttcccctccttgatcattcttgggtgctactctctgatggttaggagcctgacaaatccagtggaggacctcccaacgacaggccacacagcccgtgccaagtctattcggaccatcctgctggtgtgtggcctcttcacactctgttttgtgcccttccacattgcccgattcttctacttgatcatccgcttcctgaagtcacaggactgccagctcttgtgggcagccagcatggcctacaaggtctgtaggcctctggtaagcatgagcagctgcctcaatccagtcctgtacttcttgtcacagggc

SEQ ID NO: 1501 - protein, 319 aa, Mus musculus
MEHTNCSAASTVVETAVGTMLTLECVLGLMGNAVALWTFFYRLKVWKPYAVYLFNLVVADLLLATSVPFFAAFYLKGKTWKLGHMPCQLLLFLLAFSCGVGVAFLMTVALDRYLHVVHPRLRVNLLSLRAAWGISSLIWLLMVVLTPQNLLTCRTTQNSTECPSFYPTGGTKAIATCQEVLFFLQVLLPFGLISFCNSGLIRTLQKRLSESDKQPTIRRARVLVAIMLLLFGLCFLPSVLTRVLVHIFQEFKSCSVQQAIMRASDIAGSLTCLHSTLSPAIYCFSNPAFTHSYRKVLKSLRGRRKAAESPSDNLRDSYS

SEQ ID NO: 1502 - DNA, 960 bp, Mus musculus
atggagcacaccaactgctcagctgccagcactgtggtggagacagccgtgggcaccatgctgacactggagtgtgtgctgggccttatgggcaatgctgtggccctctggaccttcttttaccgtctcaaagtatggaagccttatgccgtctacctgttcaacctggtggtggctgacctgctattggccaccagtgtgccattctttgctgccttctatctgaagggcaagacctggaaacttggacacatgccctgccaactcctgctcttcttgctggcattcagctgtggtgtgggagtagccttcctgatgacagtggctttagaccggtatctgcatgtggtccatcctcggctcagagttaacttgctgtctctgagggcagcttggggcatctccagcctcatctggcttctgatggttgttctcactccccaaaaccttctcacttgcaggactacccagaattccacggaatgccccagcttctatcccacaggagggaccaaggccattgccacctgccaagaggtactcttcttccttcaggtcctgcttccctttggcctcatctccttctgcaacagtgggctcatcaggaccctccagaagagactctcagagtctgacaaacagcccacgatccggagggccagggtgctggttgccataatgctgctactgtttggactgtgcttcctgcctagtgtcctgaccagggttctggtgcacatctttcaggaatttaagagctgcagtgtccagcaagccataatgcgggcctctgacatcgctggcagcctcacctgcctgcacagtacattgagcccagccatttactgcttctccaatccagccttcacccactcataccggaaggtgctcaaaagccttcgaggcaggaggaaggcagcagagtcacctagcgacaacctcagggactcctattcctga

SEQ ID NO: 1503 - protein, 365 aa, Mus musculus
MLIFALALFGNALVVYVVTRSKAMRTVTNIFICSLALSDLLIVFFCIPVTMLQNVSDTWLGGAFICKMVPFVQCTAIVTEILTMTCIAVERHQGLVHPFKMKRQYTNQRAFTMLGVVWLVAIIIGSPMWHVQRLEIKYDFLYEKEHICCLEEWSSPVHQKIYTTFILVTLFLLPLLLLSVLYGKIGYELWIKKRIGDGSVLRTIHGKEMFKIARKKKRAVIMMVTVVVLFAVCWAPFHIVHMMIEYSNFEKEYDEVTIKMIFAIVQIIGFFNSICNPIIYALMNENFKKNFVSAVCYCIVKETPSSARKHGSSGAMVMHRRAKLAARENPVEIKGEAFGGSNIDIKWCEQPEKKKRRSKVASCPL

SEQ ID NO: 1504 - DNA, 1095 bp, Mus musculus
atgctcatctttgccctggcgctcttcggcaacgccctggtagtctatgtggtgacccgcagcaaggccatgcgcaccgtcaccaacatcttcatctgctccctggcactcagcgacctgctcatcgtcttcttctgcatcccggtcaccatgctccagaacgtctcggacacctggctggggggtgccttcatttgcaaaatggtcccatttgtccagtgcactgccattgtgacagaaatccttactatgacctgcattgctgtggaaaggcaccagggacttgtccatccttttaaaatgaagcggcagtacaccaatcaaagagctttcacaatgctaggtgtggtgtggctggtggccatcatcataggatcacccatgtggcatgtgcagcgacttgagattaagtatgacttcctatatgaaaaagaacacatctgctgcctggaagagtggagcagccccgtgcaccagaagatctacaccaccttcatccttgtcaccctcttcctgctaccactgttgctgctctctgtcctctacgggaaaatcggttatgagctttggatcaagaaaagaatcggggatggctcagtgctccgaactattcatggaaaagaaatgttcaaaatagccagaaagaagaagcgagctgtgatcatgatggtgacagtcgtggttctctttgctgtgtgctgggcacctttccacatcgttcacatgatgattgaatacagtaattttgaaaaggaatatgatgaagtcacaatcaagatgatttttgctatagtgcaaataattggatttttcaactccatctgtaatcccattatttatgcacttatgaatgaaaacttcaaaaaaaactttgtgtctgccgtttgctattgcattgtgaaggaaacaccttcttcagcacggaagcatggaagttcaggagctatggtgatgcacaggagggcaaagttagctgcaagagagaatcctgtagagatcaaaggagaagcatttgggggcagcaacatcgatatcaagtggtgtgaacagccagaaaagaagaagaggagatcaaaagtggcatcttgtcctctt

SEQ ID NO: 1505 - protein, 318 aa, Homo sapiens
MMVDPNGNESSATYFILIGLPGLEEAQFWLAFPLCSLYLIAVLGNLTIIYIVRTEHSLHEPMYIFLCMLSGIDILISTSSMPKMLAIFWFNSTTIQFDACLLQMFAIHSLSGMESTVLLAMAFDRYVAICHPLRHATVLTLPRVTKIGVAAVVRGAALMAPLPVFIKQLPFCRSNILSHSYCLHQDVMKLACDDIRVNVVYGLIVIISAIGLDSLLISFSYLLILKTVLGLTREAQAKAFGTCVSHVCAVFIFYVPFIGLSMVHRFSKRRDSPLPVILANIYLLVPPVLNPIVYGVKTKEIRQRILRLFHVATHASEP

SEQ ID NO: 1506 - protein, 316 aa, Homo sapiens
MKIANNTVVTEFILLGLTQSQDIQLLVFVLILIFYLIILPGNFLIIFTIRSDPGLTAPLYLFLGNLAFLDASYSFIVAPRMLVDFLSEKKVISYRGCITQLFFLHFLGGGEGLLLVVMAFDRYIAICRPLHCSTVMNPRACYAMMLALWLGGFVHSIIQVVLILRLPFCGPNQLDNFFCDVRQVIKLACTDMFVVELLMVFNSGLMTLLCFLGLLASYAVILCHVRRAASEGKNKAMSTCTTRVIIILLMFGPAIFIYMCPFRALPADKMVSLFHTVIFPLMNPMIYTLRNQEVKTSMKRLLSRHVVCQVDFIIRN

SEQ ID NO: 1507 - protein, 317 aa, Homo sapiens
MSQVTNTTQEGIYFILTDIPGFEASHIWISIPVCCLYTISIMGNTTILTVIRTEPSVHQRMYLFLSMLALTDLGLTLTTLPTVMQLLWFNVRRISSEACFAQFFFLHGFSFMESSVLLAMSVDCYVAICCPLHYASILTNEVIGRTGLAIICCCVLAVLPSLFLLKRLPFCHSHLLSRSYCLHQDMIRLVCADIRLNSWYGFALALLIIIVDPLLIVISYTLILKNILGTATWAERLRALNNCLSHILAVLVLYIPMVGVSMTHRFAKHASPLVHVIMANIYLLAPPVMNPIIYSVKNKQIQWGMLNFLSLKNMHSR

SEQ ID NO: 1508 - protein, 320 aa, Homo sapiens
MSSCNFTHATFVLIGIPGLEKAHFWVGFPLLSMYVVAMFGNCIVVFIVRTERSLHAPMYLFLCMLAAIDLALSTSTMPKILALFWFDSREISFEACLTQMFFIHALSAIESTILLAMAFDRYVAICHPLRHAAVLNNTVTAQIGIVAVVRGSLFFFPLPLLIKRLAFCHSNVLSHSYCVHQDVMKLAYADTLPNVVYGLTAILLVMGVDVMFISLSYFLIIRTVLQLPSKSERAKAFGTCVSHIGVVLAFYVPLIGLSVVHRFGNSLHPIVRVVMGDIYLLLPPVINPIIYGAKTKQIRTRVLAMFKISCDKDLQAVGGK

SEQ ID NO: 1509 - protein, 313 aa, Homo sapiens
MLARNNSLVTEFILAGLTDHPEFQQPLFFLFLVVYIVTMVGNLGLIILFGLNSHLHTPMYYFLFNLSFIDLCYSSVFTPKMLMNFVSKKNIISYVGCMTQLFFFLFFVISECYMLTSMAYDRYVAICNPLLYKVTMSHQVCSMLTFAAYIMGLAGATAHTGCMLRLTFCSANIINHYLCDILPLLQLSCTSTYVNEVVVLIVVGINIMVPSCTILISYVFIVTSILHIKSTQGRSKAFSTCSSHVIALSLFFGSAAFMYIKYSSGSMEQGKVSSVFYTNVVPMLNPLIYSLRNKDVKVALRKALIKIQRRNIF

SEQ ID NO: 1510 - protein, 312 aa, Homo sapiens
MEAGNQTGFLEFILLGLSEDPELQPFIFGLFLSMYLVTVLGNLLIILAISSDSHLHTPMYFFLSNLSWVDICFSTCIVPKMLVNIQTENKAISYMDCLTQVYFSMFFPILDTLLLTVMAYDRFVAVCHPLHYMIIMNPHLCGLLVFVTWLIGVMTSLLHISLMMHLIFCKDFEIPHFFCELTYILQLACSDTFLNSTLIYFMTGVLGVFPLLGIIFSYSRIASSIRKMSSSGGKQKALSTCGSHLSVVSLFYGTGIGVHFTSAVTHSSQKISVASVMYTVVTPMLNPFIYSLRNKDVKGALGSLLSRAASCL

SEQ ID NO: 1511 - protein, 310 aa, Homo sapiens
MGDNITSITEFLLLGFPVGPRIQMLLFGLFSLFYVFTLLGNGTILGLISLDSRLHAPMYFFLSHLAVVDIAYACNTVPRMLVNLLHPAKPISFAGRMMQTFLFSTFAVTECLLLVVMSYDLYVAICHPLRYLAIMTWRVCITLAVTSWTTGVLLSLIHLVLLLPLPFCRPQKIYHFFCEILAVLKLACADTHINENMVLAGAISGLVGPLSTIVVSYMCILCAILQIQSREVQRKAFCTCFSHLCVIGLFYGTAIIMYVGPRYGNPKEQKKYLPLFHSLFNPMLNPLICSLRNSEVKNTLKRVLGVERAL

SEQ ID NO: 1512 - protein, 300 aa, Homo sapiens [sequence omitted]

SEQ ID NO: 1513 - protein, 310 aa, Homo sapiens
MGENQTMVTEFLLLGFLLGPRIQMLLFGLFSLFYIFTLLGNGAILGLISLDSRLHTPMYFFLSHLAVVDIAYTRNTVPQMLANLLHPAKPISFAGCMTQTFLCLSFGHSECLLLVLMSYDRYVAICHPLRYSVIMTWRVCITLAVTSWTCGSLLALAHVVLILRLPFSGPHEINHFFCEILSVLRLACADTWLNQVVIFAACVFFLVGPPSLVLVSYSHILAAILRIQSGEGRRKAFSTCSSHLCVVGLFFGSAIIMYMAPKSRHPEEQQKVFFLFYSFFNPTLNPLIYSLRNGEVKGALRRALGKESHS

SEQ ID NO: 1514 - protein, 291 aa, Homo sapiens
MFAALVLLCYLLTLTGNSALVLLAVRDPRLHTPMYYFLCHLALVDAGFTTSVVPPLLANLRGPALWLPRSHCTAQLCASLALGSAECVLLAVMALDRAAKKVKGAARRLLRSLGRGQAGQSASWLSGLTNSVAQTALLAERPLCAPRLLDHFICELPALLKLACGGDGDTTENQMFAARVVILLLPFAVILASYGAVARAVCCMRFSGGRRRAVGTCGSHLTAVCLFYGSAIYTYLQPAQRYNQARGKFVSLFYTVVTPALNPLIYTLRNKKVKGAARRLLRSLGRGQAGQ

SEQ ID NO: 1515 - DNA, 954 bp, Homo sapiens
atgatggtggatcccaatggcaatgaatccagtgctacatacttcatcctaataggcctccctggtttagaagaggctcagttctggttggccttcccattgtgctccctctaccttattgctgtgctaggtaacttgacaatcatctacattgtgcggactgagcacagcctgcatgagcccatgtatatatttctttgcatgctttcaggcattgacatcctcatctccacctcatccatgcccaaaatgctggccatcttctggttcaattccactaccatccagtttgatgcttgtctgctacagatgtttgccatccactccttatctggcatggaatccacagtgctgctggccatggcttttgaccgctatgtggccatctgtcacccactgcgccatgccacagtacttacgttgcctcgtgtcaccaaaattggtgtggctgctgtggtgcggggggctgcactgatggcaccccttcctgtcttcatcaagcagctgcccttctgccgctccaatatcctttcccattcctactgcctacaccaagatgtcatgaagctggcctgtgatgatatccgggtcaatgtcgtctatggccttatcgtcatcatctccgccattggcctggactcacttctcatctccttctcatatctgcttattcttaagactgtgttgggcttgacacgtgaagcccaggccaaggcatttggcacttgcgtctctcatgtgtgtgctgtgttcatattctatgtacctttcattggattgtccatggtgcatcgctttagcaagcggcgtgactctccgctgcccgtcatcttggccaatatctatctgctggttcctcctgtgctcaacccaattgtctatggagtgaagacaaaggagattcgacagcgcatccttcgacttttccatgtggccacacacgcttcagagccc

SEQ ID NO: 1516 - DNA, 948 bp, Homo sapiens
atgaagatagcaaacaacacagtagtgacagaatttatcctccttggtctgactcagtctcaagatattcagctcttggtctttgtgctgatcttaattttctaccttatcatcctccctggaaattttctcattattttcaccataaggtcagaccctgggctcacagcccccctctatttatttctgggcaacttggccttcctggatgcatcctactccttcattgtggctcccaggatgttggtggacttcctctctgagaaaaaggtaatctcctacagaggctgcatcactcagctctttttcttgcacttccttggaggaggggagggattactccttgttgtgatggcctttgaccgctacatcgccatctgccggcctctgcactgttcaactgtcatgaaccctagagcctgctatgcaatgatgttggctctgtggcttgggggttttgtccactccattatccaggtggtcctcatcctccgcttgcctttttgtggcccaaaccagctggacaacttcttctgtgatgtccgacaggtcatcaagctggcttgcaccgacatgtttgtggtggagcttctaatggtcttcaacagtggcctgatgacactcctgtgctttctggggcttctggcttcctatgcagtcatcctctgccatgttcgtagggcagcttctgaagggaagaacaaggccatgtccacgtgcaccactcgtgtcattattatacttcttatgtttggacctgctatcttcatctacatgtgccctttcagggccttaccagctgacaagatggtttctctctttcacacagtgatctttccattgatgaatcctatgatttatacccttcgcaaccaggaagtgaaaacttccatgaagaggttattgagtcgacatgtagtctgtcaagtggattttataataagaaac

SEQ ID NO: 1517 - DNA, 951 bp, Homo sapiens
atgtcccaggtgactaacaccacacaagaaggcatctacttcatcctcacggacatccctggatttgaggcctcccacatctggatctccatccccgtctgctgtctctacaccatctccatcatgggcaataccaccatcctcactgtcattcgcacagagccatctgtccaccagcgcatgtatctgtttctctccatgctggccctgacggacctgggtctcaccctcaccaccctacccacagtcatgcagcttctctggttcaacgttcgtagaatcagctctgaggcctgttttgctcagtttttcttccttcatggattctcctttatggagtcttctgtcctcctggctatgtccgttgactgctatgtggccatctgctgtcccctccattatgcctccatcctcaccaatgaagtcattggtagaactgggttagccatcatttgctgctgtgttctggcggttcttccctcccttttcttactcaagcgactgcctttctgccactcccaccttctctctcgctcctattgcctccaccaggatatgatccgcctggtctgtgctgacatcaggctcaacagctggtatggatttgctcttgccttgctcattattatcgtggatcctctgctcattgtgatctcctatacacttattctgaaaaatatcttgggcacagccacctgggctgagcgactccgtgccctcaataactgcctgtcccacattctagctgtcctggtcctctacattcccatggttggtgtatctatgactcatcgctttgccaagcatgcctctccactggtccatgttatcatggccaatatctacctgctggcacccccggtgatgaaccccatcatttacagtgtaaagaacaagcagatccaatggggaatgttaaatttcctttccctcaaaaatatgcattcaaga

SEQ ID NO: 1518 - DNA, 960 bp, Homo sapiens
atgagttcctgcaacttcacacatgccacctttgtgcttattggtatcccaggattagagaaagcccatttctgggttggcttccccctcctttccatgtatgtagtggcaatgtttggaaactgcatcgtggtcttcatcgtaaggacggaacgcagcctgcacgctccgatgtacctctttctctgcatgcttgcagccattgacctggccttatccacatccaccatgcctaagatccttgcccttttctggtttgattcccgagagattagctttgaggcctgtcttacccagatgttctttattcatgccctctcagccattgaatccaccatcctgctggccatggcctttgaccgttatgtggccatctgccacccactgcgccatgctgcagtgctcaacaatacagtaacagcccagattggcatcgtggctgtggtccgcggatccctcttttttttcccactgcctctgctgatcaagcggctggccttctgccactccaatgtcctctcgcactcctattgtgtccaccaggatgtaatgaagttggcctatgcagacactttgcccaatgtggtatatggtcttactgccattctgctggtcatgggcgtggacgtaatgttcatctccttgtcctattttctgataatacgaacggttctgcaactgccttccaagtcagagcgggccaaggcctttggaacctgtgtgtcacacattggtgtggtactcgccttctatgtgccacttattggcctctcagtggtacaccgctttggaaacagccttcatcccattgtgcgtgttgtcatgggtgacatctacctgctgctgcctcctgtcatcaatcccatcatctatggtgccaaaaccaaacagatcagaacacgggtgctggctatgttcaagatcagctgtgacaaggacttgcaggctgtgggaggcaag

SEQ ID NO: 1519 - DNA, 939 bp, Homo sapiens
atgctggctagaaacaactccttagtgactgaatttattcttgctggattaacagatcatccagagttccagcaacccctctttttcctgtttctagtggtctacattgtcaccatggtaggcaaccttggcttgatcattcttttcggtctaaattctcacctccacacaccaatgtactatttcctcttcaatctctccttcattgatctctgttactcctctgttttcactcccaaaatgctaatgaactttgtatcaaaaaagaatattatctcctatgttgggtgcatgactcagctgtttttctttctcttttttgtcatctctgaatgttacatgttgacctcaatggcatatgatcgctatgtggccatctgtaatccattgctgtataaggtcaccatgtcccatcaggtctgttctatgctcacttttgctgcttacataatgggattggctggagccacggcccacaccgggtgcatgcttagactcaccttctgcagtgctaatatcatcaaccattacttgtgtgacatactccccctcctccagctttcctgcaccagcacctatgtcaacgaggtggttgttctcattgttgtgggtattaatatcatggtacccagttgtaccatcctcatttcttatgttttcattgtcactagcattcttcatatcaaatccactcaaggaagatcaaaagccttcagtacttgtagctctcatgtcattgctctgtctctgttttttgggtcagcggcattcatgtatattaaatattcttctggatctatggagcagggaaaagtttcttctgttttctacactaatgtggtgcccatgctcaatcctctcatctacagtttgaggaacaaggatgtcaaagttgcactgaggaaagctctgattaaaattcagagaagaaatatattc

SEQ ID NO: 1520 - DNA, 936 bp, Homo sapiens
atggaagcaggaaaccaaacaggatttttagagtttatccttctcggactctctgaggatccagaactacagccgttcatatttgggctgttcctgtccatgtacctggtgacggtgctgggaaacctgctcatcatcctggccatcagctctgactcccacctccacacccccatgtacttcttcctctccaacctgtcctgggttgacatctgtttcagcacttgcatcgtccccaagatgctggtgaacatccagaccgagaacaaagccatctcctacatggactgcctcacacaggtctatttctccatgttttttcctattctggacacgctactcctgaccgtgatggcctatgaccggtttgtggctgtctgccaccctctgcactatatgatcatcatgaacccccacctctgtggcctcctggtttttgtcacctggctcattggtgtcatgacatccctcctccatatttctctgatgatgcatctaatcttctgtaaagattttgaaattccacattttttctgcgaactgacgtacatcctccagctggcctgctctgataccttcctgaacagcacgttgatatactttatgacgggtgtgctgggcgtttttcccctccttgggatcattttctcttattcacgaattgcttcatccataaggaagatgtcctcatctgggggaaaacaaaaagcactttccacctgtgggtctcacctctccgtcgtttctttattttatgggacaggcattggggtccacttcacttctgcggtgactcactcttcccagaaaatctccgtggcctcggtgatgtacactgtggtcacccccatgttgaaccccttcatctacagcctgaggaacaaggatgtgaagggagccctggggagtctcctcagcagggcagcctcttgtttg

SEQ ID NO: 1521 - DNA, 930 bp, Homo sapiens
atgggggacaatataacatccatcacagagttcctcctactgggatttcccgttggcccaaggattcagatgctcctctttgggctcttctccctgttctacgtcttcaccctgctggggaacgggaccatactggggctcatctcactggactccagactgcacgcccccatgtacttcttcctctcacacctggcggtcgtcgacatcgcctacgcctgcaacacggtgccccggatgctggtgaacctcctgcatccagccaagcccatctcctttgcgggccgcatgatgcagacctttctgttttccacttttgctgtcacagaatgtctcctcctggtggtgatgtcctatgatctgtacgtggccatctgccaccccctccgatatttggccatcatgacctggagagtctgcatcaccctcgcggtgacttcctggaccactggagtccttttatccttgattcatcttgtgttacttctacctttacccttctgtaggccccagaaaatttatcactttttttgtgaaatcttggctgttctcaaacttgcctgtgcagatacccacatcaatgagaacatggtcttggccggagcaatttctgggctggtgggacccttgtccacaattgtagtttcatatatgtgcatcctctgtgctatccttcagatccaatcaagggaagttcagaggaaagccttctgcacctgcttctcccacctctgtgtgattggactcttttatggcacagccattatcatgtatgttggacccagatatgggaaccccaaggagcagaagaaatatctcccgctgtttcacagcctctttaatcccatgctcaatccccttatctgtagtcttaggaactcagaagtgaagaatactttgaagagagtgctgggagtagaaagggcttta

SEQ ID NO: 1522 - DNA, 900 bp, Homo sapiens
atgtacctggtcacggtgctgaggaacctgctcatcatcctggctgtcagctctgactcccacctccacacccccatgtgcttcttcctctccaacctgtgctgggctgacatcggtttcacctcggccatggttcccaagatgattgtggacatgcagtcgcatagcagagtcatctcttatgcgggctgcctgacacagatgtctttctttgtcctttttgcatgtatagaagacatgctcctgacagtgatggcctatgaccgatttgtggccatctgtcaccccctgcactacccagtcatcatgaatcctcaccttggtgtcttcttagttttggtgtcctttttcctcagcctgttggattcccagctgcacagttggattgtgttacaattcaccttcttcaagaatgtggaaatctccaattttgtctgtgacccatctcaacttctcaaccttgcctgttctgacagtgtcatcaatagcatattcatatatttagatagtattatgtttggttttcttcccatttcagggatccttttgtcttacgctaacaatgtcccctccattctaagaatttcatcatcagataggaagtctaaagccttctccacctgtggctctcacctggcagttgtttgcttattttatggaacaggcattggcgtgtacctgacttcagctgtgtcaccaccccccaggaatggtgtggtggcatcagtgatgtacgctgtggtcacccccatgctgaaccctttcatctacagcctgagaaatagggacattcaaagtgccctgtggaggctgcgcagcagaacagtcgaatctcatgatctgttatctcaagatctgctccatcctttttcttgtgtgggtgagaaaggtcaaccacat

SEQ ID NO: 1523 - DNA, 930 bp, Homo sapiens
atgggggaaaatcagacaatggtcacagagttcctcctactgggatttctcctgggcccaaggattcagatgctcctctttgggctcttctccctgttctatatcttcaccctgctggggaacggggccatcctggggctcatctcactggactccagactccacacccccatgtacttcttcctctcacacctggctgtcgtcgacatcgcctacacccgcaacacggtgccccagatgctggcgaacctcctgcatccagccaagcccatctcctttgctggctgcatgacgcagacctttctctgtttgagttttggacacagcgaatgtctcctgctggtgctgatgtcctacgatcgttacgtggccatctgccaccctctccgatactccgtcatcatgacctggagagtctgcatcaccctggccgtcacttcctggacgtgtggctccctcctggctctggcccatgtggttctcatcctaagactgcccttctctgggcctcatgaaatcaaccacttcttctgtgaaatcctgtctgtcctcaggctggcctgtgctgacacctggctcaaccaggtggtcatctttgcagcctgcgtgttcttcctggtggggccacccagcctggtgcttgtctcctactcgcacatcctggcggccatcctgaggatccagtctggggagggccgcagaaaggccttctccacctgctcctcccacctctgcgtggtgggactcttctttggcagtgccatcatcatgtacatggcccccaagtcccgccatcctgaggagcagcaaaaggtcttttttctattttacagttttttcaacccaacacttaaccccctgatttacagcctgaggaacggagaggtcaagggtgccctgaggagagcactgggcaaggaaagtcattcc

SEQ ID NO: 1524 - DNA, 873 bp, Homo sapiens
atgttcgccgcccttgtcctcctgtgctacctcctgaccttgacgggcaactcggcgctggtgctgctggcggtgcgcgacccgcgcctgcacacgcccatgtactacttcctctgccacctggccttggtagacgcgggcttcactactagcgtggtgccgccgctgctggccaacctgcgcggaccagcgctctggctgccgcgcagccactgcacggcccagctgtgcgcatcgctggctctgggttcggccgaatgcgtcctcctggcggtgatggctctggaccgcgcggccaagaaagtgaagggggcagcgaggaggctgctgcggagtctggggagaggccaggctgggcagagcgcctcctggctaagcggcctcaccaactcggttgcgcaaaccgcgctcctggctgagcggccgctgtgcgcgccccgcctgctggaccacttcatctgtgagctgccggcgttgctcaagctggcctgcggaggcgacggagacactaccgagaaccagatgttcgccgcccgcgtggtcatcctgctgctgccgtttgccgtcatcctggcctcctacggtgccgtggcccgagctgtctgttgcatgcggttcagcggaggccggaggagggcggtgggcacgtgtgggtcccacctgacagccgtctgcctgttctacggctcggccatctacacctacctgcagcccgcgcagcgctacaaccaggcacggggcaagttcgtatcgctcttctacaccgtggtcacacctgctctcaacccgctcatctacaccctcaggaataagaaagtgaagggggcagcgaggaggctgctgcggagtctggggagaggccaggctgggcag

SEQ ID NO: 1525 - protein, 317 aa, Mus musculus
MVGFNSNESSATYFILIGLPGLEEVQFWLAFPLCSLYLIAVLGNLTIIYIVRTEHSLHEPMYIFLCMLSGLDILISTSSMPKMMAIFWFNSTTIQFDACLVQMFAIHSLSGMESTVLLAMAFDRYVAICHPLRHATVLTLPRVAKIGMAAVVRGAVLMAPLPVFIKRLPFCRSNILSHSYCLHQDVMKLACADIRVNIIYGLIVIISAIGLDSLLISFSYLLILKTVLGLTREAQAKAFGTCVSHVCAVFIFYVPFIGLSMVHRFSKRRDSLLPVIMANIYLLVPPVLNPIVYGVKTKEIRQRILRLFLVTTHTSDH

SEQ ID NO: 1526 - protein, 308 aa, Mus musculus
METENRTVVTEFILIGLTQSHDIQRLVFVLSLIFYIIILPGNILIILTIRSDPGLTAPLYFFLGNLAFLDASYSFIVAPRMLVDFFSEKKIISYKACITQLFFLHFLGGGEGLLLVVMAFDRYIAICRPLHYSTVMSPRACYVMLLALWLGGFIHSIIQVVLILRLPFCGPNHLDNFFCDVPQVIKLACTDTFAVELLMIFNSGLLTLLCFLGLLTSYAVILCHVHRSASEGKNKAISTCTTHVIIIFIMFGPAIFIYTRPFTALSADKVVSFFHTVIFPLMNPVIYTLRNQEVKTSMKKLIIRHIIC

SEQ ID NO: 1527 - protein, 315 aa, Mus musculus
MSEVTNTTHDPFYFILTGIPGFEDIHLWISIPLFCLYTISIMGNTTILTVIRTEPSLHQPMYLFLSMLALTDLGLTLTTLPTVMQLLWFNIREISFEACFAQFFFLHGFSFMESSVLLAMSFDRYVAICRPLHYASILTSEVIARIGLAIICRCVLAVLPSLFLLKRLPFCHSHLISHSYCLHQDMIHLVCADIRVNSWYGFALVLLIIVLDPLLIVLSYALILKSVLNTATWTERLRALNNCLSHMLAVLVLYVPMVGVSMTHRFAKHASPLVHVLMANIYLLAPPVMNPIIYSVKTKQIRQGITRLLLQRKVH

SEQ ID NO: 1528 - protein, 320 aa, Mus musculus
MSSCNFTHATFLLIGIPGLEEAHFWFGFPLLSMYAVALFGNCIVVFIVRTERSLHAPMYLFLCMLAAIDLALSTSTMPKILALFWFDSREITFDACLAQMFFIHTLSAIESTILLAMAFDRYVAICHPLRHAAVLNNTVTVQIGMVALVRGSLFFFPLPLLIKRLAFCHSNVLSHSYCVHQDVMKLAYTDTLPNVVYGLTAILLVMGVDVMFISLSYFLIIRTVLQLPSKSERAKAFGTCVSHISVVLAFYVPLIGLSVVHRFGNSLDPIVHVLMGDVYLLLPPVINPIIYGAKTKQIRTRVLAMFKISCDKDIEAGGNT

SEQ ID NO: 1529 - protein, 314 aa, Mus musculus
MLAGNGSSVTEFVLAGLTDRPELQLPLFYLFLIIYIITVVGNLGLIILIGLNPHLHTPMYYFLFNLSFIDLCYSSVFSPKMLINFVSEKNSISYAGCMTQLFLFLFFVISECYMLTSMAYDRYVAICNPLLYKVTMSPQICSVISFAAYGMGFAGSSAHTGCMLRLTFCNVNVINHYLCDILPLLQLSCTSTYVNEVVVLIVVGINITVPSFTILISYVFILANILNIKSTQGRAKAFSTCSSHIMAISLFFGSAAFMYLKYSSGSMEQGKISSVFYTNVGPMLNPLIYSLRNKDVKVALRKSLIKFREKTDFN

SEQ ID NO: 1530 - protein, 309 aa, Mus musculus
MEPRNNTHILEFFLLGFSQDPNLQPVICGLFLSMYLITVVGNLLIILTIISDANLHTPMYFFLSNLSFVDICFVSTTVPKMLVNIQTKRKSISYADCITQMYFFLIFVELDNFLLAVMAYDRYVAICHPLHYTGIMNRRLCGFLVLVCWIVSVLHALLQSMMVLRLSFCTDLEIPHFFCELNQVAQLTCSDTFLNDVVMYFALVLLAIVPLFGILYSYSKIVSSIRAMSTVQGKYKAFSTCASHLSVVSLFYFTGLGVYLSSAVSHSSQASATASVMYTVVTPMLNPFIYSLRNKDVKGALKRLLGVKL

SEQ ID NO: 1531 - protein, 310 aa, Mus musculus
MGNNMTLITEFILLGFPLSPRMQMLLFALFSLFYAFTLLGNGTIVGLICLDSRLHTPMYFFLSHLAIVDIAYACNTVPQMLVNLLDPVKPISYAGCMTQTFLFLTFAITECLLLVVMSYDRYVAICHPLRYSAIMSWRVCSTMAVTSWIIGVLLSLIHLVLLLPLPFCVSQKVNHFFCEITAILKLACADTHLNETMVLAGAVSVLVGPFSSIVVSYACILGAILKIQSEEGQRKAFSTCSSHLCVVGLFYGTAIVMYVGPRHGSPKEQKKYLLLFHSLFNPMLNPLIYSLRNSDVKNTLKRVLRTQRAL

SEQ ID NO: 1532 - protein, 309 aa, Mus musculus
IEEQNITRISEFHLMGLSDDLQLQPILFGLFLSMYLVTLLGNLLIILTVSSDSHLHSPMYFFLSNLSLADVSFTSTTLPKMIVDIQTHNRAISYSGCLTQMSFFMLFGCLDSLLLTAMAYDRFVAICHPLHYQFIMNPRLCGLLVFLSVLISLFVSQLHNSVVLQLTYFKSVDISHFFCDPSQLLNLACSDTFTNNIVMYFVGAISGFLPISGIFFSYYKIVSSILRMPSPGGKYKAFSTCGSHLSVVCLFYGTGLGVYLSSAVSLSPRKGAVASIVYTVVTPMLNPFIYSLRNQDIKRAMWRLLRKTV

SEQ ID NO: 1533 - protein, 321 aa, Mus musculus
MEENQTMVTEFVLLGFCLGPRIHLVLFLLFSLFYTLTILGNGTILAMICLDSRLHTPMYFFLSHLAIVDMAYACNTVPQTLINLLDETRPITFAGCMTQTFLFLAFAHTECVLLVVMSYDRYVAICHPLHYTVIMNWRVCTILAAVSWIFSFLLALVHLVLILRLPFCGPHEINHFFCEILSVLKLACADTTLNQVVIFAACVFILVAPLCFVLVSYTRILVAILRIQSGEGRRKAFSTCSSHLCVVGLFFGSAIVMYMAPKSQHPEEQQKVLFLFYSFFNPMLNPLIYSLRNAEVKGALKRSLCKESHSWLVWCSDHKSW

SEQ ID NO: 1534 - protein, 313 aa, Mus musculus
  misc_feature (146)..(146): Xaa can be any naturally occurring amino acid
PPQANHSSAERFLLLGFSDWPSLQPVLFALVLLCYLLTLTGNAALVLLAIRDPRLHTPMYYFLCHLALVDVGFTTSVVPPLLASLRGSMLQLPRAGCMAQLCSSLALGSAECVLLAVMALDRAAAVCNPLRYTSLASPLLCRTLAXGVSWLGGLANSAAQTALLAARPLCAPRCLDHFICELPALLQLACRGGRSATERQMFAARVVILLVPSAVILASYIAVGRAVWGMHSSSGWRKAASTCGSHLTAVCLFYGSATYTYLQPTHSYNQGRGKFVSLFYTVVTPALNPLIYTLRNKEVKGAALRLLRSLGRP

SEQ ID NO: 1535 - DNA, 954 bp, Mus musculus
atggtgggcttcaatagcaatgaatccagtgccacatatttcatcttaataggccttccaggattggaagaggttcagttttggctggctttccctttgtgttccctctaccttattgctgtgctaggtaacttgacaatcatctacattgtgaggacagagcacagcctgcatgagcccatgtatatctttctttgcatgctttctggcctagacatcctcatttccacctcatccatgccaaaaatgatggccatcttttggttcaattccactaccatccagtttgatgcttgtctggtacagatgtttgccatccattccttgtctggcatggagtccacagtgctgctggccatggcctttgaccgctatgtggccatttgccatcctctacggcatgccactgtgctgacattgcctcgtgttgccaagattggcatggctgctgtggtcaggggtgcagtactaatggcacccttacctgtcttcatcaaaaggttgcctttctgtcgttccaacatcctttctcattcctactgcctacaccaagatgtcatgaagctggcctgtgctgacatccgtgtcaatatcatttatggactcattgtcatcatctcagccattggtttggactcacttctcatttccttctcatatttgctcatcctcaagactgtgttgggcttgacacgtgaagcccaggcaaaagcgtttggcacttgtgtttcacatgtgtgtgctgttttcatcttctatgtgcctttcattggattgtcgatggtgcaccgtttcagcaagaggcgtgactctctcctgcctgtcattatggctaacatctatctgctagttcctcctgtgctcaaccccattgtctatggagtaaagacaaaggagatccggcagcgcattcttcgtcttttcctcgtgaccacacacacttcagatcactag

SEQ ID NO: 1536 - DNA, 927 bp, Mus musculus
atggagacagaaaacaggacagttgtcacagaattcatcctcataggactgacccagtcacatgacattcagcgcttggtctttgttctgagcttaattttctacatcatcatcttgcctggaaatatcctgatcattctgaccatcagatcagaccctggacttactgcccctctttatttcttcttgggaaatttggccttcctggatgcctcctactccttcattgtggctcccaggatgttggtagacttcttctctgagaagaagataatctcctacaaagcctgtatcactcagctattttttttgcacttccttggagggggtgaagggttacttctggttgtgatggcctttgaccgctacattgccatctgcaggcctttacattattctactgttatgagccctagagcctgctatgtgatgttgttggctctctggcttggaggatttattcactccattattcaggttgtcctcatcctccgcttgcccttctgtggtccaaatcatctagataatttcttctgtgatgtcccacaggtcatcaagctagcctgtacagacacctttgcagttgagctccttatgatcttcaatagtggcctgcttaccctcctttgttttcttggtcttctgacttcctatgcagttattttatgccatgttcacaggtcagcttctgaaggaaaaaacaaagctatatctacatgtaccactcatgttatcattatatttattatgtttggacctgcaatttttatttatacacgtccattcactgccctatcagctgacaaagtcgtttccttcttccatacagtaatatttccactgatgaatcctgtgatttatacccttcggaatcaggaagtaaaaacttccatgaaaaagttaatcatccggcatattatttgttaa

SEQ ID NO: 1537 - DNA, 948 bp, Mus musculus
atgtcagaagtaacaaacaccactcatgatcctttctacttcatcctcaccggcatcccaggatttgaggatatccatctctggatctccattcccttattctgcctctacaccatctccatcatgggaaacaccaccatcctaaccgttatccgcacagagccatctctccaccagcccatgtacctcttcctctccatgctggccctcactgacctgggtctaactctcaccacactccctacagtcatgcagctcctttggttcaacatccgagaaatcagctttgaggcctgttttgcccagttcttcttcctccatgggttctctttcatggaatcatctgttctattggccatgtcctttgaccgttatgtggccatctgtcgcccactccactatgcctccatcctcaccagtgaggtcattgctagaatagggttggccatcatttgccgctgtgtcttggctgttcttccctcccttttcctgctcaagcgcctgcccttctgccattcccaccttatttctcactcctactgcctccaccaggatatgattcacctggtctgcgctgacatcagagtcaacagctggtacggatttgctcttgtcctgctcattattgtattggaccctctgctcattgtactctcctatgcacttatcctgaagagtgtcttgaacacagccacttggactgaacgactccgggctctcaacaactgtctgtcccacatgctggctgttctggttctctatgtccctatggttggtgtgtctatgactcaccgctttgccaagcatgcctctccactggtccatgttctcatggccaatatctacctgctagcacctcctgtgatgaaccccatcatttacagtgtaaagacaaagcagatccgtcaaggaattactcgcctcctcttgcagagaaaggtgcactga

SEQ ID NO: 1538 - DNA, 963 bp, Mus musculus
atgagttcctgcaacttcacccatgccaccttcctgcttattggtattccaggactggaggaagctcacttttggtttggcttccccctgctttccatgtatgctgtagcattgtttggaaactgcattgtggtcttcatagtgagaacagagcggagcctgcatgcacccatgtacctttttctctgcatgctggcagctattgatctggctttgtccacatccacaatgcccaagattctcgccctcttttggtttgactcccgggagattacttttgatgcctgtcttgcccagatgtttttcattcatactctctcagcaattgaatctactatcctgctggccatggcctttgaccggtacgtggctatctgccacccactgcgtcacgctgctgtcctcaacaatacagtaacagtccaaataggcatggtggctctggtccggggatccctattctttttcccactcccactactgatcaagcgactggctttctgtcactccaatgtgctctcccactcctattgtgtccaccaggatgtgatgaagttggcctatacagacacattacccaatgtagtctatggtctaactgccattctgctagtcatgggtgtagatgtcatgttcatctccttgtcctacttcctgatcatacgaacggttctgcaactgccttccaagtctgagcgagctaaggcatttgggacttgtgtgtcacacattagtgtggtcctggctttctatgtaccactcattggtctgtcagtggtgcaccgttttggaaacagcctggatcccattgtgcatgttctaatgggggatgtctacctgctgctgcctcctgtgatcaatcccatcatctacggtgctaagaccaaacagatcagaacacgggttctggctatgttcaagatcagctgtgacaaggacattgaagctgggggaaacacgtga

SEQ ID NO: 1539 - DNA, 945 bp, Mus musculus
atgctggctggaaatggctcttctgtgacagaatttgtccttgctggtttgacagatcgtccagagctccagctgcctctcttttacctgtttctaataatctacataatcacagtggtgggaaacttgggcttgatcatcctgattggcctcaatcctcacctgcacacccccatgtactatttcctcttcaacctctccttcattgatctctgttactcttctgtcttcagccccaaaatgctgattaactttgtctctgagaagaattccatctcctatgcggggtgcatgactcaactgtttctctttctcttttttgtcatctctgaatgctacatgttgacctcaatggcctatgatcgctatgtggccatctgtaatccactgttgtataaggtcaccatgtcccctcagatctgttctgtgatatcttttgctgcgtatgggatgggatttgctggatcctctgcccacacaggctgtatgctcagactgaccttctgcaatgtcaatgtcatcaaccattacttatgtgacattcttcctctccttcaactttcctgcaccagtacctatgtcaatgaggttgtggttctcatagttgtgggtattaacatcacagttccaagcttcaccatcctcatttcctatgttttcatccttgccaacattctaaacatcaaatccacacaaggaagagcaaaagccttcagcacctgtagctctcacatcatggcaatttctcttttctttggatcagctgcatttatgtatcttaaatattcttctggatctatggaacaaggaaagatatcttcagttttctacactaatgttggtcccatgctcaaccctctgatttacagtttgaggaataaggatgtcaaggtggcattaaggaaatcattgattaagttcagagaaaagacagattttaattag

SEQ ID NO: 1540 - DNA, 954 bp, Mus musculus
atggagccaagaaacaatactcatattttagaattttttctattgggattttcacaggacccaaacttgcagcctgttatatgtggccttttcctctccatgtacttgatcactgtagttggaaacttgctcattattctcaccatcatctcagatgccaacttgcatacacccatgtacttttttctctctaacctgtcatttgtggatatctgctttgtttccaccactgtcccaaaaatgcttgtgaatattcaaacaaagagaaaatccattagctatgcagattgcatcacccagatgtacttttttctgatttttgtggaattggacaacttcctcctggctgtaatggcctatgaccgttatgtggccatctgccatccactgcattatactggtatcatgaatcgcagactctgtggatttttggttcttgtatgctggattgtgagtgttctgcatgccttgttacaaagcatgatggtgctgcggctgtccttctgcacagacttggaaatcccacacttcttctgtgaattgaatcaggtggcacagctaacctgttctgacacctttctcaatgatgtggtcatgtattttgcacttgttttattagccattgttcctctgtttggcatcctttactcttactccaagatagtatcctccatacgagcaatgtccacagttcaggggaagtataaagcattttccacctgtgcatctcatctctccgttgtctccttattttacttcactggtctaggagtatacctcagttctgcagtaagtcacagctcacaagcaagtgcaacagcctctgtgatgtacacagtggtgactcccatgctaaaccctttcatctacagcctgaggaataaagatgtaaaaggagccctgaagaggctcttaggggtaaaactatgagtgatttctttaccctggggttaa

SEQ ID NO: 1541 - DNA, 933 bp, Mus musculus
atgggaaacaatatgacattaatcacagagttcatcctcctgggatttcctctcagcccgaggatgcagatgctcctctttgccctcttctccctcttctatgccttcaccctgctggggaatggaaccatcgtggggctcatctgcctggactccagactccacactcccatgtacttcttcctgtctcatctggccatcgttgacattgcctatgcctgcaacacagtgccccagatgctggtgaaccttttagatccagtgaagcccatttcctatgctggttgtatgacacagacttttctctttttgacatttgctatcacagaatgccttctcctagtggtgatgtcctatgaccggtatgttgcaatctgtcacccactccgttactctgccatcatgagctggagagtttgcagcaccatggcagtgacttcctggattattggtgttctgctgtctttgatccacctcgtgttacttttacccttacccttctgtgtgtctcagaaagtgaaccactttttctgtgaaattacagctatcctcaaacttgcctgtgcagacacacacctcaatgagacgatggtcctggctggggcagtgtctgtccttgtggggccattctcctcaattgtggtctcttatgcatgtatccttggtgctatcctgaagatccagtcagaagagggtcaaaggaaagccttttccacctgctcctcccacctctgtgtggtcggattgttttatggtaccgccattgtcatgtacgttggacccagacacgggagcccaaaggagcagaagaaatatcttttgctgtttcacagtctttttaaccctatgctcaaccccttgatctatagtctcaggaattctgacgtgaagaatacattgaaaagagtgctgaggacacagagagctttgtga

SEQ ID NO: 1542 - DNA, 930 bp, Mus musculus
atagaagagcaaaatataacccgtatctcagaattccacctcatgggactctcagatgacctgcagcttcagcctatactctttggactgttcctgtccatgtacctggtcacgctgcttgggaacctgctcatcattctgacagtcagctctgattcccacctccacagtccaatgtactttttcctctctaacttatccttggctgatgtcagtttcacttccaccacactaccaaagatgatagtggacattcagactcacaacagagccatctcctattcaggatgcctgactcagatgtcctttttcatgctgtttgggtgtttggatagtctgcttctaactgcaatggcttatgataggtttgtggccatctgtcatcctttgcactaccagttcattatgaaccctcgtctttgtggcttgttggtttttctatctgttctaatcagtctttttgtctctcagctgcataattcagtagtattacaacttacctacttcaagagtgtggatatttcccatttcttctgtgatccgtctcaacttctcaaccttgcctgttctgatacctttaccaataacatagtcatgtattttgttggtgccatctctggttttctccctatctctggaatttttttctcttattataaaattgtttcctccattcttagaatgccatcacctggtgggaaatataaagccttctctacctgtggctctcacctgtcagttgtttgcttattttatggaactggtcttggggtatacctcagttcagctgtgtccttgtctcccaggaagggtgcagtagcatcaatagtgtacactgttgtcacccctatgctcaacccctttatctacagcttaagaaaccaggacataaagagggccatgtggcggctcctcagaaaaacagtctaa

SEQ ID NO: 1543 - DNA, 966 bp, Mus musculus
atggaggaaaatcagaccatggtcacagagttcgtcctgctgggattctgtcttggcccgaggattcacctagttctttttctgcttttctctctcttctatactctcaccatactggggaatgggactatccttgcaatgatctgcctggactccagactccacactcccatgtacttcttcctgtcccacctggccattgtcgatatggcctatgcctgcaacacagtgcctcagacactcataaacctcttggatgagaccaggcccatcacctttgctggatgcatgacacagacctttctcttcttggcttttgcccacactgaatgtgtgctccttgttgtgatgtcctatgaccggtatgtagctatctgccacccgctacactacactgtcatcatgaactggagagtgtgtaccattctggctgctgtttcctggatatttagctttctccttgctctggtccatttagttctcatcctgaggctgcccttctgtggacctcatgaaatcaatcacttcttctgtgaaatcctgtctgtcctcaagctggcctgtgctgacacaacactcaatcaggtcgttatctttgcagcttgtgtgttcatattagtggcccccctatgctttgtactagtctcctacacacgcatcctggtggccatcctgaggatccagtcaggggagggacgcagaaaggccttctctacctgttcctcccacctctgtgtggtagggctcttctttggcagtgccattgtcatgtacatggcccccaagtcccagcacccagaggagcagcagaaggttcttttcctgttttacagttttttcaaccccatgctgaaccccctaatctacagtctgaggaatgctgaggtgaagggcgccctcaagaggtcactgtgcaaagaaagtcattcctggttggtgtggtgttcggaccataaatcttggtag

SEQ ID NO: 1544 - DNA, 940 bp, Mus musculus
ccccctcaggctaaccacagctcagcggagcgcttcctactgctgggtttcagcgactggccctctctgcagcctgtcctcttcgcactggtccttctctgctacctactaacgctcaccggcaacgcggcgttggtgctgctggccattcgcgaccctcgcctgcacacacccatgtactacttcctttgccacttggctctggtggatgtgggtttcaccactagtgtggtgccaccgctgctggccagcctgcgcggctcaatgctgcagctaccgcgcgctgggtgcatggctcagctgtgctcatcgctggcgctgggctccgccgagtgcgtgctgctggccgtcatggcgctggaccgcgcggctgcggtatgcaaccctctgcgctacacctcactggcctcgccgctactgtgccgcacgctggcccggagtctcctggctcggtggcctggccaactccgcggcgcagaccgccctgctggccgcgcgtcccctgtgcgcaccccgctgtctggaccatttcatctgcgagttgccggcgctgctgcagctggcctgccgcggcggccgcagcgccaccgagcgccagatgttcgccgcgcgtgtggtcatcctgttggtgccttcggcggtcatcctggcctcctacatcgccgtgggccgcgcggtctggggcatgcactccagctctggctggcggaaagcggcgagcacatgtggctctcacttgaccgcggtctgcctattttatggctctgccacctacacctacctgcaacccacgcatagttacaaccagggccgtggcaaattcgtctcgctcttctacacggtggtcactcccgctctcaatcctctcatctacacactgaggaacaaggaagtgaagggggcggcactgaggctcttgcggagtctggggaggccatag

SEQ ID NO: 1545 - protein, 642 aa, Mus musculus
MAEEAAPSESRAAGRLSLELCAEALPGRREEVGHEDTASHRRPRADPRRWASGLLLLLWLLEAPLLLGVRAQAAGQVSGPGQQAPPPPQPQQSGQQYNGERGISIPDHGYCQPISIPLCTDMAYNQTIMPNLLGHTNQEDAGLEVHQFYPLVKVQCSAELKFFLCSMYAPVCTVLEQALPPCRSLCERARQGCEALMNKFGFQWPDTLKCEKFPVHGAGELCVGQNTSDKGTPTPSLLPEFWTSNGQHGGGGYRGGYPGGAGTVERGKFSCPRALRVPSYLNYHFLGEKDCGAPCEPTKVYGLMYFGPEELRFSRTWIGIWSVLCCASTLFTVLTYLVDMPRFSYPERPIISLSGCYTAVAVAYIAGFLLEDRVVCNDKFAEDGARTVAQGTNKEGCTILFMMLYFFSMASSIWWVILSLTWFLAAGMKWGHEAIEANSQYFHLAAWAVPAIKTITILALGQVDGDVLSGVCFLGLNNVDALRGFVLAPLFVYLFIGTSFLLAGFVSLFRIRTIMKHDGTKTEKLEKLMVRIGVFSVLYTVPATIVIACYFYEQAFRDQWERSWVAQSCKSYAIPCPHLQGGGGVPPHPPMSPDFTVFMIKYLMTLIVGITSGFRIWSGKTLNSWRKFYTRLTNSKQGETTV

SEQ ID NO: 1546 - DNA, 1929 bp, Mus musculus
atggctgaggaggcggcgcctagcgagtcccgggccgccggccggctgagcttggaactttgtgccgaagcactcccgggccggcgggaggaggtggggcacgaggacacggccagccaccgccgcccccgggctgatccccggcgttgggctagcgggctgctgctgctgctttggttgctggaggctcctctgcttttgggggtccgagcgcaggcggcgggccaggtatccggcccgggccagcaagccccgccgccgccccagccccagcagagcgggcagcagtacaacggcgaacggggcatctccatcccggaccacggctactgccagcccatctccatcccgctgtgcacggacatggcgtacaaccagaccatcatgcccaacctgctgggccacacgaatcaggaggacgccggtctggaggtgcaccagttctaccctctggtgaaggtgcagtgctccgccgagctcaagttcttcctgtgctccatgtacgcgcctgtgtgcaccgtactggagcaggcgctaccgccctgccgctccctgtgcgagcgcgcacgccagggctgcgaggcgctcatgaacaagttcggcttccagtggccagacacactcaagtgcgagaagttcccggtgcacggcgcaggagagctgtgcgtgggccagaacacgtccgacaaaggcaccccaactccctccttgctaccagagttctggaccagtaatggccagcacggcggcggtggttaccgcggcggctacccggggggtgccgggacggtggagcggggaaagttctcctgcccgcgcgccctcagggtcccctcctacctcaactaccactttctgggggagaaggactgcggcgcaccctgcgaacccaccaaggtttacgggctcatgtacttcgggccagaggagctgcgcttctcgcgcacctggataggcatctggtccgtgctgtgctgcgcctccacgctcttcacggtgctcacgtacctagtcgacatgccgcgcttcagctacccggaacggcccatcatttccctgtccggctgttacacagcggtggcggtggcctacatcgctggctttctcttggaggaccgggtggtgtgcaacgacaagtttgcagaggacggggcgcgcacggtggcgcagggcactaacaaagaaggctgcactatactctttatgatgctctacttcttcagcatggccagctccatctggtgggtgatcctgtccctcacctggttcctggcagccggcatgaagtggggccacgaagccatcgaggccaactcacagtatttccatttagccgcctgggctgtgccagccatcaaaactataaccatcttggcgttgggccaggtggatggcgacgtactgagcggagtgtgttttctggggctcaacaacgtggacgcactgcgtggctttgtgctggcgcctctcttcgtttatctgttcattggcacttctttcctgctggccggtttcgtgtcactcttccgcatccgcaccatcatgaagcatgacggcaccaagacagagaagctggagaagctcatggtgcgcatcggagtcttcagtgtcctctacactgtgccggccaccatcgtcatcgcctgctacttctatgaacaggcctttcgggaccagtgggagcgcagctgggtggcccagagctgcaagagttatgccatcccttgccctcacctccagggaggtggaggagtcccaccacacccgcccatgagcccagactttacagtcttcatgatcaagtatctcatgacgctgattgtgggcatcacatcgggcttccggatctggtccggcaagacactgaattcctggaggaagttctacacgaggcttaccaacagcaaacagggggagactaccgtctga

SEQ ID NO: 1547 - protein, 301 aa, Mus musculus
MLTLECVLGLMGNAVALWTFFYRLKVWKPYAVYLFNLVVADLLLATSLPFFAAFYLKGNTWKLGHMPCQVLLFLLAFSRGVGVAFLTTVALDRYLRVVHPRLRVNLLSLRASWGISSLIWLLMVVLTPQNLLTCRTTQNSTECPSFYPTGGAKAIATCQEVLIFFLQVLLPFGLISFCNSGLIRTLQKRLQESDKQSRIWRARVLVAIVLLLFGLCFLPSVLTRVLVHIFQEFKSCSVQQAIVRASDIAGSLTCLHSTLSPAIYCFSNPAFTHSYRKVLKSLRGRRKAAESPSDNLRDSYS

SEQ ID NO: 1548 - DNA, 906 bp, Mus musculus
atgctgacactggagtgtgtgctgggccttatgggcaatgctgtggccctctggaccttcttttaccgtctcaaagtatggaagccttatgctgtctacctgttcaacctggtggtggctgacctgctattggccaccagtctgccattctttgctgccttctatctgaagggcaacacctggaaacttggacacatgccctgccaagtccttctcttcttgctggcattcagccgtggtgtaggagtagccttcctgacaacagtggctttagaccggtatctgcgtgtggtccatcctcggctcagagttaacttgctgtctctgagggcatcttggggcatctccagcctcatctggcttctgatggttgttctcactccccaaaaccttctcacttgcaggactacccagaattccacggaatgccccagcttctaccccacaggaggggccaaagccattgccacctgccaagaggtactaatcttcttccttcaggtcctgcttccctttggcctcatctccttctgcaacagtgggctcatcaggaccctccagaagagactccaagagtctgacaaacagtccaggatctggagggccagggtgctggttgccatagtgctgctactgtttggactgtgcttcctgcctagtgtcctgaccagggttctggtgcacatctttcaggaatttaagagctgcagtgtccagcaagccatagtgcgggcctctgacatcgctggcagcctcacctgcctgcacagtacattgagcccagccatttactgcttctccaatccagccttcacccactcataccggaaggtgctcaaaagccttcgaggcaggaggaaggcagcagagtcacctagcgacaacctcagggactcctattcctga

SEQ ID NO: 1549 - protein, 323 aa, Mus musculus
MAQRLTGEQTLDHYEDSTHASIFTYTNSNSTKGPFEGPNYHIAPRWVYHLTSTWMILVVVASVFTNGLVLAATMRFKKLRHPLNWILVNLAVADLAETIIASTISVVNQIYGYFVLGHPLCVIEGYIVSLCGITGLWSLAIISWERWLVVCKPFGNVRFDAKLATVGIVFSWVWAAIWTAPPIFGWSRYWPYGLKTSCGPDVFSGTSYPGVQSYMMVLMVTCCIFPLSIIVLCYLQVWLAIRAVAKQQKESESTQKAEKEVTRMVVVMVFAYCLCWGPYTFFACFATAHPGYAFHPLVASLPSYFAKSATIYNPIIYVFMNRQ

SEQ ID NO: 1550 - DNA, 969 bp, Mus musculus
atggcccaaaggcttacaggtgaacagacactggaccactatgaggatagcacccatgcaagcatcttcacctataccaacagcaacagcaccaaaggtccctttgaaggccccaattatcacattgctcccaggtgggtgtaccacctcaccagcacctggatgattcttgtggtcgttgcatctgtcttcactaatggacttgtgctggcagccaccatgagattcaagaagctgcgccatccactgaactggattctggtgaacttggcagttgctgacctagcagagaccattattgccagcactatcagtgttgtgaaccaaatctatggctacttcgttctgggacaccctctgtgtgtcattgaaggctacattgtctcattgtgtggaatcacaggcctctggtccctggccatcatttcctgggagagatggctggtggtctgcaagccctttggcaatgtgagatttgatgctaagctggccactgtgggaatcgtcttctcctgggtctgggctgctatatggacggccccaccaatctttggttggagcaggtactggccttatggcctgaagacatcctgtggcccagacgtgttcagcggtacctcgtaccccggggttcagtcttatatgatggtcctcatggtcacgtgctgcatcttcccactcagcatcatcgtgctctgctacctccaagtgtggctggccatccgagcagtggcaaagcaacagaaagaatctgagtccactcagaaggccgagaaggaggtgacacgcatggtggtggtgatggtcttcgcatactgcctctgctggggaccctatactttctttgcatgctttgctactgcccaccctggctatgccttccaccctcttgtggcctccctaccatcctactttgccaaaagtgccactatctacaaccccattatctatgtctttatgaaccggcag

SEQ ID NO: 1551 - protein, 424 aa, Homo sapiens
MTACTLLPLPPLCPFTCDAWWAIPWSLKCRVLGVPPSSWSLSFPIHTHNCPMPLNPRSCTCPVSVSCLQTFRHKLVEPVCAFWNYRGAWATTGCSVAALYLDSTACFCNHSTSFAILLQIYEVQAWVLLAACCTVEANAGVGGLRVTRVPKSERTTVHKNLTFSLASAEGFLMTSEWAKANEVACVAVTVAMHFLFLVAFSWMLVEGLLLWRKVVAVSMHPGPGMRLYHATGWGVPVGIVAVTLAMLPHDYVAPGHCWLNVHTNAIWAFVGPVLFVLTANTCILARVVMITVSSARRRARMLSPQPCLQQQIWTQIWATVKPVLVLLPVLGLTWLAGILVHLSPAWAYAAVGLNSIQGLYIFLVYAACNEEVRSALQRMAEKKVAEVLRALGVWVGAGGPQSQVPAPISSPLSPVPALPAGGPA

SEQ ID NO: 1552 - DNA, 1430 bp, Homo sapiens
aaggagaggagaggcgcagttgcttaactgctccccggtgatggctgcttagcttgttcccagtttttccaccttccacaccatgctggaatgacagcctgcactctcctccctctgcctcccctctgccccttcacctgtgacgcatggtgggcaatcccctggtccctaaaatgcagagtccttggcgtccctccatcctcctggtctctctcctttcccatccacactcacaactgccccatgcccctcaatccacgctcatgcacctgccctgtctctgtctcctgcctccagaccttccgtcataagctggtggagcctgtctgtgctttctggaactacaggggtgcctgggccaccacaggctgctccgtggctgccctgtacctggactccaccgcctgcttctgcaaccacagcaccagctttgccatcctgctgcaaatctatgaagtacaggcctgggtcctgctggctgcctgctgcactgtggaggcgaatgcgggcgtggggggccttagagtcaccagggtccccaagtcagagcgaaccacagtccacaagaacctcaccttctccctggcctctgccgagggcttcctcatgaccagcgagtgggccaaggccaatgaggtggcatgtgtggctgtcacagtcgcaatgcacttcctctttctggtggcattctcctggatgctggtggaggggctgctgctgtggaggaaggtggtagctgtgagcatgcacccgggcccaggcatgcggctctaccacgccacaggctggggcgtgcctgtgggcatcgtggcggtcaccctggccatgctcccccatgactacgtggcccccggacattgctggctcaatgtgcacacaaatgccatctgggccttcgtggggcctgtgctcttcgtgctgactgccaacacctgcatcctggcccgtgtggtaatgatcaccgtgtccagtgcccgccgccgtgcccgcatgttgagcccacagccctgcctgcagcagcagatctggacccagatatgggccacggtgaagcccgtgctggtcctgctgcccgtcctaggcctgacctggctggcaggcatcctggtgcacctgagccccgcctgggcctacgctgccgtgggcctcaactccatccaggggctgtacatcttcctggtttatgctgcctgcaatgaggaggtgcggagcgccctgcagaggatggctgagaagaaggtggccgaggtgctcagggcactgggggtgtgggtgggggcgggaggcccccagagccaggtcccagcccccatatcctctcctttaagtcccgtgccagccctgccagctgggggaccagcctgaggcccccaggcccctgggaggcagcccgagggagccccatagccttggctccaccccggagacac

SEQ ID NO: 1553 - DNA, 1083 bp, Mus musculus; identical to SEQ ID NO: 1457

SEQ ID NO: 1554 - protein, 360 aa, Mus musculus; identical to SEQ ID NO: 814

SEQ ID NO: 1555 - protein, 363 aa, Homo sapiens [sequence omitted]

SEQ ID NO: 1556 - DNA, 1089 bp, Homo sapiens
atgaatcggcaccatctgcaggatcactttctggaaatagacaagaagaactgctgtgtgttccgagatgacttcattgtcaaggtgttgccgccggtgttggggctggagtttatcttcgggcttctgggcaatggccttgccctgtggattttctgtttccacctcaagtcctggaaatccagccggattttcctgttcaacctggcagtggctgactttctactgatcatctgcctgcccttcctgatggacaactatgtgaggcgttgggactggaagtttggggacatcccttgccggctgatgctcttcatgttggctatgaaccgccagggcagcatcatcttcctcacggtggtggcggtagacaggtatttccgggtggtccatccccaccacgccctgaacaagatctccaatcggacagcagccatcatctcttgccttctgtggggcatcactattggcctgacagtccacctcctgaagaagaagatgccgatccagaatggcggtgcaaatttgtgcagcagcttcagcatctgccataccttccagtggcacgaagccatgttcctcctggagttcttcctgcccctgggcatcatcctgttctgctcagccagaattatctggagcctgcggcagagacaaatggaccggcatgccaagatcaagagagccatcaccttcatcatggtggtggccatcgtctttgtcatctgcttccttcccagcgtggttgtgcggatccgcatcttctggctcctgcacacttcgggcacgcagaattgtgaagtgtaccgctcggtggacctggcgttctttatcactctcagcttcacctacatgaacagcatgctggaccccgtggtgtactacttctccagcccatcctttcccaacttcttctccactttgatcaaccgctgcctccagaggaagatgacaggtgagccagataataaccgcagcacgagcgtcgagctcacaggggaccccaacaaaaccagaggcgctccagaggcgttaatggccaactccggtgagccatggagcccctcttatctgggcccaacctctcct

SEQ ID NO: 1557 - DNA, 23 bp, Artificial Sequence
  Primer
cgactggagcacgaggacactga

SEQ ID NO: 1558 - DNA, 25 bp, Artificial Sequence
  Primer
gctgtcaacgatacgctacgtaacg

SEQ ID NO: 1559 - DNA, 26 bp, Artificial Sequence
  Primer
ggacactgacatggactgaaggagta

SEQ ID NO: 1560 - DNA, 23 bp, Artificial Sequence
  Primer
cgctacgtaacggcatgacagtg

SEQ ID NO: 1561 - DNA, 22 bp, Artificial Sequence
  Primer
gccgcgctgcaggtgcacgatg

SEQ ID NO: 1562 - DNA, 24 bp, Artificial Sequence
  Primer
tgccacctgctcttctacgtgatg

SEQ ID NO: 1563 - DNA, 23 bp, Artificial Sequence
  Primer
gcaaatcagtgtgcaaatcgaaa

SEQ ID NO: 1564 - DNA, 24 bp, Artificial Sequence
  Primer
cattcctggagagatctcgtggga

SEQ ID NO: 1565 - DNA, 23 bp, Artificial Sequence
  Primer
ggtgccactgatggagggtactg

SEQ ID NO: 1566 - DNA, 24 bp, Artificial Sequence
  Primer
ggtaagcctggcctactcggagag

SEQ ID NO: 1567 - DNA, 24 bp, Artificial Sequence
  Primer
tgcacctggccaacaaatcctttt

SEQ ID NO: 1568 - DNA, 24 bp, Artificial Sequence
  Primer
ggtaagcctggcctactcggagag

SEQ ID NO: 1569 - DNA, 18 bp, Artificial Sequence
  Primer
gggccagaggcgagatgt

SEQ ID NO: 1570 - DNA, 16 bp, Artificial Sequence
  Primer
gcaggtccgcgcagaa

SEQ ID NO: 1571 - DNA, 18 bp, Artificial Sequence
  Primer
ccaccagatccgcgtgtc

SEQ ID NO: 1572 - DNA, 22 bp, Artificial Sequence
  Primer
gttggtcaggttggtctcgaac

SEQ ID NO: 1573 - DNA, 20 bp, Artificial Sequence
  Primer
actaccttctggcgctcaca

SEQ ID NO: 1574 - DNA, 22 bp, Artificial Sequence
  Primer
cccagcaggacactgtagtaga

SEQ ID NO: 1575 - DNA, 24 bp, Artificial Sequence
  Primer
atggatcccagcgttgttagcaat

SEQ ID NO: 1576 - DNA, 24 bp, Artificial Sequence
  Primer
tggagtccttggatggccttattc

SEQ ID NO: 1577 - DNA, 19 bp, Artificial Sequence
  Primer
ccgcgaacacgatgaccac

SEQ ID NO: 1578 - DNA, 24 bp, Artificial Sequence
  Primer
gggggaagctgggacctccgaata

SEQ ID NO: 1579 - DNA, 23 bp, Artificial Sequence
  Primer
cgaggtcctcaagtgggctcact

SEQ ID NO: 1580 - DNA, 23 bp, Artificial Sequence
  Primer
ggtgtttctatggcgcgatctca

SEQ ID NO: 1581 - DNA, 23 bp, Artificial Sequence
  Primer
cgttgttagcaatgagtattatg

SEQ ID NO: 1582 - DNA, 28 bp, Artificial Sequence
  Primer
tatcactttattttattaaaggttacac

SEQ ID NO: 1583 - DNA, 25 bp, Artificial Sequence
  Primer
atggagcacacgcacgcccacctcg

SEQ ID NO: 1584 - DNA, 25 bp, Artificial Sequence
  Primer
tcatgatgatgcggggggcccaaag

SEQ ID NO: 1585 - DNA, 25 bp, Artificial Sequence
  Primer
cggccaagggtaggagccagtcctg

SEQ ID NO: 1586 - DNA, 25 bp, Artificial Sequence
  Primer
cttgagcgggtggcagacagcgata

SEQ ID NO: 1587 - DNA, 23 bp, Artificial Sequence
  Primer
gggtttcgtgcccgtggtctact

SEQ ID NO: 1588 - DNA, 23 bp, Artificial Sequence
  Primer
atggtgaacaagatggcggtggt

SEQ ID NO: 1589 - DNA, 19 bp, Artificial Sequence
  Primer
cacccgctcaagtaccaca

SEQ ID NO: 1590 - DNA, 23 bp, Artificial Sequence
  Primer
tcacaggatgatgacacaagctc

SEQ ID NO: 1591 - DNA, 22 bp, Artificial Sequence
  Primer
ccatcttgttcaccattacctc

SEQ ID NO: 1592 - DNA, 25 bp, Artificial Sequence
  Primer
cattacgactttttataggttttcc

SEQ ID NO: 1593 - DNA, 22 bp, Artificial Sequence
  Primer
caccgagccggcgaccagagtc

SEQ ID NO: 1594 - DNA, 22 bp, Artificial Sequence
  Primer
tgagcgggtggcagacagcgat

SEQ ID NO: 1595 - DNA, 23 bp, Artificial Sequence
  Primer
atgggggatgagctggcaccttg

SEQ ID NO: 1596 - DNA, 23 bp, Artificial Sequence
  Primer
tggcacggggaagcatcatgagt

SEQ ID NO: 1597 - DNA, 27 bp, Artificial Sequence
  Primer
tagttccagacagctgctccttccttt

SEQ ID NO: 1598 - DNA, 27 bp, Artificial Sequence
  Primer
gaagtcttggcctctgcatagatcctc

SEQ ID NO: 1599 - DNA, 25 bp, Artificial Sequence
  Primer
atggtggcagtgggatgatctgtta

SEQ ID NO: 1600 - DNA, 24 bp, Artificial Sequence
  Primer
aggtagcgcagtggatggatgact

SEQ ID NO: 1601 - DNA, 25 bp, Artificial Sequence
  Primer
gctgtactggcttttccttccctca

SEQ ID NO: 1602 - DNA, 22 bp, Artificial Sequence
  Primer
acaccacccctgtgctcacgta

SEQ ID NO: 1603 - DNA, 23 bp, Artificial Sequence
  Primer
ctgctctcagacctggcctacat

SEQ ID NO: 1604 - DNA, 25 bp, Artificial Sequence
  Primer
ctaggaaatggtaaagatggcctgg

SEQ ID NO: 1605 - DNA, 25 bp, Artificial Sequence
  Primer
tgccatgctcccatacctgtacctg

SEQ ID NO: 1606 - DNA, 25 bp, Artificial Sequence
  Primer
ctccactgctgtggatcgttggctt

SEQ ID NO: 1607 - DNA, 24 bp, Artificial Sequence
  Primer
atgtggcctcctggtcattgttac

SEQ ID NO: 1608 - DNA, 25 bp, Artificial Sequence
  Primer
attttggcttctgtgtgttggtcag

SEQ ID NO: 1609 - DNA, 57 bp, Artificial Sequence
  Primer
  misc_feature (57)..(57): n is a, c, g, or t
aagcagtggtatcaacgcagagtacttttttttttttttttttttttttttttttvn

SEQ ID NO: 1610 - DNA, 26 bp, Artificial Sequence
  Primer
  misc_feature (26)..(26): n is a, c, g, or t
ttttttttttttttttttttttttvn

SEQ ID NO: 1611 - DNA, 30 bp, Artificial Sequence
  Primer
aagcagtggtatcaacgcagagtacgcggg

SEQ ID NO: 1612 - DNA, 23 bp, Artificial Sequence
  Primer
aagcagtggtatcaacgcagagt

SEQ ID NO: 1613 - DNA, 45 bp, Artificial Sequence
  Primer
ctaatacgactcactatagggcaagcagtggtatcaacgcagagt

SEQ ID NO: 1614 - DNA, 22 bp, Artificial Sequence
  Primer
ctaatacgactcactatagggc

SEQ ID NO: 1615 - DNA, 23 bp, Artificial Sequence
  Primer
tggatgatctcatgagcgtcctg

SEQ ID NO: 1616 - DNA, 22 bp, Artificial Sequence
  Primer
tctgaaaccccacgacgttctg

SEQ ID NO: 1617 - DNA, 22 bp, Artificial Sequence
  Primer
agaaccgggggactctctatgg

SEQ ID NO: 1618 - DNA, 23 bp, Artificial Sequence
  Primer
ggtgggcaaaaagagggagtatg

SEQ ID NO: 1619 - DNA, 25 bp, Artificial Sequence
  Primer
cacaagtcagatctccatccctacg

SEQ ID NO: 1620 - DNA, 25 bp, Artificial Sequence
  Primer
tgctgtatccagaagcctaccatgt

SEQ ID NO: 1621 - DNA, 25 bp, Artificial Sequence
  Primer
ggactgtgtctctccatgcacctac

SEQ ID NO: 1622 - DNA, 26 bp, Artificial Sequence
  Primer
gatccattcttgctcctgttagacca

SEQ ID NO: 1623 - DNA, 25 bp, Artificial Sequence
  Primer
tgactcttatgcatgggattgatga

SEQ ID NO: 1624 - DNA, 27 bp, Artificial Sequence
  Primer
ctcctaccaagttcccctctagatgtt

SEQ ID NO: 1625 - DNA, 24 bp, Artificial Sequence
  Primer
agatgggattctgtgcacaagctc

SEQ ID NO: 1626 - DNA, 23 bp, Artificial Sequence
  Primer
acatgaagatggtcaccgacagg

SEQ ID NO: 1627 - DNA, 24 bp, Artificial Sequence
  Primer
gtagaaatcagcaccacgccctct

SEQ ID NO: 1628 - DNA, 26 bp, Artificial Sequence
  Primer
cagatctccatccctacgttactcca

SEQ ID NO: 1629 - DNA, 22 bp, Artificial Sequence
  Primer
cggtaatgggaggaattcacgg

SEQ ID NO: 1630 - DNA, 22 bp, Artificial Sequence
  Primer
cggagcagacagccttgaatct

SEQ ID NO: 1631 - DNA, 21 bp, Artificial Sequence
  Primer
gtggatgtggtagcgctggtt

SEQ ID NO: 1632 - DNA, 22 bp, Artificial Sequence
  Primer
aaatcctgcccaagaccgtgaa

SEQ ID NO: 1633 - DNA, 21 bp, Artificial Sequence
  Primer
ctggctcgaggcggaaactaa

SEQ ID NO: 1634 - DNA, 20 bp, Artificial Sequence
  Primer
acggctgtgcgctcacgaga

SEQ ID NO: 1635 - DNA, 21 bp, Artificial Sequence
  Primer
agcacgccaaagacccacgag

SEQ ID NO: 1636 - DNA, 22 bp, Artificial Sequence
  Primer
gctggaaaggagatcgccatgt

SEQ ID NO: 1637 - DNA, 22 bp, Artificial Sequence
  Primer
tggcccatgacggtgtcaatag

SEQ ID NO: 1638 - DNA, 21 bp, Artificial Sequence
  Primer
gcgtgcttgctgtcaacggtt

SEQ ID NO: 1639 - DNA, 21 bp, Artificial Sequence
  Primer
gctcacacggctgacaggtcg

SEQ ID NO: 1640 - DNA, 21 bp, Artificial Sequence
  Primer
tgtcttcaacgctgccaagcc

SEQ ID NO: 1641 - DNA, 21 bp, Artificial Sequence
  Primer
ggtacagcagacccacgacgg

SEQ ID NO: 1642 - DNA, 24 bp, Artificial Sequence
  Primer
atccaaggagggcctgaaagtcta

SEQ ID NO: 1643 - DNA, 21 bp, Artificial Sequence
  Primer
caaggctgtctgctccgagag

SEQ ID NO: 1644 - DNA, 22 bp, Artificial Sequence
  Primer
gctggaaaggagatcgccatgt

SEQ ID NO: 1645 - DNA, 22 bp, Artificial Sequence
  Primer
tgaagtccaggaaggcgcagta

SEQ ID NO: 1646 - DNA, 21 bp, Artificial Sequence
  Primer
cccctgccctgtttgtcatcg

SEQ ID NO: 1647 - DNA, 21 bp, Artificial Sequence
  Primer
gctgtctcggggccacaacac

SEQ ID NO: 1648 - DNA, 25 bp, Artificial Sequence
  Primer
tgacctgggaaaatctatacggtcg

SEQ ID NO: 1649 - DNA, 24 bp, Artificial Sequence
  Primer
ttggttatgatgggatggtaggca

SEQ ID NO: 1650 - DNA, 24 bp, Artificial Sequence
  Primer
cctgggcagagaagacatagacct

SEQ ID NO: 1651 - DNA, 27 bp, Artificial Sequence
  Primer
gtaatttgggatggagtggtcatatct

SEQ ID NO: 1652 - DNA, 24 bp, Artificial Sequence
  Primer
ggcttcatttcaatggcatacaat

SEQ ID NO: 1653 - DNA, 27 bp, Artificial Sequence
  Primer
tcaataagcctagttgggagagtcaat

SEQ ID NO: 1654 - DNA, 27 bp, Artificial Sequence
  Primer
agctgccggaactgtaccttggtttac

SEQ ID NO: 1655 - DNA, 26 bp, Artificial Sequence
  Primer
agccaccacagaactgccattaactg

SEQ ID NO: 1656 - DNA, 25 bp, Artificial Sequence
  Primer
gagcacacatatattcggtgaaccc

SEQ ID NO: 1657 - DNA, 24 bp, Artificial Sequence
  Primer
ctggcaatgaggacatctggtaaa

SEQ ID NO: 1658 - DNA, 23 bp, Artificial Sequence
  Primer
agtcaccaaacacattcgccttc

SEQ ID NO: 1659 - DNA, 27 bp, Artificial Sequence
  Primer
cccagataatatgcccaaagttgtagc

SEQ ID NO: 1660 - DNA, 27 bp, Artificial Sequence
  Primer
tgggcatattatctgggattactaaca

SEQ ID NO: 1661 - DNA, 22 bp, Artificial Sequence
  Primer
cagccaatgtggaagtgatagc

SEQ ID NO: 1662 - DNA, 27 bp, Artificial Sequence
  Primer
tggcaatgtcatcaattcctatgtcag

SEQ ID NO: 1663 - DNA, 23 bp, Artificial Sequence
  Primer
gtttgggctgtctccgtagggtt

SEQ ID NO: 1664 - DNA, 27 bp, Artificial Sequence
  Primer
cctttctatctacggaagcatcgactt

SEQ ID NO: 1665 - DNA, 26 bp, Artificial Sequence
  Primer
ggcactcacaacataggtggttaatg

SEQ ID NO: 1666 - DNA, 27 bp, Artificial Sequence
  Primer
gtgagtgccagcatttcagatgatatg

SEQ ID NO: 1667 - DNA, 25 bp, Artificial Sequence
  Primer
tgactgtgattgccaccatgatagc

SEQ ID NO: 1668 - DNA, 27 bp, Artificial Sequence
  Primer
tgccaaaacaaaaatcacatgctaatg

SEQ ID NO: 1669 - DNA, 26 bp, Artificial Sequence
  Primer
caggttgtgtggttgatccgttactt

SEQ ID NO: 1670 - DNA, 26 bp, Artificial Sequence
  Primer
ctatcatggtggcaatcacagtcagt

SEQ ID NO: 1671 - DNA, 27 bp, Artificial Sequence
  Primer
gtgagtcaaccctacaaatccgaaaaa

SEQ ID NO: 1672 - DNA, 23 bp, Artificial Sequence
  Primer
agccccgcaatctgttgataact

SEQ ID NO: 1673 - DNA, 23 bp, Artificial Sequence
  Primer
aagcagaaattcaggagcgtgtg

SEQ ID NO: 1674 - DNA, 21 bp, Artificial Sequence
  Primer
tggagaaggagacgcatctgc

SEQ ID NO: 1675 - DNA, 24 bp, Artificial Sequence
  Primer
cttggtcacctgcttgtagatgtt

SEQ ID NO: 1676 - DNA, 25 bp, Artificial Sequence
  Primer
cctgacctttcccagtgttcaatgt

SEQ ID NO: 1677 - DNA, 24 bp, Artificial Sequence
  Primer
ttgtccatgagaatctcccgtctg

SEQ ID NO: 1678 - DNA, 25 bp, Artificial Sequence
  Primer
ggaccctggaaaaacgaaactactg

SEQ ID NO: 1679 - DNA, 23 bp, Artificial Sequence
  Primer
tccatgagaatctcccgtctgtc

SEQ ID NO: 1680 - DNA, 23 bp, Artificial Sequence
  Primer
tgtgtacttcctgggcacctacg

SEQ ID NO: 1681 - DNA, 25 bp, Artificial Sequence
  Primer
gcaggccttctagcaatttaccctt

SEQ ID NO: 1682 - DNA, 18 bp, Artificial Sequence
  Primer
cgctgaccgccgctgtct

SEQ ID NO: 1683 - DNA, 17 bp, Artificial Sequence
  Primer
cgccgcagctgcacgta

SEQ ID NO: 1684 - DNA, 17 bp, Artificial Sequence
  Primer
ctcctggccgccgtctg

SEQ ID NO: 1685 - DNA, 18 bp, Artificial Sequence
  Primer
ggacccctccgctgacga

SEQ ID NO: 1686 - DNA, 18 bp, Artificial Sequence
  Primer
gcgccgcagctgcacgta

SEQ ID NO: 1687 - DNA, 18 bp, Artificial Sequence
  Primer
gcctgggcgccttctacg

SEQ ID NO: 1688 - DNA, 17 bp, Artificial Sequence
  Primer
aggtgcacgtgcgcctc

SEQ ID NO: 1689 - DNA, 17 bp, Artificial Sequence
  Primer
ccccgtgctgcgccaag

SEQ ID NO: 1690 - DNA, 18 bp, Artificial Sequence
  Primer
gcgtggcccggagcgttt

SEQ ID NO: 1691 - DNA, 21 bp, Artificial Sequence
  Primer
ggtcacggctgccacgaacat

SEQ ID NO: 1692 - DNA, 21 bp, Artificial Sequence
  Primer
gcacgcggaattgggataagg

SEQ ID NO: 1693 - DNA, 21 bp, Artificial Sequence
  Primer
ctctgctgggtgccggctaaa

SEQ ID NO: 1694 - DNA, 21 bp, Artificial Sequence
  Primer
atgacgcccaacagcactggc

SEQ ID NO: 1695 - DNA, 19 bp, Artificial Sequence
  Primer
tggcgggcgctgctcatag

SEQ ID NO: 1696 - DNA, 21 bp, Artificial Sequence
  Primer
ggatggctgagctggacggat

SEQ ID NO: 1697 - DNA, 25 bp, Artificial Sequence
  Primer
ttactggtcctgcctcctcgtctac

SEQ ID NO: 1698 - DNA, 21 bp, Artificial Sequence
  Primer
cagtcagtgcggggtcaaaca

SEQ ID NO: 1699 - DNA, 25 bp, Artificial Sequence
  Primer
aggctatcttcccagccccctacct

SEQ ID NO: 1700 - DNA, 21 bp, Artificial Sequence
  Primer
cttgcctgcctggagtcggac

SEQ ID NO: 1701 - DNA, 22 bp, Artificial Sequence
  Primer
ctcctctcagtcctggcctatg

SEQ ID NO: 1702 - DNA, 25 bp, Artificial Sequence
  Primer
acttcccagagacagagtctgtgtg

SEQ ID NO: 1703 - DNA, 25 bp, Artificial Sequence
  Primer
tgctaccacacaggacatatgtgtt

SEQ ID NO: 1704 - DNA, 24 bp, Artificial Sequence
  Primer
gagcccatagacttcgaggtacag

SEQ ID NO: 1705 - DNA, 25 bp, Artificial Sequence
  Primer
cctcaacacagctgcccagaaaagg

SEQ ID NO: 1706 - DNA, 23 bp, Artificial Sequence
  Primer
gctaggagcaggttcgcggtgat

SEQ ID NO: 1707 - DNA, 22 bp, Artificial Sequence
  Primer
tcctctggccgtttatgattat

SEQ ID NO: 1708 - DNA, 27 bp, Artificial Sequence
  Primer
tggaaaggaggaagagatactagttaa

SEQ ID NO: 1709 - DNA, 24 bp, Artificial Sequence
  Primer
agatctttcacatcagtagccaga

SEQ ID NO: 1710 - DNA, 19 bp, Artificial Sequence
  Primer
ggaagtgcattgcgactgt

SEQ ID NO: 1711 - DNA, 23 bp, Artificial Sequence
  Primer
ccaaggagaggagaggcgcagtt

SEQ ID NO: 1712 - DNA, 24 bp, Artificial Sequence
  Primer
gaaagcacagacaggctccaccag

SEQ ID NO: 1713 - DNA, 21 bp, Artificial Sequence
  Primer
tacctggactccaccgcctgc

SEQ ID NO: 1714 - DNA, 19 bp, Artificial Sequence
  Primer
cagggtgaccgccacgatg

SEQ ID NO: 1715 - DNA, 23 bp, Artificial Sequence
  Primer
ctctgtcatttgtgggctgtggc

SEQ ID NO: 1716 - DNA, 23 bp, Artificial Sequence
  Primer
ggtgttggcagtcagcacgaaga

SEQ ID NO: 1717 - DNA, 23 bp, Artificial Sequence
  Primer
gctgctgtggaggaaggtggtag

SEQ ID NO: 1718 - DNA, 23 bp, Artificial Sequence
  Primer
ggccctcaggatcaaatacgcta

SEQ ID NO: 1719 - DNA, 23 bp, Artificial Sequence
  Primer
ctcaatgtgcacacaaatgccat

SEQ ID NO: 1720 - DNA, 23 bp, Artificial Sequence
  Primer
ggccctcaggatcaaatacgcta

SEQ ID NO: 1721 - DNA, 24 bp, Artificial Sequence
  Primer
agaggagaggcgcagttgcttaac

SEQ ID NO: 1722 - DNA, 25 bp, Artificial Sequence
  Primer
catatctgggtccagatctgctgct

SEQ ID NO: 1723 - DNA, 20 bp, Artificial Sequence
  Primer
gcctccagaccttccgtcat

SEQ ID NO: 1724 - DNA, 25 bp, Artificial Sequence
  Primer
gcataaaccaggaagatgtacagcc

SEQ ID NO: 1725 - DNA, 22 bp, Artificial Sequence
  Primer
ggctgtcacagtcgcaatgcac

SEQ ID NO: 1726 - DNA, 22 bp, Artificial Sequence
  Primer
ggctggcacgggacttaaagga

SEQ ID NO: 1727 - DNA, 24 bp, Artificial Sequence
  Primer
gggctgtacatcttcctggtttat

SEQ ID NO: 1728 - DNA, 22 bp, Artificial Sequence
  Primer
agggagttctagggccataggt

SEQ ID NO: 1729 - DNA, 24 bp, Artificial Sequence
  Primer
cgggacttaaaggagaggatatgg

SEQ ID NO: 1730 - DNA, 21 bp, Artificial Sequence
  Primer
caggtcccagcccccatatcc

SEQ ID NO: 1731 - DNA, 21 bp, Artificial Sequence
  Primer
tcccacagtacccaccctgcc

SEQ ID NO: 1732 - DNA, 24 bp, Artificial Sequence
  Primer
tggctctcagaggtactcgcagca

SEQ ID NO: 1733 - DNA, 24 bp, Artificial Sequence
  Primer
aaagcacttctccctcagcgggtt

SEQ ID NO: 1734 - DNA, 24 bp, Artificial Sequence
  Primer
gggcatgggttgaatgacttcgag

SEQ ID NO: 1735 - DNA, 24 bp, Artificial Sequence
  Primer
tcctcccaaggggtactgcctggt

We claim:

1. A method for identifying a candidate compound for use in reducing the body weight of a mammalian subject, said method comprising:
   (a) contacting a cell expressing a SREB3 polypeptide comprising an amino acid sequence having at least 95% identity to the amino acid sequence set forth in SEQ ID NO. 243 with a candidate compound;
   (b) measuring the expression of said SREB3 polypeptide expressed in said cell,
   (c) contacting a cell expressing a SREB2 polypeptide comprising an amino acid sequence having at least 95% identity the amino acid sequence set forth in SEQ ID NO. 552 with said candidate compound; and
   (d) measuring the expression of said SREB2 polypeptide expressed in said cell,
   wherein the candidate compound is identified as a compound for use in reducing the body weight of a mammalian subject when a decrease in the expression of said SREB3 polypeptide is measured in a cell contacted with said compound relative to a cell not contacted with said compound and a decrease in the expression of said SREB2 polypeptide is measured in a cell contacted with said compound, relative to a cell not contacted with said candidate compound.

* * * * *